United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 4

SEQ ID NO: 33489 - DNA, 20 bp, Artificial Sequence
  Description of Artificial Sequence: Synthetic oligonucleotide
  Target: ATXN1; (+) strand; PAM type: NNNNGHTT; PAM sequence: ACCCGCTT
ctcctgacctcaggtgatcc

SEQ ID NO: 33490 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
cttgttacaaatgcaaattc

SEQ ID NO: 33491 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
ttcttgggctttccagcaat

SEQ ID NO: 33492 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
gtaagaaccattttctttta

SEQ ID NO: 33493 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
acacaagcacatattgactt

SEQ ID NO: 33494 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
ttgacttttttgcttaataa

SEQ ID NO: 33495 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
ctcagacccactaacagatc

SEQ ID NO: 33496 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
tgatcacagagaagaatcac

SEQ ID NO: 33497 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
ttttaaatttttttgtagag

SEQ ID NO: 33498 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
aatttttttgtagagaggag

SEQ ID NO: 33499 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
catcatgatggttcatagtg

SEQ ID NO: 33500 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
tgatggttcatagtgagttg

SEQ ID NO: 33501 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
cagtgtgtctgaatacatac

SEQ ID NO: 33502 - DNA, 20 bp, Artificial Sequence
  Description of Artificial Sequence: Synthetic oligonucleotide
  Target: ATXN1; (+) strand; PAM type: NNNNGHTT; PAM sequence: TGACGTTT
cataccagtgtttatggcac

SEQ ID NO: 33503 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
cggaaacacaaaatgcacta

SEQ ID NO: 33504 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
catatgtgactaattttaaa

SEQ ID NO: 33505 - DNA, 20 bp, Artificial Sequence
  Description of Artificial Sequence: Synthetic oligonucleotide
  Target: ATXN1; (+) strand; PAM type: NNNNGHTT; PAM sequence: ATGGGATT
aagtgtaataccttttcaac

SEQ ID NO: 33506 - DNA, 20 bp, Artificial Sequence
  Description of Artificial Sequence: Synthetic oligonucleotide
  Target: ATXN1; (+) strand; PAM type: NNNNGHTT; PAM sequence: CCTAGTTT
tgtaattcgtgcctccctcc

SEQ ID NO: 33507 - DNA, 20 bp, Artificial Sequence
  Description of Artificial Sequence: Synthetic oligonucleotide
  Target: ATXN1; (+) strand; PAM type: NNNNGHTT; PAM sequence: CTATGCTT
ctccctcccctagttttaac

SEQ ID NO: 33508 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
ttggtccaaatatcatgggt

SEQ ID NO: 33509 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
taagttaacaattctgaaat

SEQ ID NO: 33510 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
aattctgaaatactggtttc

SEQ ID NO: 33511 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
gtttctttggcttttagacc

SEQ ID NO: 33512 - DNA, 20 bp, Artificial Sequence
  Description of Artificial Sequence: Synthetic oligonucleotide
  Target: ATXN1; (+) strand; PAM type: NNNNGHTT; PAM sequence: GATTGTTT
ctttggcttttagacctgtt

SEQ ID NO: 33513 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
taggcaaccctcacctcaac

SEQ ID NO: 33514 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
cttcttgggaatattttcta

SEQ ID NO: 33515 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
tatatttatgggctagagta

SEQ ID NO: 33516 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
gaacattcaaattcctcttg

SEQ ID NO: 33517 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
aaagaccctataaaattcag

SEQ ID NO: 33518 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
tttatgactgcattttccac

SEQ ID NO: 33519 - DNA, 20 bp, Artificial Sequence
  Description of Artificial Sequence: Synthetic oligonucleotide
  Target: ATXN1; (+) strand; PAM type: NNNNGHTT; PAM sequence: TTAAGCTT
aggtctgtgagagctaacag

SEQ ID NO: 33520 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
aaaattaacttatataaact

SEQ ID NO: 33521 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gaggtggaggttgcggtgag

SEQ ID NO: 33522 - DNA, 20 bp, Artificial Sequence
  Description of Artificial Sequence: Synthetic oligonucleotide
  Target: ATXN1; (+) strand; PAM type: NNNNGHTT; PAM sequence: CGCGGATT
ataacaacatttgggtcagc

SEQ ID NO: 33523 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
gcatatgtgacagcggtcac

SEQ ID NO: 33524 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
aatagtgtaatacattactc

SEQ ID NO: 33525 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
tgaaaataaatgactatgtt

SEQ ID NO: 33526 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
gagtcggaggttgcagtgag

SEQ ID NO: 33527 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
gtgtggggctaggctaatgt

SEQ ID NO: 33528 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
gctaatgtatgtgtttgtgt

SEQ ID NO: 33529 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
aaaaactttttttaataaga

SEQ ID NO: 33530 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
ttgggaggctgaggcaggag

SEQ ID NO: 33531 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
gcctgggcaacatagtgaga

SEQ ID NO: 33532 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
gagacttagtttctacaaaa

SEQ ID NO: 33533 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
tattcttgtacagctgtaaa

SEQ ID NO: 33534 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
tgctattatgaaagttatca

SEQ ID NO: 33535 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
caaaaagtttttaaaaatta

SEQ ID NO: 33536 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
tatgtctagatgcacaaaaa

SEQ ID NO: 33537 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
aggcaatcgtaaccctatgt

SEQ ID NO: 33538 - DNA, 20 bp, Artificial Sequence
  Description of Artificial Sequence: Synthetic oligonucleotide
  Target: ATXN1; (+) strand; PAM type: NNNNGHTT; PAM sequence: TATAGCTT
aggagcaacaggctgcatta

SEQ ID NO: 33539 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
tgtgtagcaggctgtaccat

SEQ ID NO: 33540 - DNA, 20 bp, Artificial Sequence
  Description of Artificial Sequence: Synthetic oligonucleotide
  Target: ATXN1; (+) strand; PAM type: NNNNGHTT; PAM sequence: GGTAGTTT
atggttggtaatgtcacatt

SEQ ID NO: 33541 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
cccgagccagtagctaaact

SEQ ID NO: 33542 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gccagtagctaaactttttg

SEQ ID NO: 33543 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gctaaactttttgttttgtt

SEQ ID NO: 33544 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ttttgttttgttttttgttt

SEQ ID NO: 33545 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ttgttttttgtttttttgtt

SEQ ID NO: 33546 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
tcactgcaacctccacctcc

SEQ ID NO: 33547 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
cctccacctccaagtgattc

SEQ ID NO: 33548 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
atttatatttttagtagaga

SEQ ID NO: 33549 - DNA, 20 bp, Artificial Sequence
  Description of Artificial Sequence: Synthetic oligonucleotide
  Target: ATXN1; (+) strand; PAM type: NNNNGHTT; PAM sequence: CCATGATT
cagtaggaatagtcaacttt

SEQ ID NO: 33550 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
gccaccaaatcattgctgtc

SEQ ID NO: 33551 - DNA, 20 bp, Artificial Sequence
  Description of Artificial Sequence: Synthetic oligonucleotide
  Target: ATXN1; (+) strand; PAM type: NNNNGHTT; PAM sequence: TGCTGATT
agagtttccaactaatctat

SEQ ID NO: 33552 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
atctattgctgatttactcc

SEQ ID NO: 33553 - DNA, 20 bp, Artificial Sequence
  Description of Artificial Sequence: Synthetic oligonucleotide
  Target: ATXN1; (+) strand; PAM type: NNNNGHTT; PAM sequence: GACGGATT
tcaccacggccacagaattt

SEQ ID NO: 33554 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
tcctcgcaaccattgctatg

SEQ ID NO: 33555 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
gctatgttgagtttcattgt

SEQ ID NO: 33556 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
tcattgtccctgtttgacag

SEQ ID NO: 33557 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
ctttagactttaccacaggt

SEQ ID NO: 33558 - DNA, 20 bp, Artificial Sequence
  Description of Artificial Sequence: Synthetic oligonucleotide
  Target: ATXN1; (+) strand; PAM type: NNNNGHTT; PAM sequence: CTACGTTT
caactttgaggcacccacat

SEQ ID NO: 33559 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
ggcaggtgggcatcattagg

SEQ ID NO: 33560 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
aatatatatgtatatgtgta

SEQ ID NO: 33561 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
acatacatatgcacaaatac

SEQ ID NO: 33562 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
tgtgagtgtgtatgtgtgtg

SEQ ID NO: 33563 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
agtgtgtatgtgtgtgtcta

SEQ ID NO: 33564 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
ttatccttgcaatatgtcta

SEQ ID NO: 33565 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
aatcctgggaaaaatgtgaa

SEQ ID NO: 33566 - DNA, 20 bp, Artificial Sequence
  Description of Artificial Sequence: Synthetic oligonucleotide
  Target: ATXN1; (+) strand; PAM type: NNNNGHTT; PAM sequence: GCAAGCTT
gaagaatgcttggctagatg

SEQ ID NO: 33567 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
cttttccagtaaaaacacaa

SEQ ID NO: 33568 - DNA, 20 bp, Artificial Sequence
  Description of Artificial Sequence: Synthetic oligonucleotide
  Target: ATXN1; (+) strand; PAM type: NNNNGHTT; PAM sequence: TCTAGCTT
aacatgatgtacatttttgc

SEQ ID NO: 33569 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
tgctctagcttgagactaaa

SEQ ID NO: 33570 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
agactaaatcctgtttggag

SEQ ID NO: 33571 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
ctgtttggaggtaggttttc

SEQ ID NO: 33572 - DNA, 20 bp, Artificial Sequence
  Description of Artificial Sequence: Synthetic oligonucleotide
  Target: ATXN1; (+) strand; PAM type: NNNNGHTT; PAM sequence: AACCGATT
ttggctttcagaaaaagttg

SEQ ID NO: 33573 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
cagccagggttaaaaccttc

SEQ ID NO: 33574 - DNA, 20 bp, Artificial Sequence
  Description of Artificial Sequence: Synthetic oligonucleotide
  Target: ATXN1; (+) strand; PAM type: NNNNGHTT; PAM sequence: TCAGGATT
taaacccatctgtccccttg

SEQ ID NO: 33575 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
ctgtccccttgtcaggattt

SEQ ID NO: 33576 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
attaccctggcaagagatga

SEQ ID NO: 33577 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
tggagtttccattttatctc

SEQ ID NO: 33578 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
ctggaagtgtctgaggacat

SEQ ID NO: 33579 - DNA, 20 bp, Artificial Sequence
  Description of Artificial Sequence: Synthetic oligonucleotide
  Target: ATXN1; (+) strand; PAM type: NNNNGHTT; PAM sequence: CCCTGCTT
cacctccaccccctccatct

SEQ ID NO: 33580 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
cccaaatgtcaacagtgctg

SEQ ID NO: 33581 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
tcctggaggacatcctctga

SEQ ID NO: 33582 - DNA, 20 bp, Artificial Sequence
  Description of Artificial Sequence: Synthetic oligonucleotide
  Target: ATXN1; (+) strand; PAM type: NNNNGHTT; PAM sequence: GCTTGTTT
ggaggacatcctctgaagat

SEQ ID NO: 33583 - DNA, 20 bp, Artificial Sequence
  Description of Artificial Sequence: Synthetic oligonucleotide
  Target: ATXN1; (+) strand; PAM type: NNNNGHTT; PAM sequence: GGGGGCTT
tgcatttccactagaacgct

SEQ ID NO: 33584 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
ctagtaaaaagtagctctct

SEQ ID NO: 33585 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
ccttggctccctgcagacag

SEQ ID NO: 33586 - DNA, 20 bp, Artificial Sequence
  Description of Artificial Sequence: Synthetic oligonucleotide
  Target: ATXN1; (+) strand; PAM type: NNNNGHTT; PAM sequence: ATTGGCTT
catggccagaccacatggcc

SEQ ID NO: 33587 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
tccatttattgttgcaaggt

SEQ ID NO: 33588 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
ctgactgtgtgctaaagata

SEQ ID NO: 33589 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
ccatattgtccttgttctca

SEQ ID NO: 33590 - DNA, 20 bp, Artificial Sequence
  Description of Artificial Sequence: Synthetic oligonucleotide
  Target: ATXN1; (+) strand; PAM type: NNNNGHTT; PAM sequence: AGGAGCTT
agaagtattttggcactaga

SEQ ID NO: 33591 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
aaaatatcccttccttttta

SEQ ID NO: 33592 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
actcatccttgaaacctgga

SEQ ID NO: 33593 - DNA, 20 bp, Artificial Sequence
  Description of Artificial Sequence: Synthetic oligonucleotide
  Target: ATXN1; (+) strand; PAM type: NNNNGHTT; PAM sequence: AGGGGCTT
gctttccaggtctacatggg

SEQ ID NO: 33594 - DNA, 20 bp, Artificial Sequence
  Description of Artificial Sequence: Synthetic oligonucleotide
  Target: ATXN1; (+) strand; PAM type: NNNNGHTT; PAM sequence: GCTTGCTT
tccaggtctacatgggaggg

SEQ ID NO: 33595 - DNA, 20 bp, Artificial Sequence
  Description of Artificial Sequence: Synthetic oligonucleotide
  Target: ATXN1; (+) strand; PAM type: NNNNGHTT; PAM sequence: ACTTGCTT
ttgtagcgagggttggcaag

SEQ ID NO: 33596 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
agtcattaattgttcttcat

SEQ ID NO: 33597 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
caggctcacacctgtaatcc

SEQ ID NO: 33598 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
ctcagaggctgagggtggag

SEQ ID NO: 33599 - DNA, 20 bp, Artificial Sequence
  Description of Artificial Sequence: Synthetic oligonucleotide
  Target: ATXN1; (+) strand; PAM type: NNNNGHTT; PAM sequence: GGCAGATT
acagcaacaaaaacaacttt

SEQ ID NO: 33600 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
cagcagttacaacaaaagta

SEQ ID NO: 33601 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
agggctctgtctcagggatc

SEQ ID NO: 33602 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
ctgagcaatttacaaaagaa

SEQ ID NO: 33603 - DNA, 20 bp, Artificial Sequence
  Description of Artificial Sequence: Synthetic oligonucleotide
  Target: ATXN1; (+) strand; PAM type: NNNNGHTT; PAM sequence: GAGAGCTT
gtggcaggcaaaaaatgaga

SEQ ID NO: 33604 - DNA, 20 bp, Artificial Sequence
  Description of Artificial Sequence: Synthetic oligonucleotide
  Target: ATXN1; (+) strand; PAM type: NNNNGHTT; PAM sequence: CCATGATT
gcatgggaaagacctgcccc

SEQ ID NO: 33605 - DNA, 20 bp, Artificial Sequence
  Description of Artificial Sequence: Synthetic oligonucleotide
  Target: ATXN1; (+) strand; PAM type: NNNNGHTT; PAM sequence: GACAGTTT
aagacttctcgccaaccact

SEQ ID NO: 33606 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
tttttttttttttttttttt

SEQ ID NO: 33607 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
tttttttttgcttctagttc

SEQ ID NO: 33608 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
cttcctttttatttaccctt

SEQ ID NO: 33609 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
agggacaatgtgcataggcc

SEQ ID NO: 33610 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
gtgcataggccagaggattt

SEQ ID NO: 33611 - DNA, 20 bp, Artificial Sequence
  Description of Artificial Sequence: Synthetic oligonucleotide
  Target: ATXN1; (+) strand; PAM type: NNNNGHTT; PAM sequence: ATTCGTTT
aggattttatggtttttcta

SEQ ID NO: 33612 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
tttttaaaacttacgagaca

SEQ ID NO: 33613 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
attacttatgagatctttcc

SEQ ID NO: 33614 - DNA, 20 bp, Artificial Sequence
  Description of Artificial Sequence: Synthetic oligonucleotide
  Target: ATXN1; (+) strand; PAM type: NNNNGHTT; PAM sequence: CAAGGCTT
caccagatctataatgcatg

SEQ ID NO: 33615 - DNA, 20 bp, Artificial Sequence
  Description of Artificial Sequence: Synthetic oligonucleotide
  Target: ATXN1; (+) strand; PAM type: NNNNGHTT; PAM sequence: GGCTGCTT
cagaaaaggccagagggcaa

SEQ ID NO: 33616 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
gaagatgggcctcagaggtt

SEQ ID NO: 33617 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
ttatggaattaggcatggga

SEQ ID NO: 33618 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
cttgacaaccagaggaggaa

SEQ ID NO: 33619 - DNA, 20 bp, Artificial Sequence
  Description of Artificial Sequence: Synthetic oligonucleotide
  Target: ATXN1; (+) strand; PAM type: NNNNGHTT; PAM sequence: CAGCGCTT
tttttttaactctcttaaaa

SEQ ID NO: 33620 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
agcgctttgaattttgaaca

SEQ ID NO: 33621 - DNA, 20 bp, Artificial Sequence
  Description of Artificial Sequence: Synthetic oligonucleotide
  Target: ATXN1; (+) strand; PAM type: NNNNGHTT; PAM sequence: CTCGGCTT
agaggttgaaatcccaggtc

SEQ ID NO: 33622 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
cggcttctcagctgacacat

SEQ ID NO: 33623 - DNA, 20 bp, Artificial Sequence
  Description of Artificial Sequence: Synthetic oligonucleotide
  Target: ATXN1; (+) strand; PAM type: NNNNGHTT; PAM sequence: ATGCGTTT
cagctgacacatcagagttt

SEQ ID NO: 33624 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
cttctgggttcaagcaattc

SEQ ID NO: 33625 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 33626 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
caccttggcctccaaaagtg

SEQ ID NO: 33627 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
gtggggctgcatgtgatatt

SEQ ID NO: 33628 - DNA, 20 bp, Artificial Sequence
  Description of Artificial Sequence: Synthetic oligonucleotide
  Target: ATXN1; (+) strand; PAM type: NNNNGHTT; PAM sequence: GTAAGCTT
tttcacgttctgttcttgaa

SEQ ID NO: 33629 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
gtatcctaaaattgaaaagt

SEQ ID NO: 33630 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
tgtgggataatatggtaaat

SEQ ID NO: 33631 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
atctctgtgcccattcttaa

SEQ ID NO: 33632 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
aaaaaaggaggccatttatt

SEQ ID NO: 33633 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
ttggagagttctttaaagca

SEQ ID NO: 33634 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
aagtactggaccaaagtgag

SEQ ID NO: 33635 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
gtgagccttgtttgaactga

SEQ ID NO: 33636 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ccttgtttgaactgagcatg

SEQ ID NO: 33637 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
ttttcacattttccactaaa

SEQ ID NO: 33638 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
cccttggggttcctgtcacg

SEQ ID NO: 33639 - DNA, 20 bp, Artificial Sequence
  Description of Artificial Sequence: Synthetic oligonucleotide
  Target: ATXN1; (+) strand; PAM type: NNNNGHTT; PAM sequence: GTTAGTTT
acgcacacacactccacgtt

SEQ ID NO: 33640 - DNA, 20 bp, Artificial Sequence
  Description of Artificial Sequence: Synthetic oligonucleotide
  Target: ATXN1; (+) strand; PAM type: NNNNGHTT; PAM sequence: ACCAGATT
gggtcccacccccacctcac

SEQ ID NO: 33641 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
taataatcacgtctccactc

SEQ ID NO: 33642 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
aaaacattaatgctactgtg

SEQ ID NO: 33643 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
gtggggcttggaagatgtcc

SEQ ID NO: 33644 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
cctcaccttttcctggagaa

SEQ ID NO: 33645 - DNA, 20 bp, Artificial Sequence
  Description of Artificial Sequence: Synthetic oligonucleotide
  Target: ATXN1; (+) strand; PAM type: NNNNGHTT; PAM sequence: AGTGGATT
agagtttgatatgaacatta

SEQ ID NO: 33646 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
caaacaactctgtagccaac

SEQ ID NO: 33647 - DNA, 20 bp, Artificial Sequence
  Description of Artificial Sequence: Synthetic oligonucleotide
  Target: ATXN1; (+) strand; PAM type: NNNNGHTT; PAM sequence: AGCAGTTT
caataaaagccaagagtcct

SEQ ID NO: 33648 - DNA, 20 bp, Artificial Sequence
  Description of Artificial Sequence: Synthetic oligonucleotide
  Target: ATXN1; (+) strand; PAM type: NNNNGHTT; PAM sequence: TCTGGATT
tagtgagagttaggaactat

SEQ ID NO: 33649 - DNA, 20 bp, Artificial Sequence
  Description of Artificial Sequence: Synthetic oligonucleotide
  Target: ATXN1; (+) strand; PAM type: NNNNGHTT; PAM sequence: CATTGCTT
ttccactcagtctcatttga

SEQ ID NO: 33650 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
atgcaggaagcaataaaaca

SEQ ID NO: 33651 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
aaacaatctgtttgaaaagc

SEQ ID NO: 33652 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aaatgttagcgctggaatgg

SEQ ID NO: 33653 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
tgcctttgactcttatcata

SEQ ID NO: 33654 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
gtggggttaactctgctccc

SEQ ID NO: 33655 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
agaaagaaaatactataaac

SEQ ID NO: 33656 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
acctgtgtttgagctatttc

SEQ ID NO: 33657 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
gctatttctcttgctttcaa

SEQ ID NO: 33658 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
cttgctttcaatgcagattt

SEQ ID NO: 33659 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
atgatgaggtcaacagcatt

SEQ ID NO: 33660 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
aatctaaataaaactttaaa

SEQ ID NO: 33661 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
aaactttaaataaagcttta

SEQ ID NO: 33662 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
gtaaagtagaggttcctctt

SEQ ID NO: 33663 - DNA, 20 bp, Artificial Sequence
  Description of Artificial Sequence: Synthetic oligonucleotide
  Target: ATXN1; (+) strand; PAM type: NNNNGHTT; PAM sequence: GCATGCTT
tagcctaaatatttacccta

SEQ ID NO: 33664 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
cctgttcctcttccttattt

SEQ ID NO: 33665 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
ttcctccttcctttgttctc

SEQ ID NO: 33666 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
cctttgttctcttctgcttt

SEQ ID NO: 33667 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
cttaagatgtgtactatgga

SEQ ID NO: 33668 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
cacagagtaatgactgttaa

SEQ ID NO: 33669 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
tgttaacttggcttcatttt

SEQ ID NO: 33670 - DNA, 20 bp, Artificial Sequence
  Description of Artificial Sequence: Synthetic oligonucleotide
  Target: ATXN1; (+) strand; PAM type: NNNNGHTT; PAM sequence: TTATGATT
tctcctctaaggatatgcct

SEQ ID NO: 33671 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
atcaacttttggatgctgaa

SEQ ID NO: 33672 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
agctggttttactcacaaca

SEQ ID NO: 33673 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
ggttttactcacaacatctg

SEQ ID NO: 33674 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
gtgctcttaaatcccaggcc

SEQ ID NO: 33675 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
gcctgtgaagtggatggatg

SEQ ID NO: 33676 - DNA, 20 bp, Artificial Sequence
  Description of Artificial Sequence: Synthetic oligonucleotide
  Target: ATXN1; (+) strand; PAM type: NNNNGHTT; PAM sequence: GCCTGTTT
gatgttctgtttgtgtggag

SEQ ID NO: 33677 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
agtaattcttcaaccttctt

SEQ ID NO: 33678 - DNA, 20 bp, Artificial Sequence
  Description of Artificial Sequence: Synthetic oligonucleotide
  Target: ATXN1; (+) strand; PAM type: NNNNGHTT; PAM sequence: GCGGGATT
aaggtgcatctgctaggcat

SEQ ID NO: 33679 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
ccataaagaacctgaggcca

SEQ ID NO: 33680 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
taaatagtggcctcaccaaa

SEQ ID NO: 33681 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
ctcaccaaagcctgctttca

SEQ ID NO: 33682 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
tttgtcacttacaacctttt

SEQ ID NO: 33683 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
gaagtagaacttgaacccaa

SEQ ID NO: 33684 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
tttaattccaattttaaaaa

SEQ ID NO: 33685 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
gggactacatggatgagcca

SEQ ID NO: 33686 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
tacatggatgagccatcatg

SEQ ID NO: 33687 - DNA, 20 bp, Artificial Sequence
  Description of Artificial Sequence: Synthetic oligonucleotide
  Target: ATXN1; (+) strand; PAM type: NNNNGHTT; PAM sequence: GGGTGTTT
tcttaccttggcacccaaga

SEQ ID NO: 33688 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
gagggtgtttggcacacagt

SEQ ID NO: 33689 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
taaaaagaatacatgggttc

SEQ ID NO: 33690 - DNA, 20 bp, Artificial Sequence
  Description of Artificial Sequence: Synthetic oligonucleotide
  Target: ATXN1; (+) strand; PAM type: NNNNGHTT; PAM sequence: ACTTGCTT
ctaaggaataaatgactcgg

SEQ ID NO: 33691 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
catttattttctaaaactta

SEQ ID NO: 33692 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
tcgggaggctgaggcagggg

SEQ ID NO: 33693 - DNA, 20 bp, Artificial Sequence
  Description of Artificial Sequence: Synthetic oligonucleotide
  Target: ATXN1; (+) strand; PAM type: NNNNGHTT; PAM sequence: TGCCGTTT
aaaaaaaaaagaactcgact

SEQ ID NO: 33694 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
ccgtttatgcaatttcaaaa

SEQ ID NO: 33695 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
aattgttgtaagacaatttt

SEQ ID NO: 33696 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
caccccacagcctcacatgt

SEQ ID NO: 33697 - DNA, 20 bp, Artificial Sequence
  Description of Artificial Sequence: Synthetic oligonucleotide
  Target: ATXN1; (+) strand; PAM type: NNNNGHTT; PAM sequence: TGCGGCTT
cagcctcacatgtcttggtt

SEQ ID NO: 33698 - DNA, 20 bp, Artificial Sequence
  Description of Artificial Sequence: Synthetic oligonucleotide
  Target: ATXN1; (+) strand; PAM type: NNNNGHTT; PAM sequence: AACAGATT
cgggttgagcgaaaacaagg

SEQ ID NO: 33699 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
agcgaaaacaaggaacagat

SEQ ID NO: 33700 - DNA, 20 bp, Artificial Sequence
  Description of Artificial Sequence: Synthetic oligonucleotide
  Target: ATXN1; (+) strand; PAM type: NNNNGHTT; PAM sequence: GCATGCTT
cagatttgagtttgtccaaa

SEQ ID NO: 33701 - DNA, 20 bp, Artificial Sequence
  Description of Artificial Sequence: Synthetic oligonucleotide
  Target: ATXN1; (+) strand; PAM type: NNNNGHTT; PAM sequence: ATAGGCTT
tgagctgaacgaccgtcgtg

SEQ ID NO: 33702 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
gtgctggcactgcctcggcc

SEQ ID NO: 33703 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
cagggagtacatttctttcc

SEQ ID NO: 33704 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tttctttcctaatgcttgca

SEQ ID NO: 33705 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
cgaatacctcagaggctatg

SEQ ID NO: 33706 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
tttctgatgtagcgatattt

SEQ ID NO: 33707 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
tttggagattatggttcaac

SEQ ID NO: 33708 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
tcaaccagtgatttgtctaa

SEQ ID NO: 33709 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
gtgatttgtctaaacctgtt

SEQ ID NO: 33710 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
aaatccaaaagggtgcaatc

SEQ ID NO: 33711 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
ttgtgagcctccaatgaact

SEQ ID NO: 33712 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
caggcggatcacttgaggcc

SEQ ID NO: 33713 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
cgtgtgtagtagcacatgcc

SEQ ID NO: 33714 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ttgggaggctgaggcaggag

SEQ ID NO: 33715 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
atttgaaaacaaaagcctaa

SEQ ID NO: 33716 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
gcaaaaatgggaaattgaag

SEQ ID NO: 33717 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
ggttgttggtgccaactgga

SEQ ID NO: 33718 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
gccaactggaaaaagtttat

SEQ ID NO: 33719 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
gatctggcattttgccctgg

SEQ ID NO: 33720 - DNA, 20 bp, Artificial Sequence
  Description of Artificial Sequence: Synthetic oligonucleotide
  Target: ATXN1; (+) strand; PAM type: NNNNGHTT; PAM sequence: TCAGGATT
aaaaaatctccctggctgca

SEQ ID NO: 33721 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
cacagtgtgaagagagaaga

SEQ ID NO: 33722 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
gccacatatcatcttgtcct

SEQ ID NO: 33723 - DNA, 20 bp, Artificial Sequence
  Description of Artificial Sequence: Synthetic oligonucleotide
  Target: ATXN1; (+) strand; PAM type: NNNNGHTT; PAM sequence: AGTAGATT
atgtatgtcttatctccctt

SEQ ID NO: 33724 - DNA, 20 bp, Artificial Sequence
  Description of Artificial Sequence: Synthetic oligonucleotide
  Target: ATXN1; (+) strand; PAM type: NNNNGHTT; PAM sequence: GTCAGCTT
cttatctcccttagtagatt

SEQ ID NO: 33725 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
cagcttcttgaggttatctt

SEQ ID NO: 33726 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
cagctctctctctcgcacta

SEQ ID NO: 33727 - DNA, 20 bp, Artificial Sequence
  Description of Artificial Sequence: Synthetic oligonucleotide
  Target: ATXN1; (+) strand; PAM type: NNNNGHTT; PAM sequence: ATAGGCTT
ccaagtgcatgaagtactgt

SEQ ID NO: 33728 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
acggatgaaattaatataaa

SEQ ID NO: 33729 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
aaagccttcttctttgttgt

SEQ ID NO: 33730 - DNA, 20 bp, Artificial Sequence
  Description of Artificial Sequence: Synthetic oligonucleotide
  Target: ATXN1; (+) strand; PAM type: NNNNGHTT; PAM sequence: TAGGGATT
ttctttgttgtgcatgtttt

SEQ ID NO: 33731 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
cggaaactcaaaacaagaaa

SEQ ID NO: 33732 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
tcttaacaagtgagagacta

SEQ ID NO: 33733 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
tactactagactacatcctt

SEQ ID NO: 33734 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
taaagcatgtaaccagactg

SEQ ID NO: 33735 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
attctatccacggcaacagc

SEQ ID NO: 33736 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
aaataaaaggcctttacata

SEQ ID NO: 33737 - DNA, 20 bp, Artificial Sequence
  Description of Artificial Sequence: Synthetic oligonucleotide
  Target: ATXN1; (+) strand; PAM type: NNNNGHTT; PAM sequence: AGTAGATT
tccttttctccccacaaagt

SEQ ID NO: 33738 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
ttccaaattccccaaaggtc

SEQ ID NO: 33739 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
cagagtgactgccttgggga

SEQ ID NO: 33740 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
aagaagtatggtctctgtcc

SEQ ID NO: 33741 - DNA, 20 bp, Artificial Sequence
  Description of Artificial Sequence: Synthetic oligonucleotide
  Target: ATXN1; (+) strand; PAM type: NNNNGHTT; PAM sequence: CTTCGTTT
gaaatagcacttgctgagca

SEQ ID NO: 33742 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
tgctgcctctcaaaaggaaa

SEQ ID NO: 33743 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ctctcaaaaggaaacactgt

SEQ ID NO: 33744 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
ttttttttttaaggtacaaa

SEQ ID NO: 33745 - DNA, 20 bp, Artificial Sequence
  Description of Artificial Sequence: Synthetic oligonucleotide
  Target: ATXN1; (+) strand; PAM type: NNNNGHTT; PAM sequence: ATAGGCTT
cgggacccattctttttgtt

SEQ ID NO: 33746 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
ctataaacatccatcttact

SEQ ID NO: 33747 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
acagtgatattgtgtgcagc

SEQ ID NO: 33748 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
gcatgttaatcactactttt

SEQ ID NO: 33749 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
cttttttgagctttgtgaca

SEQ ID NO: 33750 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
aaatcctgtgtggtggtggt

SEQ ID NO: 33751 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
caatggcccacctgatataa

SEQ ID NO: 33752 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
tgaagacaaaatttcctttg

SEQ ID NO: 33753 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
caaaatttcctttgaaagga

SEQ ID NO: 33754 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
aaatcaaacattgctctact

SEQ ID NO: 33755 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
ttggggttttgaaaatggaa

SEQ ID NO: 33756 - DNA, 20 bp, Artificial Sequence
  Description of Artificial Sequence: Synthetic oligonucleotide
  Target: ATXN1; (+) strand; PAM type: NNNNGHTT; PAM sequence: GATTGTTT
ggttttgaaaatggaacatt

SEQ ID NO: 33757 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
acattgattgtttgtaaaag

SEQ ID NO: 33758 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
ctaattaaaatgtgacacgg

SEQ ID NO: 33759 - DNA, 20 bp, Artificial Sequence
  Description of Artificial Sequence: Synthetic oligonucleotide
  Target: ATXN1; (+) strand; PAM type: NNNNGHTT; PAM sequence: AACGGATT
tgttagacacttggtacagg

SEQ ID NO: 33760 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
actatcagagagtgaggtcg

SEQ ID NO: 33761 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
aacccatccaacccattttg

SEQ ID NO: 33762 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
tataagaaagctaaagataa

SEQ ID NO: 33763 - DNA, 20 bp, Artificial Sequence
  Description of Artificial Sequence: Synthetic oligonucleotide
  Target: ATXN1; (+) strand; PAM type: NNNNGHTT; PAM sequence: ACCTGCTT
aaatgtctagacttattcaa

SEQ ID NO: 33764 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
tcatagttcaaacttgtact

SEQ ID NO: 33765 - DNA, 20 bp, Artificial Sequence
  Description of Artificial Sequence: Synthetic oligonucleotide
  Target: ATXN1; (+) strand; PAM type: NNNNGHTT; PAM sequence: ATCAGCTT
aaacttgtactcactgcttc

SEQ ID NO: 33766 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
tcatcagcttatgaaccata

SEQ ID NO: 33767 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
cttcactcaggcctttttat

SEQ ID NO: 33768 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
gtaatgcctccttaagcaga

SEQ ID NO: 33769 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
ctcaatatgttggtggactg

SEQ ID NO: 33770 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
aagtatacaatttaaggatc

SEQ ID NO: 33771 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
aatggactaaaagttgagct

SEQ ID NO: 33772 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
ttgggcaaattatcttctat

SEQ ID NO: 33773 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
tattaggcagtgaaacaata

SEQ ID NO: 33774 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
agtgaaacaataagtggttt

SEQ ID NO: 33775 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
aaacaataagtggttttttt

SEQ ID NO: 33776 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
aataagtggtttttttgttt

SEQ ID NO: 33777 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
ggtttttttgtttgtttgtt

SEQ ID NO: 33778 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
aacctctgcctcctgggttc

SEQ ID NO: 33779 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttaggagaga

SEQ ID NO: 33780 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
ctccttggcctcccaaagtg

SEQ ID NO: 33781 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
tattatttcaacacagaagt

SEQ ID NO: 33782 - DNA, 20 bp, Artificial Sequence
  Description of Artificial Sequence: Synthetic oligonucleotide
  Target: ATXN1; (+) strand; PAM type: NNNNGHTT; PAM sequence: TAGGGCTT
tacccgaagcagctgggaaa

SEQ ID NO: 33783 - DNA, 20 bp, Artificial Sequence
  Description of Artificial Sequence: Synthetic oligonucleotide
  Target: ATXN1; (+) strand; PAM type: NNNNGHTT; PAM sequence: AATCGTTT
aagaaggaggggaaattttt

SEQ ID NO: 33784 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
tgcaaacaggatcgtcagga

SEQ ID NO: 33785 - DNA, 20 bp, Artificial Sequence
  Description of Artificial Sequence: Synthetic oligonucleotide
  Target: ATXN1; (+) strand; PAM type: NNNNGHTT; PAM sequence: CCAAGCTT
tttattcacaagaagaacta

SEQ ID NO: 33786 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
caaaaaaaaaaaaaaaaaac

SEQ ID NO: 33787 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
ctgataacaaatggtcatta

SEQ ID NO: 33788 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
ttcttagaaggatctctcaa

SEQ ID NO: 33789 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
ctcctaaaaaatctaaatta

SEQ ID NO: 33790 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
tccctgtggccttttacaga

SEQ ID NO: 33791 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
gtactaagtatagtccctgg

SEQ ID NO: 33792 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
taaacttttatttcataggg

SEQ ID NO: 33793 - DNA, 20 bp, Artificial Sequence
  Description of Artificial Sequence: Synthetic oligonucleotide
  Target: ATXN1; (+) strand; PAM type: NNNNGHTT; PAM sequence: AAACGTTT
tcatcttgctcgtacaccct

SEQ ID NO: 33794 - DNA, 20 bp, Artificial Sequence
  Description of Artificial Sequence: Synthetic oligonucleotide
  Target: ATXN1; (+) strand; PAM type: NNNNGHTT; PAM sequence: CACCGCTT
tctgaatcccatcacatttt

SEQ ID NO: 33795 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
ctgaattcctctagtaggcc

SEQ ID NO: 33796 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
tcattgcatactcagtagaa

SEQ ID NO: 33797 - DNA, 20 bp, Artificial Sequence
  Description of Artificial Sequence: Synthetic oligonucleotide
  Target: ATXN1; (+) strand; PAM type: NNNNGHTT; PAM sequence: GTAGGCTT
tggcttttatcttgcatggt

SEQ ID NO: 33798 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
acctaaccctacaatatttc

SEQ ID NO: 33799 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
ttttatttattttttagaga

SEQ ID NO: 33800 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
agccttgaactgctgggctc

SEQ ID NO: 33801 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
ggctcaagtgattctcccac

SEQ ID NO: 33802 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagtca

SEQ ID NO: 33803 - DNA, 20 bp, Artificial Sequence
  Description of Artificial Sequence: Synthetic oligonucleotide
  Target: ATXN1; (+) strand; PAM type: NNNNGHTT; PAM sequence: TATGGCTT
atcaataataatttccaagt

SEQ ID NO: 33804 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
tcaagtagagagagggagtt

SEQ ID NO: 33805 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aagctccgcctcccaggttc

SEQ ID NO: 33806 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtatatttactagaga

SEQ ID NO: 33807 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
actttttttttaatggccta

SEQ ID NO: 33808 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
tcccagacaactgatgccat

SEQ ID NO: 33809 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
caaagaaggctaaatataaa

SEQ ID NO: 33810 - DNA, 20 bp, Artificial Sequence
  Description of Artificial Sequence: Synthetic oligonucleotide
  Target: ATXN1; (+) strand; PAM type: NNNNGHTT; PAM sequence: CGAAGATT
ccactaccctagttcatcct

SEQ ID NO: 33811 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
caacgaatgaaggtaaagca

SEQ ID NO: 33812 - DNA, 20 bp, Artificial Sequence
  Description of Artificial Sequence: Synthetic oligonucleotide
  Target: ATXN1; (+) strand; PAM type: NNNNGHTT; PAM sequence: GGGTGATT
aaagcatgttgtttgagaca

SEQ ID NO: 33813 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
tcccaacgctctggtgtagc

SEQ ID NO: 33814 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
aaagatatttggcacataat

SEQ ID NO: 33815 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
aatgcataacccttcctact

SEQ ID NO: 33816 - DNA, 20 bp, Artificial Sequence
  Description of Artificial Sequence: Synthetic oligonucleotide
  Target: ATXN1; (+) strand; PAM type: NNNNGHTT; PAM sequence: ATCGGTTT
tgcatttgtacagaaatgga

SEQ ID NO: 33817 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
ttaagcacatcaactccctc

SEQ ID NO: 33818 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
actccctctgtggctttcag

SEQ ID NO: 33819 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
tattttattattattatact

SEQ ID NO: 33820 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
caacatatttctatttgttc

SEQ ID NO: 33821 - DNA, 20 bp, Artificial Sequence
  Description of Artificial Sequence: Synthetic oligonucleotide
  Target: ATXN1; (+) strand; PAM type: NNNNGHTT; PAM sequence: ATTCGCTT
ttgttccttagctttcaagc

SEQ ID NO: 33822 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
tcaggcctcgatatgcccac

SEQ ID NO: 33823 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
acatatgtcttacaactgtc

SEQ ID NO: 33824 - DNA, 20 bp, Artificial Sequence
  Description of Artificial Sequence: Synthetic oligonucleotide
  Target: ATXN1; (+) strand; PAM type: NNNNGHTT; PAM sequence: TATTGTTT
caactgtcatgagctttttg

SEQ ID NO: 33825 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
tacaggtgcatgacactgca

SEQ ID NO: 33826 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
gacactgcacatggcttccc

SEQ ID NO: 33827 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
tgcatgtaaatattttagca

SEQ ID NO: 33828 - DNA, 20 bp, Artificial Sequence
  Description of Artificial Sequence: Synthetic oligonucleotide
  Target: ATXN1; (+) strand; PAM type: NNNNGHTT; PAM sequence: GGCTGTTT
gtaatttaaaatgcccaaat

SEQ ID NO: 33829 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
accgctcatcctatcatcta

SEQ ID NO: 33830 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
aaattatgtaaatcctcact

SEQ ID NO: 33831 - DNA, 20 bp, Artificial Sequence
  Description of Artificial Sequence: Synthetic oligonucleotide
  Target: ATXN1; (+) strand; PAM type: NNNNGHTT; PAM sequence: GCGTGTTT
gagcctaactgcaaacattt

SEQ ID NO: 33832 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
tttgcgtgtttttatttaac

SEQ ID NO: 33833 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
ttacttttgggaagctggga

SEQ ID NO: 33834 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
ggcctataaaatctaacagt

SEQ ID NO: 33835 - DNA, 20 bp, Artificial Sequence
  Description of Artificial Sequence: Synthetic oligonucleotide
  Target: ATXN1; (+) strand; PAM type: NNNNGHTT; PAM sequence: TGCGGTTT
ccaattttgcataatgtctc

SEQ ID NO: 33836 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
taatgtctctgcggttttgt

SEQ ID NO: 33837 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
catgtgatacacacacattt

SEQ ID NO: 33838 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
ctgggtactggcactcgcct

SEQ ID NO: 33839 - DNA, 20 bp, Artificial Sequence
  Description of Artificial Sequence: Synthetic oligonucleotide
  Target: ATXN1; (+) strand; PAM type: NNNNGHTT; PAM sequence: GGCAGCTT
gaagtacattaggacagagg

SEQ ID NO: 33840 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
acttaagttgccagggtagc

SEQ ID NO: 33841 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
agcatgagctttttaaaaac

SEQ ID NO: 33842 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
aaaacagttgtttctggcct

SEQ ID NO: 33843 - DNA, 20 bp, Artificial Sequence
  Description of Artificial Sequence: Synthetic oligonucleotide
  Target: ATXN1; (+) strand; PAM type: NNNNGHTT; PAM sequence: TTAGGCTT
ttgtttctggccttcctgtt

SEQ ID NO: 33844 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
gagttcacatgcagctaagg

SEQ ID NO: 33845 - DNA, 20 bp, Artificial Sequence
  Description of Artificial Sequence: Synthetic oligonucleotide
  Target: ATXN1; (+) strand; PAM type: NNNNGHTT; PAM sequence: AACAGATT
ataatgactaatttttaaat

SEQ ID NO: 33846 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
aataacagattggtacagct

SEQ ID NO: 33847 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
tggaaaggtcctcagacctt

SEQ ID NO: 33848 - DNA, 20 bp, Artificial Sequence
  Description of Artificial Sequence: Synthetic oligonucleotide
  Target: ATXN1; (+) strand; PAM type: NNNNGHTT; PAM sequence: TGGTGCTT
gtcctcagaccttttaggtt

SEQ ID NO: 33849 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
aaaggctgtagagttcaaca

SEQ ID NO: 33850 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
agggtaaagacaagcaggtg

SEQ ID NO: 33851 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
gaaaaaaacatggaatacaa

SEQ ID NO: 33852 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
agtttagccacgactggcag

SEQ ID NO: 33853 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
cttcatcttttgaagtatat

SEQ ID NO: 33854 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
ttcgagagggccacatattt

SEQ ID NO: 33855 - DNA, 20 bp, Artificial Sequence
  Description of Artificial Sequence: Synthetic oligonucleotide
  Target: ATXN1; (+) strand; PAM type: NNNNGHTT; PAM sequence: GGTAGATT
tgaggtttcagagacagtga

SEQ ID NO: 33856 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
actccggcgacacactgagc

SEQ ID NO: 33857 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
cacacctatgccttttacaa

SEQ ID NO: 33858 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
gaactccttcacccacagag

SEQ ID NO: 33859 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
tgatctgccttatctctgcc

SEQ ID NO: 33860 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
agagggaaaccaggaatctt

SEQ ID NO: 33861 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
aaagcactttattttcagta

SEQ ID NO: 33862 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
aaatagaattgtcatatctg

SEQ ID NO: 33863 - DNA, 20 bp, Artificial Sequence
  Description of Artificial Sequence: Synthetic oligonucleotide
  Target: ATXN1; (+) strand; PAM type: NNNNGHTT; PAM sequence: GGCTGTTT
ttctttgtcattttgcatca

SEQ ID NO: 33864 - DNA, 20 bp, Artificial Sequence
  Description of Artificial Sequence: Synthetic oligonucleotide
  Target: ATXN1; (+) strand; PAM type: NNNNGHTT; PAM sequence: TCATGATT
attttgcatcaggctgtttt

SEQ ID NO: 33865 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
ctgggtccttgtgatgttcc

SEQ ID NO: 33866 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
acatgtgatattagggcagc

SEQ ID NO: 33867 - DNA, 20 bp, Artificial Sequence
  Description of Artificial Sequence: Synthetic oligonucleotide
  Target: ATXN1; (+) strand; PAM type: NNNNGHTT; PAM sequence: CCGGGATT
caatggtttcctctactggt

SEQ ID NO: 33868 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
tcctctactggtccgggatt

SEQ ID NO: 33869 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
cttcacagatgagagaattt

SEQ ID NO: 33870 - DNA, 20 bp, Artificial Sequence
  Description of Artificial Sequence: Synthetic oligonucleotide
  Target: ATXN1; (+) strand; PAM type: NNNNGHTT; PAM sequence: CCTTGATT
ttaaggtgggcagggcctag

SEQ ID NO: 33871 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
tagccttgattacaggctct

SEQ ID NO: 33872 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
agagaggagagaagacaagg

SEQ ID NO: 33873 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
agtggacagaaattaaataa

SEQ ID NO: 33874 - DNA, 20 bp, Artificial Sequence
  Description of Artificial Sequence: Synthetic oligonucleotide
  Target: ATXN1; (+) strand; PAM type: NNNNGHTT; PAM sequence: ACCTGATT
atgcaggactatttagtggt

SEQ ID NO: 33875 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
attattctgatcacaaacaa

SEQ ID NO: 33876 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
cttcagagagtgtctatctg

SEQ ID NO: 33877 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
tgcttgaagcaaacgaaact

SEQ ID NO: 33878 - DNA, 20 bp, Artificial Sequence
  Description of Artificial Sequence: Synthetic oligonucleotide
  Target: ATXN1; (+) strand; PAM type: NNNNGHTT; PAM sequence: GCTAGTTT
tggactagccttacgagaat

SEQ ID NO: 33879 - DNA, 20 bp, Artificial Sequence
  Description of Artificial Sequence: Synthetic oligonucleotide
  Target: ATXN1; (+) strand; PAM type: NNNNGHTT; PAM sequence: AGCAGTTT
agagctatggctgtgcctat

SEQ ID NO: 33880 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
gggagcggcctggatctgcc

SEQ ID NO: 33881 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ggcctggatctgccttctga

SEQ ID NO: 33882 - DNA, 20 bp, Artificial Sequence
  Description of Artificial Sequence: Synthetic oligonucleotide
  Target: ATXN1; (+) strand; PAM type: NNNNGHTT; PAM sequence: CGGTGATT
agcctgcgtgcacaaacatt

SEQ ID NO: 33883 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
ctggaaaatcacagcagagg

SEQ ID NO: 33884 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
tatggggaagtctgttggga

SEQ ID NO: 33885 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
gctatttaataatagtatct

SEQ ID NO: 33886 - DNA, 20 bp, Artificial Sequence
  Description of Artificial Sequence: Synthetic oligonucleotide
  Target: ATXN1; (+) strand; PAM type: NNNNGHTT; PAM sequence: GTAAGCTT
acggtggaaggaatgctgaa

SEQ ID NO: 33887 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
cttctgtaagagctcactgg

SEQ ID NO: 33888 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
gggtgaagacagaaacaaag

SEQ ID NO: 33889 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
actcagggccttccatgaat

SEQ ID NO: 33890 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
atattttaaagtgcacagat

SEQ ID NO: 33891 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
aaagtgcacagatgcctgat

SEQ ID NO: 33892 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
gagcacaaattaatatttac

SEQ ID NO: 33893 - DNA, 20 bp, Artificial Sequence
  Description of Artificial Sequence: Synthetic oligonucleotide
  Target: ATXN1; (+) strand; PAM type: NNNNGHTT; PAM sequence: CGTTGTTT
tactccatcccactgtgcca

SEQ ID NO: 33894 - DNA, 20 bp, Artificial Sequence
  Description of Artificial Sequence: Synthetic oligonucleotide
  Target: ATXN1; (+) strand; PAM type: NNNNGHTT; PAM sequence: TGCGGATT
tattcacacaccttggagcc

SEQ ID NO: 33895 - DNA, 20 bp, Artificial Sequence
  Description of Artificial Sequence: Synthetic oligonucleotide
  Target: ATXN1; (+) strand; PAM type: NNNNGHTT; PAM sequence: AGCAGATT
attactttgtccttcaaaac

SEQ ID NO: 33896 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
tcagttgtaatctgggtccc

SEQ ID NO: 33897 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
ttgtaagtaacaaagagatg

SEQ ID NO: 33898 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
agttctcatgctatcccacc

SEQ ID NO: 33899 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
agcatccctgaaacacggct

SEQ ID NO: 33900 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
ccacaatactgccacagagg

SEQ ID NO: 33901 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
cttttgaggacagaaggcaa

SEQ ID NO: 33902 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
gagccattttgggagaagga

SEQ ID NO: 33903 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
gattctgtcattcattttga

SEQ ID NO: 33904 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
ctaccctggccaaaggaaaa

SEQ ID NO: 33905 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
tgtctatctctgtctctctg

SEQ ID NO: 33906 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
ctctgtcttgttttttcctt

SEQ ID NO: 33907 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
ccctctatccagcatcccct

SEQ ID NO: 33908 - DNA, 20 bp, Artificial Sequence
  Description of Artificial Sequence: Synthetic oligonucleotide
  Target: ATXN1; (+) strand; PAM type: NNNNGHTT; PAM sequence: TCGAGATT
aagaccaagtagaggcagga

SEQ ID NO: 33909 - DNA, 20 bp, Artificial Sequence
  Description of Artificial Sequence: Synthetic oligonucleotide
  Target: ATXN1; (+) strand; PAM type: NNNNGHTT; PAM sequence: ACCAGATT
aataaagtctattctcatgg

SEQ ID NO: 33910 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
tccatgtccttgactggggg

SEQ ID NO: 33911 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
cttttaaggttaaggtaaac

SEQ ID NO: 33912 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
cactgttgacatcttgtgct

SEQ ID NO: 33913 - DNA, 20 bp, Artificial Sequence
  Description of Artificial Sequence: Synthetic oligonucleotide
  Target: ATXN1; (+) strand; PAM type: NNNNGHTT; PAM sequence: GGATGTTT
gggctgtcctgtgtgttgca

SEQ ID NO: 33914 - DNA, 20 bp, Artificial Sequence
  Description of Artificial Sequence: Synthetic oligonucleotide
  Target: ATXN1; (+) strand; PAM type: NNNNGHTT; PAM sequence: CCTCGTTT
aatccctaagacagagtggt

SEQ ID NO: 33915 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
taagacagagtggtcctcgt

SEQ ID NO: 33916 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
atttttccacactttcattt

SEQ ID NO: 33917 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
tgatttgttgtaaatgcctc

SEQ ID NO: 33918 - DNA, 20 bp, Artificial Sequence
  Description of Artificial Sequence: Synthetic oligonucleotide
  Target: ATXN1; (+) strand; PAM type: NNNNGHTT; PAM sequence: TTCCGTTT
tttgagcagaacatcaaggg

SEQ ID NO: 33919 - DNA, 20 bp, Artificial Sequence
  Description of Artificial Sequence: Synthetic oligonucleotide
  Target: ATXN1; (+) strand; PAM type: NNNNGHTT; PAM sequence: CAGCGTTT
aaagtgacctcaactgcctc

SEQ ID NO: 33920 - DNA, 20 bp, Artificial Sequence
  Description of Artificial Sequence: Synthetic oligonucleotide
  Target: ATXN1; (+) strand; PAM type: NNNNGHTT; PAM sequence: GGAAGTTT
tgagctctagaagccaggat

SEQ ID NO: 33921 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
ttttcaggcagatacaactc

SEQ ID NO: 33922 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
atacaactcccaggctttca

SEQ ID NO: 33923 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
aaaagaaagcagacgcagaa

SEQ ID NO: 33924 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
aacactctataaaaattcct

SEQ ID NO: 33925 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
gctgcactcttttattattg

SEQ ID NO: 33926 - DNA, 20 bp, Artificial Sequence
  Description of Artificial Sequence: Synthetic oligonucleotide
  Target: ATXN1; (+) strand; PAM type: NNNNGHTT; PAM sequence: AACAGATT
ttattgagctgattcaaagg

SEQ ID NO: 33927 - DNA, 20 bp, Artificial Sequence
  Description of Artificial Sequence: Synthetic oligonucleotide
  Target: ATXN1; (+) strand; PAM type: NNNNGHTT; PAM sequence: CAAGGCTT
ctatctgtaaaatatggttg

SEQ ID NO: 33928 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
ttttttttttttttctgaga

SEQ ID NO: 33929 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aacctctggctcccaggttc

SEQ ID NO: 33930 - DNA, 20 bp, Artificial Sequence
  Description of Artificial Sequence: Synthetic oligonucleotide
  Target: ATXN1; (+) strand; PAM type: NNNNGHTT; PAM sequence: TAGGGATT
tgcctcagcctctggagtag

SEQ ID NO: 33931 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
ccaccatgcccagcacattt

SEQ ID NO: 33932 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtgtttttagttgcga

SEQ ID NO: 33933 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
tgcctcggcctcccaaagtg

SEQ ID NO: 33934 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
tgggttggtgcaaaagtaat

SEQ ID NO: 33935 - DNA, 20 bp, Artificial Sequence
  Description of Artificial Sequence: Synthetic oligonucleotide
  Target: ATXN1; (+) strand; PAM type: NNNNGHTT; PAM sequence: AAGCGCTT
gcaccaacataatatttctt

SEQ ID NO: 33936 - DNA, 20 bp, Artificial Sequence
  Description of Artificial Sequence: Synthetic oligonucleotide
  Target: ATXN1; (+) strand; PAM type: NNNNGHTT; PAM sequence: AAGAGCTT
ttaagcgcttgcactgttcc

SEQ ID NO: 33937 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
aggtagctatcattattaag

SEQ ID NO: 33938 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
aaatgaggaaaggagacagg

SEQ ID NO: 33939 - DNA, 20 bp, Artificial Sequence
  Description of Artificial Sequence: Synthetic oligonucleotide
  Target: ATXN1; (+) strand; PAM type: NNNNGHTT; PAM sequence: GGGAGATT
cagcacaagctgatgccaga

SEQ ID NO: 33940 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
tacacatcaccagaccgacg

SEQ ID NO: 33941 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
ccccaagtggggagaggtta

SEQ ID NO: 33942 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
ggttaatgggtttgcggtta

SEQ ID NO: 33943 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
agctgggccctgaagtagag

SEQ ID NO: 33944 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
attagaattacaatgtgaag

SEQ ID NO: 33945 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
ccttactgactgtagagacc

SEQ ID NO: 33946 - DNA, 20 bp, Artificial Sequence
  Description of Artificial Sequence: Synthetic oligonucleotide
  Target: ATXN1; (+) strand; PAM type: NNNNGHTT; PAM sequence: GGATGTTT
tttgacagtgggtgataaca

SEQ ID NO: 33947 - DNA, 20 bp, Artificial Sequence
  Description of Artificial Sequence: Synthetic oligonucleotide
  Target: ATXN1; (+) strand; PAM type: NNNNGHTT; PAM sequence: GTTCGTTT
atagcatcagagtatttttt

SEQ ID NO: 33948 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aacctccgcctcccaggttc

SEQ ID NO: 33949 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgccttagcctcccaagtag

SEQ ID NO: 33950 - DNA, 20 bp, Artificial Sequence
  Description of Artificial Sequence: Synthetic oligonucleotide
  Target: ATXN1; (+) strand; PAM type: NNNNGHTT; PAM sequence: TAGGGTTT
ttttgtatttttagtagaga

SEQ ID NO: 33951 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
catctcggcctcccaaaatg

SEQ ID NO: 33952 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
tgtgagccactgagcctggc

SEQ ID NO: 33953 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
tctcttatcatagaagcatt

SEQ ID NO: 33954 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
tagaagcattctgtgtttct

SEQ ID NO: 33955 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
gcatggaggcacaggcagtt

SEQ ID NO: 33956 - DNA, 20 bp, Artificial Sequence
  Description of Artificial Sequence: Synthetic oligonucleotide
  Target: ATXN1; (+) strand; PAM type: NNNNGHTT; PAM sequence: TGTGGATT
gtggagctcaaacccaagtc

SEQ ID NO: 33957 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
tttttaagtacacgtgcctg

SEQ ID NO: 33958 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
aaatgttaggaaaaaaattc

SEQ ID NO: 33959 - DNA, 20 bp, Artificial Sequence
  Description of Artificial Sequence: Synthetic oligonucleotide
  Target: ATXN1; (+) strand; PAM type: NNNNGHTT; PAM sequence: CATTGCTT
aattctgaagtttactgata

SEQ ID NO: 33960 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
agtccctgaatcccccacat

SEQ ID NO: 33961 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
gcaactattggaataaggct

SEQ ID NO: 33962 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
tgtatacacactatttccag

SEQ ID NO: 33963 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
tccagacatgtttttgaaac

SEQ ID NO: 33964 - DNA, 20 bp, Artificial Sequence
  Description of Artificial Sequence: Synthetic oligonucleotide
  Target: ATXN1; (+) strand; PAM type: NNNNGHTT; PAM sequence: CCATGATT
ttgttacttacacagatgtt

SEQ ID NO: 33965 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
ttgcatatggctcagccaaa

SEQ ID NO: 33966 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
gtgtaagggagaggagaatg

SEQ ID NO: 33967 - DNA, 20 bp, Artificial Sequence
  Description of Artificial Sequence: Synthetic oligonucleotide
  Target: ATXN1; (+) strand; PAM type: NNNNGHTT; PAM sequence: ACAAGATT
gtgtgtatgtgtgtgtagta

SEQ ID NO: 33968 - DNA, 20 bp, Artificial Sequence
  Description of Artificial Sequence: Synthetic oligonucleotide
  Target: ATXN1; (+) strand; PAM type: NNNNGHTT; PAM sequence: ATGGGATT
ctcttgactgagtcattcct

SEQ ID NO: 33969 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
ctgcgtacatccaaggttcg

SEQ ID NO: 33970 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
cgggagaaatgtgaatgcat

SEQ ID NO: 33971 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
ctgacaacagcagagccctc

SEQ ID NO: 33972 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
tatcagagagcagcccgcct

SEQ ID NO: 33973 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
aaggagggtctgtgcagatg

SEQ ID NO: 33974 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
caggagcgtagataggagtg

SEQ ID NO: 33975 - DNA, 20 bp, Artificial Sequence
  Description of Artificial Sequence: Synthetic oligonucleotide
  Target: ATXN1; (+) strand; PAM type: NNNNGHTT; PAM sequence: CCAGGTTT
tgagattaaatccaagcata

SEQ ID NO: 33976 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
tgtctgccaaggacttctaa

SEQ ID NO: 33977 - DNA, 20 bp, Artificial Sequence
  Description of Artificial Sequence: Synthetic oligonucleotide
  Target: ATXN1; (+) strand; PAM type: NNNNGHTT; PAM sequence: ACCCGTTT
cttctaattcagtttgttcc

SEQ ID NO: 33978 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
gttttatttttaaactcgag

SEQ ID NO: 33979 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
gattttattcctggaatgtt

SEQ ID NO: 33980 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
aatgggcaaattcacttcag

SEQ ID NO: 33981 - DNA, 20 bp, Artificial Sequence
  Description of Artificial Sequence: Synthetic oligonucleotide
  Target: ATXN1; (+) strand; PAM type: NNNNGHTT; PAM sequence: CCTTGATT
ctcttttctgaagaaagctg

SEQ ID NO: 33982 - DNA, 20 bp, Artificial Sequence
  Description of Artificial Sequence: Synthetic oligonucleotide
  Target: ATXN1; (+) strand; PAM type: NNNNGHTT; PAM sequence: CTGTGCTT
ccttcttcgccactatgcaa

SEQ ID NO: 33983 - DNA, 20 bp, Artificial Sequence
  Description of Artificial Sequence: Synthetic oligonucleotide
  Target: ATXN1; (+) strand; PAM type: NNNNGHTT; PAM sequence: AGCAGATT
tctaacaggatgggggcaaa

SEQ ID NO: 33984 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
gggcaaaagcagattcctta

SEQ ID NO: 33985 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
gagatcgcgggggagccaaa

SEQ ID NO: 33986 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
aagaggaccagtctctgcgc

SEQ ID NO: 33987 - DNA, 20 bp, Artificial Sequence
  Description of Artificial Sequence: Synthetic oligonucleotide
  Target: ATXN1; (+) strand; PAM type: NNNNGHTT; PAM sequence: AATCGATT
ccaaaagtatttacttcaaa

SEQ ID NO: 33988 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
tctgttccatagctcatttg

SEQ ID NO: 33989 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
agctcatttgcatggttttc

SEQ ID NO: 33990 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
gtcaatttccttttctttcc

SEQ ID NO: 33991 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
taaagcttattagctgtgtg

SEQ ID NO: 33992 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
tattagctgtgtgtgatgtt

SEQ ID NO: 33993 - DNA, 20 bp, Artificial Sequence
  Description of Artificial Sequence: Synthetic oligonucleotide
  Target: ATXN1; (+) strand; PAM type: NNNNGHTT; PAM sequence: AACAGATT
tgtttacagcttgaagacca

SEQ ID NO: 33994 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
gatatatttgtgctgttaaa

SEQ ID NO: 33995 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
gtgctgttaaaatatgcttt

SEQ ID NO: 33996 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
cacataagcaccaccacaaa

SEQ ID NO: 33997 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
gatctagaagaagcagagac

SEQ ID NO: 33998 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
acatttgcttataaactatg

SEQ ID NO: 33999 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
tgggctgacattcaaacatt

SEQ ID NO: 34000 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
gtatttcaatctctcaaaac

SEQ ID NO: 34001 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
gagtgaatatacagcaataa

SEQ ID NO: 34002 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
aacaatacaatgaataggtt

SEQ ID NO: 34003 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
tagtagacaatgtcctatag

SEQ ID NO: 34004 - DNA, 20 bp, Artificial Sequence
  Description of Artificial Sequence: Synthetic oligonucleotide
  Target: ATXN1; (+) strand; PAM type: NNNNGHTT; PAM sequence: GTTGGCTT
ttaaattaaattttatagtt

SEQ ID NO: 34005 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
aagaagaactgagtgctcca

SEQ ID NO: 34006 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
gttgtgataaagcatcattt

SEQ ID NO: 34007 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
ttactgtcaaatacgatcca

SEQ ID NO: 34008 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
ttaagtcttaattatctagt

SEQ ID NO: 34009 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
attatctagtggaagattat

SEQ ID NO: 34010 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
ggaagattatccaagattct

SEQ ID NO: 34011 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
tttctctttcccttctaaaa

SEQ ID NO: 34012 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
tgaatggaaatgttcctgag

SEQ ID NO: 34013 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
ttaaaatagagaatacatgt

SEQ ID NO: 34014 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
accacacagcataattttct

SEQ ID NO: 34015 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
cagcataattttctatctgc

SEQ ID NO: 34016 - DNA, 20 bp, Artificial Sequence
  Description of Artificial Sequence: Synthetic oligonucleotide
  Target: ATXN1; (+) strand; PAM type: NNNNGHTT; PAM sequence: GATTGATT
ataattttctatctgcttct

SEQ ID NO: 34017 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
attcttcattctcccttgat

SEQ ID NO: 34018 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
cagtttgtcatttaatacat

SEQ ID NO: 34019 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
ggcactgtgctgctaggagc

SEQ ID NO: 34020 - DNA, 20 bp, Artificial Sequence
  Description of Artificial Sequence: Synthetic oligonucleotide
  Target: ATXN1; (+) strand; PAM type: NNNNGHTT; PAM sequence: TAGTGCTT
caggaagctccctgctctca

SEQ ID NO: 34021 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
ctgtggctcctagaaagaag

SEQ ID NO: 34022 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
agtgcattcgaaagacactg

SEQ ID NO: 34023 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
atgcagaggaagagggacag

SEQ ID NO: 34024 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
atggggaattcttgggtaga

SEQ ID NO: 34025 - DNA, 20 bp, Artificial Sequence
  Description of Artificial Sequence: Synthetic oligonucleotide
  Target: ATXN1; (+) strand; PAM type: NNNNGHTT; PAM sequence: TGGTGATT
gtagatgaggtttggtggga

SEQ ID NO: 34026 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
catggatccatcaaggcact

SEQ ID NO: 34027 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 34028 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
ctcctgacctcaggtgatct

SEQ ID NO: 34029 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcttcagcctcccaaagtg

SEQ ID NO: 34030 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
ttacctatcctcatggaaat

SEQ ID NO: 34031 - DNA, 20 bp, Artificial Sequence
  Description of Artificial Sequence: Synthetic oligonucleotide
  Target: ATXN1; (+) strand; PAM type: NNNNGHTT; PAM sequence: TCAAGCTT
gtggtctggtgaccattttt

SEQ ID NO: 34032 - DNA, 20 bp, Artificial Sequence
  Description of Artificial Sequence: Synthetic oligonucleotide
  Target: ATXN1; (+) strand; PAM type: NNNNGHTT; PAM sequence: GAGGGTTT
gagtgagctgagaggcactg

SEQ ID NO: 34033 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
aggcccaggctggagaaggt

SEQ ID NO: 34034 - DNA, 20 bp, Artificial Sequence
  Description of Artificial Sequence: Synthetic oligonucleotide
  Target: ATXN1; (+) strand; PAM type: NNNNGHTT; PAM sequence: GATGGTTT
ggagaaggtgtcagttttga

SEQ ID NO: 34035 - DNA, 20 bp, Artificial Sequence
  Description of Artificial Sequence: Synthetic oligonucleotide
  Target: ATXN1; (+) strand; PAM type: NNNNGHTT; PAM sequence: CCAGGTTT
aggcatcaacaaaaaacaga

SEQ ID NO: 34036 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
ctactttccgctactttcca

SEQ ID NO: 34037 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
ttccactctgattgttccac

SEQ ID NO: 34038 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
agatctcagcgctcttcccc

SEQ ID NO: 34039 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
tccaagctccttgtgtctct

SEQ ID NO: 34040 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
ctcttcctgctttaattata

SEQ ID NO: 34041 - DNA, 20 bp, Artificial Sequence
  Description of Artificial Sequence: Synthetic oligonucleotide
  Target: ATXN1; (+) strand; PAM type: NNNNGHTT; PAM sequence: GAGAGCTT
taggtagcagagagtgtaag

SEQ ID NO: 34042 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
taggggtagggggatcaggc

SEQ ID NO: 34043 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
gccactgatctgacaggagg

SEQ ID NO: 34044 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
ttttagcagaaataaaaatt

SEQ ID NO: 34045 - DNA, 20 bp, Artificial Sequence
  Description of Artificial Sequence: Synthetic oligonucleotide
  Target: ATXN1; (+) strand; PAM type: NNNNGHTT; PAM sequence: GCCAGCTT
actgaaataatacatttagt

SEQ ID NO: 34046 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
catttagtgccagctttgag

SEQ ID NO: 34047 - DNA, 20 bp, Artificial Sequence
  Description of Artificial Sequence: Synthetic oligonucleotide
  Target: ATXN1; (+) strand; PAM type: NNNNGHTT; PAM sequence: ATTAGTTT
cttgtagacagtaaatttta

SEQ ID NO: 34048 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
aatcagataactggtccact

SEQ ID NO: 34049 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
atattgtatattttatccaa

SEQ ID NO: 34050 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
cattaatagaatttaataag

SEQ ID NO: 34051 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
accctttcattactgaattt

SEQ ID NO: 34052 - DNA, 20 bp, Artificial Sequence
  Description of Artificial Sequence: Synthetic oligonucleotide
  Target: ATXN1; (+) strand; PAM type: NNNNGHTT; PAM sequence: GCACGTTT
tctaacctacactataagaa

SEQ ID NO: 34053 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
aatgtgtaccagagtgactc

SEQ ID NO: 34054 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
cttttgatgaattagtagtg

SEQ ID NO: 34055 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
tatgttaaacaaataaaaaa

SEQ ID NO: 34056 - DNA, 20 bp, Artificial Sequence
  Description of Artificial Sequence: Synthetic oligonucleotide
  Target: ATXN1; (+) strand; PAM type: NNNNGHTT; PAM sequence: GCTTGTTT
ttaaacaaataaaaaattga

SEQ ID NO: 34057 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
caaataaaaaattgagcttg

SEQ ID NO: 34058 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
ttttgtttttcaaagcactt

SEQ ID NO: 34059 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
acttttcattttgaagtatt

SEQ ID NO: 34060 - DNA, 20 bp, Artificial Sequence
  Description of Artificial Sequence: Synthetic oligonucleotide
  Target: ATXN1; (+) strand; PAM type: NNNNGHTT; PAM sequence: GATCGCTT
ttgggaggtctaaatgggtg

SEQ ID NO: 34061 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aataaaaacattcagaaatg

SEQ ID NO: 34062 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
ctacttgggaggctaaggtg

SEQ ID NO: 34063 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttgggaggctaaggtgggat

SEQ ID NO: 34064 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
ggcaccagtgtcaaaggtag

SEQ ID NO: 34065 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
aggagaggcagtgggcatct

SEQ ID NO: 34066 - DNA, 20 bp, Artificial Sequence
  Description of Artificial Sequence: Synthetic oligonucleotide
  Target: ATXN1; (+) strand; PAM type: NNNNGHTT; PAM sequence: CCAAGCTT
ggttttggcacaacgggctc

SEQ ID NO: 34067 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
aggaaccctgggaaggtctg

SEQ ID NO: 34068 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
cactcttgagaccaacaaat

SEQ ID NO: 34069 - DNA, 20 bp, Artificial Sequence
  Description of Artificial Sequence: Synthetic oligonucleotide
  Target: ATXN1; (+) strand; PAM type: NNNNGHTT; PAM sequence: ATAGGATT
acttaaaaatgagtaacaaa

SEQ ID NO: 34070 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aataaaaacattcagaaatg

SEQ ID NO: 34071 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
agaaaagcaataaaaacagc

SEQ ID NO: 34072 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
gcacaaattctagaagtaga

SEQ ID NO: 34073 - DNA, 20 bp, Artificial Sequence
  Description of Artificial Sequence: Synthetic oligonucleotide
  Target: ATXN1; (+) strand; PAM type: NNNNGHTT; PAM sequence: ACCCGATT
ggacagaaaattagagtgtc

SEQ ID NO: 34074 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
gtcacccgatttttcaagag

SEQ ID NO: 34075 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
gctgtaggtctgttactgaa

SEQ ID NO: 34076 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
ccctgacaatatagatagta

SEQ ID NO: 34077 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
accaataaacaacagctaag

SEQ ID NO: 34078 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
tcaggaggctgaggcacgag

SEQ ID NO: 34079 - DNA, 20 bp, Artificial Sequence
  Description of Artificial Sequence: Synthetic oligonucleotide
  Target: ATXN1; (+) strand; PAM type: NNNNGHTT; PAM sequence: CAAGGCTT
ctccagcccgggtgacagag

SEQ ID NO: 34080 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
ctacttggggggctgaggca

SEQ ID NO: 34081 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttggggggctgaggcagaag

SEQ ID NO: 34082 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
aaaaaaaacctacctaaata

SEQ ID NO: 34083 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
aaaacctacctaaatagtat

SEQ ID NO: 34084 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
gacagacttcaacgacttca

SEQ ID NO: 34085 - DNA, 20 bp, Artificial Sequence
  Description of Artificial Sequence: Synthetic oligonucleotide
  Target: ATXN1; (+) strand; PAM type: NNNNGHTT; PAM sequence: GTGGGTTT
caacgacttcaccttgtttt

SEQ ID NO: 34086 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
acttcaccttgttttgtggg

SEQ ID NO: 34087 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
tgtgagtgagaactgctatt

SEQ ID NO: 34088 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
cccgtctctactaaaaacag

SEQ ID NO: 34089 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
aatggcgtgaacctgggagg

SEQ ID NO: 34090 - DNA, 20 bp, Artificial Sequence
  Description of Artificial Sequence: Synthetic oligonucleotide
  Target: ATXN1; (+) strand; PAM type: NNNNGHTT; PAM sequence: CCGAGATT
gaggtggagcttgcagtgag

SEQ ID NO: 34091 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
tatatctatatctagagaga

SEQ ID NO: 34092 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
aactatcaaagacagccagt

SEQ ID NO: 34093 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
tgcaatctatgaatttacag

SEQ ID NO: 34094 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
atgctttcaaaacacagtga

SEQ ID NO: 34095 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
agacagaatctagtatatta

SEQ ID NO: 34096 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
gtagataaattacagatgca

SEQ ID NO: 34097 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
gaaattcaggagacagaggg

SEQ ID NO: 34098 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
aaattctaccagacaaatgg

SEQ ID NO: 34099 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
gtgataccgagtagtgtaaa

SEQ ID NO: 34100 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
agggaatactgttatttgga

SEQ ID NO: 34101 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
aaagcgttcatttaccacct

SEQ ID NO: 34102 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
taccacctctctgctttcaa

SEQ ID NO: 34103 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
gtttgatatttctttttttt

SEQ ID NO: 34104 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
ttttatattattattatact

SEQ ID NO: 34105 - DNA, 20 bp, Artificial Sequence
  Description of Artificial Sequence: Synthetic oligonucleotide
  Target: ATXN1; (+) strand; PAM type: NNNNGHTT; PAM sequence: CGGTGTTT
catctatgagtgagaacatg

SEQ ID NO: 34106 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
atgagtgagaacatgcggtg

SEQ ID NO: 34107 - DNA, 20 bp, Artificial Sequence
  Description of Artificial Sequence: Synthetic oligonucleotide
  Target: ATXN1; (+) strand; PAM type: NNNNGHTT; PAM sequence: GATAGTTT
gtttggttttttgtccttgt

SEQ ID NO: 34108 - DNA, 20 bp, Artificial Sequence
  Description of Artificial Sequence: Synthetic oligonucleotide
  Target: ATXN1; (+) strand; PAM type: NNNNGHTT; PAM sequence: TGATGATT
ttgtgatagtttactgagaa

SEQ ID NO: 34109 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
gtgcatgtgtctttattgca

SEQ ID NO: 34110 - DNA, 20 bp, Artificial Sequence
  Description of Artificial Sequence: Synthetic oligonucleotide
  Target: ATXN1; (+) strand; PAM type: NNNNGHTT; PAM sequence: ACTAGTTT
ctgacttccacaatggttga

SEQ ID NO: 34111 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
tccacatcctctccagcacc

SEQ ID NO: 34112 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
cctgttgtttcctgactttt

SEQ ID NO: 34113 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
ggtgtgagatggtatctcat

SEQ ID NO: 34114 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
gagatggtatctcattgtgg

SEQ ID NO: 34115 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
ttttgagaagtgtctgttaa

SEQ ID NO: 34116 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
aagttcctttggtaatttgg

SEQ ID NO: 34117 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
atttggcagtgtttctcaaa

SEQ ID NO: 34118 - DNA, 20 bp, Artificial Sequence
  Description of Artificial Sequence: Synthetic oligonucleotide
  Target: ATXN1; (+) strand; PAM type: NNNNGHTT; PAM sequence: ATCAGCTT
ttaaaattcacattcctgac

SEQ ID NO: 34119 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
aaaattgaaagctgcccaac

SEQ ID NO: 34120 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
taggtcttctgcacactcca

SEQ ID NO: 34121 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
aataaattatttctttttca

SEQ ID NO: 34122 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
aagggtttaacagttaaatc

SEQ ID NO: 34123 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
ctaaaatattcttcacatgt

SEQ ID NO: 34124 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
agggatcagaccatactctc

SEQ ID NO: 34125 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
atgtgccttttgtatggaag

SEQ ID NO: 34126 - DNA, 20 bp, Artificial Sequence
  Description of Artificial Sequence: Synthetic oligonucleotide
  Target: ATXN1; (+) strand; PAM type: NNNNGHTT; PAM sequence: ATAAGTTT
catgcttggtgacagagaag

SEQ ID NO: 34127 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
ataagtttgcatttttaaaa

SEQ ID NO: 34128 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
ctatagcattagcatatatt

SEQ ID NO: 34129 - DNA, 20 bp, Artificial Sequence
  Description of Artificial Sequence: Synthetic oligonucleotide
  Target: ATXN1; (+) strand; PAM type: NNNNGHTT; PAM sequence: TAGTGCTT
aacataattctttctaatga

SEQ ID NO: 34130 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
agtgcttatcactagaagcc

SEQ ID NO: 34131 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
gccagaggcttgttgaatga

SEQ ID NO: 34132 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtaggga

SEQ ID NO: 34133 - DNA, 20 bp, Artificial Sequence
  Description of Artificial Sequence: Synthetic oligonucleotide
  Target: ATXN1; (+) strand; PAM type: NNNNGHTT; PAM sequence: CCAGGTTT
atggggtttcaccatgttgg

SEQ ID NO: 34134 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
tgcctcagcctcccaaagtg

SEQ ID NO: 34135 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
aatcgcactatgttgcccag

SEQ ID NO: 34136 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcggcctcccaaagtg

SEQ ID NO: 34137 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
aaaatgctagttacactctt

SEQ ID NO: 34138 - DNA, 20 bp, Artificial Sequence
  Description of Artificial Sequence: Synthetic oligonucleotide
  Target: ATXN1; (+) strand; PAM type: NNNNGHTT; PAM sequence: ATAGGATT
tacactcttagaagctttat

SEQ ID NO: 34139 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
atttctaatttaatctttat

SEQ ID NO: 34140 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
atttaatctttattgaagct

SEQ ID NO: 34141 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
ttaaacttatttaaaagccc

SEQ ID NO: 34142 - DNA, 20 bp, Artificial Sequence
  Description of Artificial Sequence: Synthetic oligonucleotide
  Target: ATXN1; (+) strand; PAM type: NNNNGHTT; PAM sequence: ACGGGCTT
aagccccaaagattctacca

SEQ ID NO: 34143 - DNA, 20 bp, Artificial Sequence
  Description of Artificial Sequence: Synthetic oligonucleotide
  Target: ATXN1; (+) strand; PAM type: NNNNGHTT; PAM sequence: CTGCGTTT
accaacgggcttcagagcat

SEQ ID NO: 34144 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
atttctcattattaagtaac

SEQ ID NO: 34145 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
accattccactcaaaccttt

SEQ ID NO: 34146 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
ggccccctcttccctcgccc

SEQ ID NO: 34147 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
tgttacaccacaaagtcctt

SEQ ID NO: 34148 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
acaccacaaagtccttgttg

SEQ ID NO: 34149 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
tgcccaacaaggacactata

SEQ ID NO: 34150 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
acaaggacactatatacagt

SEQ ID NO: 34151 - DNA, 20 bp, Artificial Sequence
  Description of Artificial Sequence: Synthetic oligonucleotide
  Target: ATXN1; (+) strand; PAM type: NNNNGHTT; PAM sequence: TCAAGCTT
tttgatgtccctagcagaga

SEQ ID NO: 34152 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
ccctagcagagatcaagctt

SEQ ID NO: 34153 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
caagcttttttgcttgcatg

SEQ ID NO: 34154 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
gttagtaaggctctacatct

SEQ ID NO: 34155 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
ctacatcttcaagatttgcc

SEQ ID NO: 34156 - DNA, 20 bp, Artificial Sequence
  Description of Artificial Sequence: Synthetic oligonucleotide
  Target: ATXN1; (+) strand; PAM type: NNNNGHTT; PAM sequence: GTTAGATT
atagcaagagttcttctgaa

SEQ ID NO: 34157 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
taatgggccagaccatactg

SEQ ID NO: 34158 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
atcccgtcatctcagtgaca

SEQ ID NO: 34159 - DNA, 20 bp, Artificial Sequence
  Description of Artificial Sequence: Synthetic oligonucleotide
  Target: ATXN1; (+) strand; PAM type: NNNNGHTT; PAM sequence: CATTGCTT
tagaaaggttgtagcgctac

SEQ ID NO: 34160 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
gcattaaactgtcagacata

SEQ ID NO: 34161 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
atgcttatggtagccaatgt

SEQ ID NO: 34162 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
tcagagattaaatctaaagt

SEQ ID NO: 34163 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
tgaaagagatgagccctccc

SEQ ID NO: 34164 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
atgagccctccctcaggctt

SEQ ID NO: 34165 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
gcttatgagtttcttcttct

SEQ ID NO: 34166 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
cattaatgttataatttaaa

SEQ ID NO: 34167 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
aagtgttttctccctctaat

SEQ ID NO: 34168 - DNA, 20 bp, Artificial Sequence
  Description of Artificial Sequence: Synthetic oligonucleotide
  Target: ATXN1; (+) strand; PAM type: NNNNGHTT; PAM sequence: GCAGGCTT
tatcattggtcctccaaatc

SEQ ID NO: 34169 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
cttaccaattaaaaaatgta

SEQ ID NO: 34170 - DNA, 20 bp, Artificial Sequence
  Description of Artificial Sequence: Synthetic oligonucleotide
  Target: ATXN1; (+) strand; PAM type: NNNNGHTT; PAM sequence: ATCAGCTT
ggtttcacattgttagcgat

SEQ ID NO: 34171 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gaagccatttcttttcttcc

SEQ ID NO: 34172 - DNA, 20 bp, Artificial Sequence
  Description of Artificial Sequence: Synthetic oligonucleotide
  Target: ATXN1; (+) strand; PAM type: NNNNGHTT; PAM sequence: ACACGTTT
cttccttttgttttaagtga

SEQ ID NO: 34173 - DNA, 20 bp, Artificial Sequence
  Description of Artificial Sequence: Synthetic oligonucleotide
  Target: ATXN1; (+) strand; PAM type: NNNNGHTT; PAM sequence: ATAAGTTT
agtgaacacgttttaagtgg

SEQ ID NO: 34174 - DNA, 20 bp, Artificial Sequence
  Description of Artificial Sequence: Synthetic oligonucleotide
  Target: ATXN1; (+) strand; PAM type: NNNNGHTT; PAM sequence: CTGAGCTT
agtttaaaggaaaacatatc

SEQ ID NO: 34175 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
atatcctgagcttgcaaggt

SEQ ID NO: 34176 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
aactccttattttagggaat

SEQ ID NO: 34177 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
aaattggaaactgaagttaa

SEQ ID NO: 34178 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
attgcagctgtcatctctaa

SEQ ID NO: 34179 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
tcaaatttctgtgttcatca

SEQ ID NO: 34180 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
aaagcttcattgttctttct

SEQ ID NO: 34181 - DNA, 20 bp, Artificial Sequence
  Description of Artificial Sequence: Synthetic oligonucleotide
  Target: ATXN1; (+) strand; PAM type: NNNNGHTT; PAM sequence: ATTCGTTT
tgctaacaaaattttccttt

SEQ ID NO: 34182 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
cctttattcgtttcatatgt

SEQ ID NO: 34183 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
tcgtttcatatgttgaggtt

SEQ ID NO: 34184 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
catatgttgaggtttcaaga

SEQ ID NO: 34185 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
taaatacaggaaagagaagc

SEQ ID NO: 34186 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
tgtgggaactatgctcccct

SEQ ID NO: 34187 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
taatcttcctcttctttttc

SEQ ID NO: 34188 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
ggaacaatcactgatgcaac

SEQ ID NO: 34189 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
cacccttcccatctagtgct

SEQ ID NO: 34190 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
tctctgattcaagggaagga

SEQ ID NO: 34191 - DNA, 20 bp, Artificial Sequence
  Description of Artificial Sequence: Synthetic oligonucleotide
  Target: ATXN1; (+) strand; PAM type: NNNNGHTT; PAM sequence: AGGGGCTT
tgtgctttggaagagagggc

SEQ ID NO: 34192 - DNA, 20 bp, Artificial Sequence
  Description of Artificial Sequence: Synthetic oligonucleotide
  Target: ATXN1; (+) strand; PAM type: NNNNGHTT; PAM sequence: GCACGTTT
gagacgtaggttcaaagcca

SEQ ID NO: 34193 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
atctgcaacatggagatgct

SEQ ID NO: 34194 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
atggagatgctatgagtttc

SEQ ID NO: 34195 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
tccatatgaagtattcaatg

SEQ ID NO: 34196 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
ctgtgaacgcacctgatcca

SEQ ID NO: 34197 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
aggggcggcgggggttagaa

SEQ ID NO: 34198 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
tcggttctccaggatgctcc

SEQ ID NO: 34199 - DNA, 20 bp, Artificial Sequence
  Description of Artificial Sequence: Synthetic oligonucleotide
  Target: ATXN1; (+) strand; PAM type: NNNNGHTT; PAM sequence: ATAGGATT
acttcagctgtacaaattat

SEQ ID NO: 34200 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
aatcacttgaacccgagggc

SEQ ID NO: 34201 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
tagtatagttgaaagaaacg

SEQ ID NO: 34202 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
aaacaaatttcacaaaaaca

SEQ ID NO: 34203 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
tgtttaaaaggttgctatcc

SEQ ID NO: 34204 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
ttgtctttctaagatgccag

SEQ ID NO: 34205 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
ctctgcatatagaaaatatt

SEQ ID NO: 34206 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
cgtccgaatgtcaggccgtt

SEQ ID NO: 34207 - DNA, 20 bp, Artificial Sequence
  Description of Artificial Sequence: Synthetic oligonucleotide
  Target: ATXN1; (+) strand; PAM type: NNNNGHTT; PAM sequence: CGATGTTT
aactcggtagaaaagaaaca

SEQ ID NO: 34208 - DNA, 20 bp, Artificial Sequence
  Description of Artificial Sequence: Synthetic oligonucleotide
  Target: ATXN1; (+) strand; PAM type: NNNNGHTT; PAM sequence: GTGAGCTT
ggtcaactgagcaccagact

SEQ ID NO: 34209 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
gactgtgagctttttgaggg

SEQ ID NO: 34210 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
gagctttttgagggtaaaga

SEQ ID NO: 34211 - DNA, 20 bp, Artificial Sequence
  Description of Artificial Sequence: Synthetic oligonucleotide
  Target: ATXN1; (+) strand; PAM type: NNNNGHTT; PAM sequence: TCCAGATT
gatatgagaaagtaaacctt

SEQ ID NO: 34212 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
ttccagattttgttgatagc

SEQ ID NO: 34213 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
cagctggaaaaggaaaacat

SEQ ID NO: 34214 - DNA, 20 bp, Artificial Sequence
  Description of Artificial Sequence: Synthetic oligonucleotide
  Target: ATXN1; (+) strand; PAM type: NNNNGHTT; PAM sequence: GAGTGATT
atttaggattatccatctct

SEQ ID NO: 34215 - DNA, 20 bp, Artificial Sequence
  Description of Artificial Sequence: Synthetic oligonucleotide
  Target: ATXN1; (+) strand; PAM type: NNNNGHTT; PAM sequence: GGCTGATT
ggtaaaaaaagcagaaatat

SEQ ID NO: 34216 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
tttttcccactctcactggt

SEQ ID NO: 34217 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
tcttgtctcattccaccaca

SEQ ID NO: 34218 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
aacaagttttataatagcag

SEQ ID NO: 34219 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
aattcacattaaaactctat

SEQ ID NO: 34220 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
tctattactgatttaaaagt

SEQ ID NO: 34221 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
aaagttcaagatttagaatt

SEQ ID NO: 34222 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
tagaatttaaggattctgat

SEQ ID NO: 34223 - DNA, 20 bp, Artificial Sequence
  Description of Artificial Sequence: Synthetic oligonucleotide
  Target: ATXN1; (+) strand; PAM type: NNNNGHTT; PAM sequence: ACTAGATT
gcgtaaacctactttagctg

SEQ ID NO: 34224 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
ttagctgactagatttttta

SEQ ID NO: 34225 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
gattttttaaaaggtttagg

SEQ ID NO: 34226 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
ccagacaacatgctagtcga

SEQ ID NO: 34227 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
gtaattctttataaaatttt

SEQ ID NO: 34228 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
ataaaaaaactgggttcaag

SEQ ID NO: 34229 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
gggttcaaggtctgtttttg

SEQ ID NO: 34230 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tcaggaggctgaggcaggag

SEQ ID NO: 34231 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gaggcagaggttgaagtgag

SEQ ID NO: 34232 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
taattgtctaagaattgctc

SEQ ID NO: 34233 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
ttctggaaaatgaggtgcag

SEQ ID NO: 34234 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
ggtgcagagaggattaagta

SEQ ID NO: 34235 - DNA, 20 bp, Artificial Sequence
  Description of Artificial Sequence: Synthetic oligonucleotide
  Target: ATXN1; (+) strand; PAM type: NNNNGHTT; PAM sequence: GTATGCTT
agtaacatgcttgaattcaa

SEQ ID NO: 34236 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
gtaattccagctactcagac

SEQ ID NO: 34237 - DNA, 20 bp, Artificial Sequence
  Description of Artificial Sequence: Synthetic oligonucleotide
  Target: ATXN1; (+) strand; PAM type: NNNNGHTT; PAM sequence: GAGTGCTT
tagatcgataaatatttact

SEQ ID NO: 34238 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
agtgcttacagtgtgccaag

SEQ ID NO: 34239 - DNA, 20 bp, Artificial Sequence
  Description of Artificial Sequence: Synthetic oligonucleotide
  Target: ATXN1; (+) strand; PAM type: NNNNGHTT; PAM sequence: CATTGTTT
aattcttctgaattcaaaat

SEQ ID NO: 34240 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
ttccccactccatattgtgc

SEQ ID NO: 34241 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
ctccatattgtgccagtgct

SEQ ID NO: 34242 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
ctgtagcccatttgtaacaa

SEQ ID NO: 34243 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
tgcattatctacagtgtagc

SEQ ID NO: 34244 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
tcaggaatatccctaatttg

SEQ ID NO: 34245 - DNA, 20 bp, Artificial Sequence
  Description of Artificial Sequence: Synthetic oligonucleotide
  Target: ATXN1; (+) strand; PAM type: NNNNGHTT; PAM sequence: TAGTGCTT
ctctcttactgccatagact

SEQ ID NO: 34246 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
gaaattaatgcaaaagaacc

SEQ ID NO: 34247 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
tttcttaatcttatcaccag

SEQ ID NO: 34248 - DNA, 20 bp, Artificial Sequence
  Description of Artificial Sequence: Synthetic oligonucleotide
  Target: ATXN1; (+) strand; PAM type: NNNNGHTT; PAM sequence: GGGAGCTT
agaactaaaagctgtgatct

SEQ ID NO: 34249 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
cttggatattatagcaatta

SEQ ID NO: 34250 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
cactattagaaaacaaacaa

SEQ ID NO: 34251 - DNA, 20 bp, Artificial Sequence
  Description of Artificial Sequence: Synthetic oligonucleotide
  Target: ATXN1; (+) strand; PAM type: NNNNGHTT; PAM sequence: AACAGTTT
aatagtaagctacttgggaa

SEQ ID NO: 34252 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
gctacttgggaaaacagttt

SEQ ID NO: 34253 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
ccacacaaaaacctgcactc

SEQ ID NO: 34254 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
acctgcactcaaatgtttat

SEQ ID NO: 34255 - DNA, 20 bp, Artificial Sequence
  Description of Artificial Sequence: Synthetic oligonucleotide
  Target: ATXN1; (+) strand; PAM type: NNNNGHTT; PAM sequence: ATAAGCTT
ttattcagcactaaaaacaa

SEQ ID NO: 34256 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
gggaaatttcccgtcctaca

SEQ ID NO: 34257 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
aggaactttcctgtcttata

SEQ ID NO: 34258 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
ataaaagtagccaatcgcag

SEQ ID NO: 34259 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
tgggtccccttccacgctgg

SEQ ID NO: 34260 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
ggtgagtaccatcagacccc

SEQ ID NO: 34261 - DNA, 20 bp, Artificial Sequence
  Description of Artificial Sequence: Synthetic oligonucleotide
  Target: ATXN1; (+) strand; PAM type: NNNNGHTT; PAM sequence: GACTGTTT
agggctcactaacaaccccc

SEQ ID NO: 34262 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
gactgtttggagtcaggagc

SEQ ID NO: 34263 - DNA, 20 bp, Artificial Sequence
  Description of Artificial Sequence: Synthetic oligonucleotide
  Target: ATXN1; (+) strand; PAM type: NNNNGHTT; PAM sequence: ACCAGCTT
ggagcattggtttgcctgga

SEQ ID NO: 34264 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
ttggtttgcctggaaccagc

SEQ ID NO: 34265 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
cctctcttctccaaggttag

SEQ ID NO: 34266 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
ctccctgtccctggtgctct

SEQ ID NO: 34267 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
tcttccagtttctcctataa

SEQ ID NO: 34268 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
agaaaacacttaggactcta

SEQ ID NO: 34269 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
taaagacgaaaggcaagggt

SEQ ID NO: 34270 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
ttgtggtctaggaggaaaac

SEQ ID NO: 34271 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
aggaaaactagtgtttccgc

SEQ ID NO: 34272 - DNA, 20 bp, Artificial Sequence
  Description of Artificial Sequence: Synthetic oligonucleotide
  Target: ATXN1; (+) strand; PAM type: NNNNGHTT; PAM sequence: GGCGGTTT
gaaaaaaaaaaaaaactgca

SEQ ID NO: 34273 - DNA, 20 bp, Artificial Sequence
  Description of Artificial Sequence: Synthetic oligonucleotide
  Target: ATXN1; (+) strand; PAM type: NNNNGHTT; PAM sequence: AGCGGCTT
cccgcaaaccctgaaaaaga

SEQ ID NO: 34274 - DNA, 20 bp, Artificial Sequence
  Description of Artificial Sequence: Synthetic oligonucleotide
  Target: ATXN1; (+) strand; PAM type: NNNNGHTT; PAM sequence: CCAAGCTT
tggagtgaaataccttatgt

SEQ ID NO: 34275 - DNA, 20 bp, Artificial Sequence
  Description of Artificial Sequence: Synthetic oligonucleotide
  Target: ATXN1; (+) strand; PAM type: NNNNGHTT; PAM sequence: TGGCGATT
aatccacaactatgcaaagc

SEQ ID NO: 34276 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
tacattccacaggaggacct

SEQ ID NO: 34277 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
gcagatcaaggtagacctgg

SEQ ID NO: 34278 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
ctggcctttaatgaaaagaa

SEQ ID NO: 34279 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
gagggtcaattgatcctaaa

SEQ ID NO: 34280 - DNA, 20 bp, Artificial Sequence
  Description of Artificial Sequence: Synthetic oligonucleotide
  Target: ATXN1; (+) strand; PAM type: NNNNGHTT; PAM sequence: TAGGGCTT
ggagcaggccaatcacccag

SEQ ID NO: 34281 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
ccagtagggcttgttatcag

SEQ ID NO: 34282 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
tcaccctcactgagccctgg

SEQ ID NO: 34283 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
tgggagactttgctcttttc

SEQ ID NO: 34284 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
tcttaaggcctgaagctcat

SEQ ID NO: 34285 - DNA, 20 bp, Artificial Sequence
  Description of Artificial Sequence: Synthetic oligonucleotide
  Target: ATXN1; (+) strand; PAM type: NNNNGHTT; PAM sequence: CGAGGCTT
ttgttatacatttaaaagtt

SEQ ID NO: 34286 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
tcaaataccaaaggaagcag

SEQ ID NO: 34287 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
cgttcctctgcacttggact

SEQ ID NO: 34288 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
tacatggacggtcttgcctc

SEQ ID NO: 34289 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
agggtttagggatagccctc

SEQ ID NO: 34290 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
atgctggtccttcagtatgt

SEQ ID NO: 34291 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
ttacttttggctaccagttc

SEQ ID NO: 34292 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
aaagaacaaatacagcctat

SEQ ID NO: 34293 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
tgtgggggttccttgggatc

SEQ ID NO: 34294 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
tagtagcaaaaggctggcct

SEQ ID NO: 34295 - DNA, 20 bp, Artificial Sequence
  Description of Artificial Sequence: Synthetic oligonucleotide
  Target: ATXN1; (+) strand; PAM type: NNNNGHTT; PAM sequence: TGGTGCTT
ggcgctactcattcagggac

SEQ ID NO: 34296 - DNA, 20 bp, Artificial Sequence
  Description of Artificial Sequence: Synthetic oligonucleotide
  Target: ATXN1; (+) strand; PAM type: NNNNGHTT; PAM sequence: TTATGCTT
caacaaattgtagcccagac

SEQ ID NO: 34297 - DNA, 20 bp, Artificial Sequence
  Description of Artificial Sequence: Synthetic oligonucleotide
  Target: ATXN1; (+) strand; PAM type: NNNNGHTT; PAM sequence: GTATGCTT
aatgtgtatacagatagcaa

SEQ ID NO: 34298 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
ggtatggaacaaccccctcc

SEQ ID NO: 34299 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
aatggggactttcacggggg

SEQ ID NO: 34300 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
ccccctgccaaacttttcac

SEQ ID NO: 34301 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
tcacccatatgcctaagtca

SEQ ID NO: 34302 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
tactaactcatgaaataatt

SEQ ID NO: 34303 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
tcatgaaataattcccagat

SEQ ID NO: 34304 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
ttcccagatttgggcttccc

SEQ ID NO: 34305 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
ggaacagagttgttccaacc

SEQ ID NO: 34306 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
ctcccctcttcctcctcatc

SEQ ID NO: 34307 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
taaggtggcaggagtggaat

SEQ ID NO: 34308 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
cgataaacctgtgaaccatt

SEQ ID NO: 34309 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
cccctttaatggaatccttt

SEQ ID NO: 34310 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
tcaaccttttttacatgcaa

SEQ ID NO: 34311 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
cacccaaaccgctctattca

SEQ ID NO: 34312 - DNA, 20 bp, Artificial Sequence
  Description of Artificial Sequence: Synthetic oligonucleotide
  Target: ATXN1; (+) strand; PAM type: NNNNGHTT; PAM sequence: GTCCGCTT
ccgctctattcagatggctt

SEQ ID NO: 34313 - DNA, 20 bp, Artificial Sequence
  Description of Artificial Sequence: Synthetic oligonucleotide
  Target: ATXN1; (+) strand; PAM type: NNNNGHTT; PAM sequence: CCCTGCTT
cccaaaaatcatcacctcct

SEQ ID NO: 34314 - DNA, 20 bp, Artificial Sequence
  Description of Artificial Sequence: Synthetic oligonucleotide
  Target: ATXN1; (+) strand; PAM type: NNNNGHTT; PAM sequence: CCAGGTTT
ctccctgcttaacaaacagt

SEQ ID NO: 34315 - DNA, 20 bp, Artificial Sequence
  Description of Artificial Sequence: Synthetic oligonucleotide
  Target: ATXN1; (+) strand; PAM type: NNNNGHTT; PAM sequence: AACAGTTT
atggttcctagtagatacaa

SEQ ID NO: 34316 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
aaatagagcacagggagtca

SEQ ID NO: 34317 - DNA, 20 bp, Artificial Sequence
  Description of Artificial Sequence: Synthetic oligonucleotide
  Target: ATXN1; (+) strand; PAM type: NNNNGHTT; PAM sequence: GCCAGTTT
ctgctacaggaaccagaata

SEQ ID NO: 34318 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
tcctactaccacacactctc

SEQ ID NO: 34319 - DNA, 20 bp, Artificial Sequence
  Description of Artificial Sequence: Synthetic oligonucleotide
  Target: ATXN1; (+) strand; PAM type: NNNNGHTT; PAM sequence: GACAGTTT
actctcaaaggatttctcaa

SEQ ID NO: 34320 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
gcaccttcttaggagaagac

SEQ ID NO: 34321 - DNA, 20 bp, Artificial Sequence
  Description of Artificial Sequence: Synthetic oligonucleotide
  Target: ATXN1; (+) strand; PAM type: NNNNGHTT; PAM sequence: AAAGGCTT
gctgcccagcagttacagga

SEQ ID NO: 34322 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
caacctctagagttgggcaa

SEQ ID NO: 34323 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
ctattactcaccttcgggcc

SEQ ID NO: 34324 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
gtttttaacctctttgtcaa

SEQ ID NO: 34325 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
tcccaacagcagctggggtg

SEQ ID NO: 34326 - DNA, 20 bp, Artificial Sequence
  Description of Artificial Sequence: Synthetic oligonucleotide
  Target: ATXN1; (+) strand; PAM type: NNNNGHTT; PAM sequence: GGGGGATT
ctggggtgtcctgtttagag

SEQ ID NO: 34327 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
tctgtaaaatgcatcaatca

SEQ ID NO: 34328 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
ctaaaggtagccaatcgcag

SEQ ID NO: 34329 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
tgggtccccttccacgctgt

SEQ ID NO: 34330 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
atgtgaaaagggtacatact

SEQ ID NO: 34331 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
taaaaaaaaaaaaaaaaatc

SEQ ID NO: 34332 - DNA, 20 bp, Artificial Sequence
  Description of Artificial Sequence: Synthetic oligonucleotide
  Target: ATXN1; (+) strand; PAM type: NNNNGHTT; PAM sequence: TGGGGATT
aaaaaaaaaatcaggggttt

SEQ ID NO: 34333 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
caagatgttagcagtaggga

SEQ ID NO: 34334 - DNA, 20 bp, Artificial Sequence
  Description of Artificial Sequence: Synthetic oligonucleotide
  Target: ATXN1; (+) strand; PAM type: NNNNGHTT; PAM sequence: AGCTGTTT
aacaacaacactgcactgac

SEQ ID NO: 34335 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ttgggaggctgaggcaggag

SEQ ID NO: 34336 - DNA, 20 bp, Artificial Sequence
  Description of Artificial Sequence: Synthetic oligonucleotide
  Target: ATXN1; (+) strand; PAM type: NNNNGHTT; PAM sequence: CAAGGTTT
ccataaagatgactcccagg

SEQ ID NO: 34337 - DNA, 20 bp, Artificial Sequence
  Description of Artificial Sequence: Synthetic oligonucleotide
  Target: ATXN1; (+) strand; PAM type: NNNNGHTT; PAM sequence: GCCAGTTT
gtttgaagggctagaggaga

SEQ ID NO: 34338 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
ggccaagaactaggaggatg

SEQ ID NO: 34339 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
gaagagtagtcagcagagca

SEQ ID NO: 34340 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
ataggtgcatcaaagatagc

SEQ ID NO: 34341 - DNA, 20 bp, Artificial Sequence
  Description of Artificial Sequence: Synthetic oligonucleotide
  Target: ATXN1; (+) strand; PAM type: NNNNGHTT; PAM sequence: CCTTGCTT
ctacaggtgaggtcatgagt

SEQ ID NO: 34342 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
gggaaagtaaacagaaaata

SEQ ID NO: 34343 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tagggaggctgaggcaggag

SEQ ID NO: 34344 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
cgcttgtacccaggcggggg

SEQ ID NO: 34345 - DNA, 20 bp, Artificial Sequence
  Description of Artificial Sequence: Synthetic oligonucleotide
  Target: ATXN1; (+) strand; PAM type: NNNNGHTT; PAM sequence: CCGAGATT
ggggcagagattgcagtgag

SEQ ID NO: 34346 - DNA, 20 bp, Artificial Sequence
  Description of Artificial Sequence: Synthetic oligonucleotide
  Target: ATXN1; (+) strand; PAM type: NNNNGHTT; PAM sequence: CCTAGATT
actctctatcaagtagggtt

SEQ ID NO: 34347 - DNA, 20 bp, Artificial Sequence
  Description of Artificial Sequence: Synthetic oligonucleotide
  Target: ATXN1; (+) strand; PAM type: NNNNGHTT; PAM sequence: GCACGATT
atttcggaaaagtagatcaa

SEQ ID NO: 34348 - DNA, 20 bp, Artificial Sequence
  Description of Artificial Sequence: Synthetic oligonucleotide
  Target: ATXN1; (+) strand; PAM type: NNNNGHTT; PAM sequence: GGCAGATT
caggtagataataatgacat

SEQ ID NO: 34349 - DNA, 20 bp, Artificial Sequence
  Description of Artificial Sequence: Synthetic oligonucleotide
  Target: ATXN1; (+) strand; PAM type: NNNNGHTT; PAM sequence: ACTAGTTT
catggcagatttttaatatt

SEQ ID NO: 34350 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
agagaatccatgtaaaagac

SEQ ID NO: 34351 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
aaagactaatgttttcaatg

SEQ ID NO: 34352 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
tgttctttccatctcataac

SEQ ID NO: 34353 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
tcagtgccttacacaaaagc

SEQ ID NO: 34354 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
cccacccacacatccccagc

SEQ ID NO: 34355 - DNA, 20 bp, Artificial Sequence
  Description of Artificial Sequence: Synthetic oligonucleotide
  Target: ATXN1; (+) strand; PAM type: NNNNGHTT; PAM sequence: AGGCGCTT
acttgttttcttgactctgg

SEQ ID NO: 34356 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
tcttgactctggaggcgctt

SEQ ID NO: 34357 - DNA, 20 bp, Artificial Sequence
  Description of Artificial Sequence: Synthetic oligonucleotide
  Target: ATXN1; (+) strand; PAM type: NNNNGHTT; PAM sequence: TATTGTTT
tagtctatttaaaaaaatgt

SEQ ID NO: 34358 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
gcacggtccaatcaccagtg

SEQ ID NO: 34359 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
caatcaccagtgtcaggttt

SEQ ID NO: 34360 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
accagtgtcaggttttactg

SEQ ID NO: 34361 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
ttggttttatttgtcaaaac

SEQ ID NO: 34362 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
catgcagaggagggaggagt

SEQ ID NO: 34363 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
agtacctttaatcaaaagcc

SEQ ID NO: 34364 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
ccactgcctacaagaagacc

SEQ ID NO: 34365 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
aagaagaccaaaagattgtc

SEQ ID NO: 34366 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
gtctgaagattccatttagt

SEQ ID NO: 34367 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
tgaccatcgaatatgttgta

SEQ ID NO: 34368 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
gctagagactaaagtaagaa

SEQ ID NO: 34369 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
aagtaagaatttggtttagg

SEQ ID NO: 34370 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
atgccaccacgcgtggctaa

SEQ ID NO: 34371 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtatttttagtagaga

SEQ ID NO: 34372 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
cactgtgttagtcaggatgg

SEQ ID NO: 34373 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcctcggcctcctaaagtg

SEQ ID NO: 34374 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
atcaaattgttatcagagta

SEQ ID NO: 34375 - DNA, 20 bp, Artificial Sequence
  Description of Artificial Sequence: Synthetic oligonucleotide
  Target: ATXN1; (+) strand; PAM type: NNNNGHTT; PAM sequence: AGCAGATT
aaaagtcactcccctttcta

SEQ ID NO: 34376 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
catggctgatattggaaata

SEQ ID NO: 34377 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
ttgagatttagagcaactag

SEQ ID NO: 34378 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
gagcaactagagaagttttc

SEQ ID NO: 34379 - DNA, 20 bp, Artificial Sequence
  Description of Artificial Sequence: Synthetic oligonucleotide
  Target: ATXN1; (+) strand; PAM type: NNNNGHTT; PAM sequence: CGATGCTT
gaacacaaacttacttagat

SEQ ID NO: 34380 - DNA, 20 bp, Artificial Sequence
  Description of Artificial Sequence: Synthetic oligonucleotide
  Target: ATXN1; (+) strand; PAM type: NNNNGHTT; PAM sequence: GTTAGATT
tgcacctaaaaatacaggaa

SEQ ID NO: 34381 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
aaatacaggaagttagattt

SEQ ID NO: 34382 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
gtccaaaccttctagaaagg

SEQ ID NO: 34383 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
ttacaccgtgggcacccaat

SEQ ID NO: 34384 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
aatgcatgaaagaatgagtg

SEQ ID NO: 34385 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
atacaagagtcttgccctta

SEQ ID NO: 34386 - DNA, 20 bp, Artificial Sequence
  Description of Artificial Sequence: Synthetic oligonucleotide
  Target: ATXN1; (+) strand; PAM type: NNNNGHTT; PAM sequence: ATAAGTTT
caggagaagcaaaaatataa

SEQ ID NO: 34387 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
gaactaggcaaggggttaaa

SEQ ID NO: 34388 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
attttaatagaaaactagct

SEQ ID NO: 34389 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
aatagaaaactagctgatgg

SEQ ID NO: 34390 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
aggaaagaggtcagcagaaa

SEQ ID NO: 34391 - DNA, 20 bp, Artificial Sequence
  Description of Artificial Sequence: Synthetic oligonucleotide
  Target: ATXN1; (+) strand; PAM type: NNNNGHTT; PAM sequence: CAAGGCTT
aggttcaaagtgggtagatg

SEQ ID NO: 34392 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
gtggctcatgcctgtaatcc

SEQ ID NO: 34393 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ttgggaggctgaggcaacag

SEQ ID NO: 34394 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
attgcttgaacctgggaggc

SEQ ID NO: 34395 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
agaaaaagagagagttgatg

SEQ ID NO: 34396 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
agagttgatgaatggtttca

SEQ ID NO: 34397 - DNA, 20 bp, Artificial Sequence
  Description of Artificial Sequence: Synthetic oligonucleotide
  Target: ATXN1; (+) strand; PAM type: NNNNGHTT; PAM sequence: ACATGATT
ggcacaaaaggacaaatact

SEQ ID NO: 34398 - DNA, 20 bp, Artificial Sequence
  Description of Artificial Sequence: Synthetic oligonucleotide
  Target: ATXN1; (+) strand; PAM type: NNNNGHTT; PAM sequence: TCTAGATT
gagcattagtattttatggg

SEQ ID NO: 34399 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
tagtattttatgggtctaga

SEQ ID NO: 34400 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
tgtgaagacaagacaatgga

SEQ ID NO: 34401 - DNA, 20 bp, Artificial Sequence
  Description of Artificial Sequence: Synthetic oligonucleotide
  Target: ATXN1; (+) strand; PAM type: NNNNGHTT; PAM sequence: CATAGCTT
attatgttggtgaactatac

SEQ ID NO: 34402 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
tgaaacttacatgcaaagtt

SEQ ID NO: 34403 - DNA, 20 bp, Artificial Sequence
  Description of Artificial Sequence: Synthetic oligonucleotide
  Target: ATXN1; (+) strand; PAM type: NNNNGHTT; PAM sequence: GGTAGTTT
attggacagaagtcagaatg

SEQ ID NO: 34404 - DNA, 20 bp, Artificial Sequence
  Description of Artificial Sequence: Synthetic oligonucleotide
  Target: ATXN1; (+) strand; PAM type: NNNNGHTT; PAM sequence: GACTGATT
aagtcagaatgggtagttta

SEQ ID NO: 34405 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
tttagactgattaggtagac

SEQ ID NO: 34406 - DNA, 20 bp, Artificial Sequence
  Description of Artificial Sequence: Synthetic oligonucleotide
  Target: ATXN1; (+) strand; PAM type: NNNNGHTT; PAM sequence: GCTTGCTT
gactgattaggtagacagct

SEQ ID NO: 34407 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
agacagctgcttgcttccta

SEQ ID NO: 34408 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
caccattaaaaaaattcagg

SEQ ID NO: 34409 - DNA, 20 bp, Artificial Sequence
  Description of Artificial Sequence: Synthetic oligonucleotide
  Target: ATXN1; (+) strand; PAM type: NNNNGHTT; PAM sequence: ATCAGCTT
ttatcctagccaaggtctct

SEQ ID NO: 34410 - DNA, 20 bp, Artificial Sequence
  Description of Artificial Sequence: Synthetic oligonucleotide
  Target: ATXN1; (+) strand; PAM type: NNNNGHTT; PAM sequence: GACTGTTT
taatgtgagtgtctcaacaa

SEQ ID NO: 34411 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
gtgaggcatttggaagaggg

SEQ ID NO: 34412 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
agcacagatgaccttttgcc

SEQ ID NO: 34413 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
cttttgccacaagttttcat

SEQ ID NO: 34414 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
gccacaagttttcatacaag

SEQ ID NO: 34415 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
cacacaattcaaaacttgaa

SEQ ID NO: 34416 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
actgaactatggttagtaat

SEQ ID NO: 34417 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
tgccttagagctcggcattc

SEQ ID NO: 34418 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
gagtttgctgcaatgagtag

SEQ ID NO: 34419 - DNA, 20 bp, Artificial Sequence
  Description of Artificial Sequence: Synthetic oligonucleotide
  Target: ATXN1; (+) strand; PAM type: NNNNGHTT; PAM sequence: GACAGATT
atgatgtaatagataaggca

SEQ ID NO: 34420 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
aggcagacagattggatcag

SEQ ID NO: 34421 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
aatgcaaagcagccatgtgc

SEQ ID NO: 34422 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
aaagcagccatgtgccctgg

SEQ ID NO: 34423 - DNA, 20 bp, Artificial Sequence
  Description of Artificial Sequence: Synthetic oligonucleotide
  Target: ATXN1; (+) strand; PAM type: NNNNGHTT; PAM sequence: GGCAGCTT
ttcgcacctctctgtagctg

SEQ ID NO: 34424 - DNA, 20 bp, Artificial Sequence
  Description of Artificial Sequence: Synthetic oligonucleotide
  Target: ATXN1; (+) strand; PAM type: NNNNGHTT; PAM sequence: GGGAGTTT
gtctgtcattgtaatataca

SEQ ID NO: 34425 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
caagaagaggcaaccaagtg

SEQ ID NO: 34426 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
taaaaaggtaaacaacagga

SEQ ID NO: 34427 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
ggttttaatcacagtgttga

SEQ ID NO: 34428 - DNA, 20 bp, Artificial Sequence
  Description of Artificial Sequence: Synthetic oligonucleotide
  Target: ATXN1; (+) strand; PAM type: NNNNGHTT; PAM sequence: GGCAGCTT
gattgcatacccatgtccct

SEQ ID NO: 34429 - DNA, 20 bp, Artificial Sequence
  Description of Artificial Sequence: Synthetic oligonucleotide
  Target: ATXN1; (+) strand; PAM type: NNNNGHTT; PAM sequence: CAGCGCTT
ctggcagcttagaatggtta

SEQ ID NO: 34430 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
tcaccccacttccaaaaata

SEQ ID NO: 34431 - DNA, 20 bp, Artificial Sequence
  Description of Artificial Sequence: Synthetic oligonucleotide
  Target: ATXN1; (+) strand; PAM type: NNNNGHTT; PAM sequence: AACAGATT
gtctactccatacactctag

SEQ ID NO: 34432 - DNA, 20 bp, Artificial Sequence
  Description of Artificial Sequence: Synthetic oligonucleotide
  Target: ATXN1; (+) strand; PAM type: NNNNGHTT; PAM sequence: TATTGTTT
catatttataaagagaaatg

SEQ ID NO: 34433 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
gcaaaacttcatgtaaggtc

SEQ ID NO: 34434 - DNA, 20 bp, Artificial Sequence
  Description of Artificial Sequence: Synthetic oligonucleotide
  Target: ATXN1; (+) strand; PAM type: NNNNGHTT; PAM sequence: ACCAGATT
tactgtgttctggaagccag

SEQ ID NO: 34435 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
cagtatagaatgcaatgagt

SEQ ID NO: 34436 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
atcaggaattccaaaacatg

SEQ ID NO: 34437 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
tctttatcagtcctccacat

SEQ ID NO: 34438 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
gactctgataaaaatgtcaa

SEQ ID NO: 34439 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
tgcaggctccgagcatgccc

SEQ ID NO: 34440 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
tgccagagcagaaccctgca

SEQ ID NO: 34441 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
tcagtcagtctgttcgaact

SEQ ID NO: 34442 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
aaagtggcctgcctgcccct

SEQ ID NO: 34443 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
tgcccctggaagattaggtc

SEQ ID NO: 34444 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
ggaagattaggtcctgggtt

SEQ ID NO: 34445 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
gccactccgacccgatatca

SEQ ID NO: 34446 - DNA, 20 bp, Artificial Sequence
  Description of Artificial Sequence: Synthetic oligonucleotide
  Target: ATXN1; (+) strand; PAM type: NNNNGHTT; PAM sequence: TTATGCTT
atttttgccttttgaaagag

SEQ ID NO: 34447 - DNA, 20 bp, Artificial Sequence
  Description of Artificial Sequence: Synthetic oligonucleotide
  Target: ATXN1; (+) strand; PAM type: NNNNGHTT; PAM sequence: CATTGTTT
gccccagagcctttagaaca

SEQ ID NO: 34448 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
ctttgactcagccccttggt

SEQ ID NO: 34449 - DNA, 20 bp, Artificial Sequence
  Description of Artificial Sequence: Synthetic oligonucleotide
  Target: ATXN1; (+) strand; PAM type: NNNNGHTT; PAM sequence: ACCAGATT
aacactggtggagttctccc

SEQ ID NO: 34450 - DNA, 20 bp, Artificial Sequence
  Description of Artificial Sequence: Synthetic oligonucleotide
  Target: ATXN1; (+) strand; PAM type: NNNNGHTT; PAM sequence: GTCAGCTT
acattgttctgaaagtacac

SEQ ID NO: 34451 - DNA, 20 bp, Artificial Sequence
  Description of Artificial Sequence: Synthetic oligonucleotide
  Target: ATXN1; (+) strand; PAM type: NNNNGHTT; PAM sequence: GAGTGTTT
cctgaattgtctaggctaac

SEQ ID NO: 34452 - DNA, 20 bp, Artificial Sequence
  Description of Artificial Sequence: Synthetic oligonucleotide
  Target: ATXN1; (+) strand; PAM type: NNNNGHTT; PAM sequence: TTAGGCTT
gtctaggctaacgagtgttt

SEQ ID NO: 34453 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
tctcattgatcatgtcaaca

SEQ ID NO: 34454 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
actgaaaagacactttatga

SEQ ID NO: 34455 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
tgccatgttctctcttacct

SEQ ID NO: 34456 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
tgtcctcatgtgactagagc

SEQ ID NO: 34457 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
tgaactgaacaaattaagta

SEQ ID NO: 34458 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
aattagcaagcatcttgaag

SEQ ID NO: 34459 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
cttgaaaagcactcatgcac

SEQ ID NO: 34460 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
cactggggcttgccctttct

SEQ ID NO: 34461 - DNA, 20 bp, Artificial Sequence
  Description of Artificial Sequence: Synthetic oligonucleotide
  Target: ATXN1; (+) strand; PAM type: NNNNGHTT; PAM sequence: GCTGGATT
agctatgtgagtgagaccat

SEQ ID NO: 34462 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
agtccaggtgacccacaatc

SEQ ID NO: 34463 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
tcttggcccttaactgttgg

SEQ ID NO: 34464 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
tatgctaactgatacatcca

SEQ ID NO: 34465 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
cctcattcaagtctgaggat

SEQ ID NO: 34466 - DNA, 20 bp, Artificial Sequence
  Description of Artificial Sequence: Synthetic oligonucleotide
  Target: ATXN1; (+) strand; PAM type: NNNNGHTT; PAM sequence: GCCTGTTT
ggtcatggtgtaaaggaatt

SEQ ID NO: 34467 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
aagaatgtagatatccatct

SEQ ID NO: 34468 - DNA, 20 bp, Artificial Sequence
  Description of Artificial Sequence: Synthetic oligonucleotide
  Target: ATXN1; (+) strand; PAM type: NNNNGHTT; PAM sequence: GACTGTTT
aatttcaaagaattagacta

SEQ ID NO: 34469 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
aaccacatcaaaatgtattt

SEQ ID NO: 34470 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
ccttttatagatgagactat

SEQ ID NO: 34471 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
tttccaaactcactgtgcct

SEQ ID NO: 34472 - DNA, 20 bp, Artificial Sequence
  Description of Artificial Sequence: Synthetic oligonucleotide
  Target: ATXN1; (+) strand; PAM type: NNNNGHTT; PAM sequence: GATAGATT
tcacttcagcaacgcatcat

SEQ ID NO: 34473 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
ggtctgaaatctgaacccaa

SEQ ID NO: 34474 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
atagaggcacccagatagag

SEQ ID NO: 34475 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aacctccacctcccgggtcc

SEQ ID NO: 34476 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
atatatatttttagtagaga

SEQ ID NO: 34477 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
acctcaggtgatccacccgc

SEQ ID NO: 34478 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
gcctggcctagtcattaata

SEQ ID NO: 34479 - DNA, 20 bp, Artificial Sequence
  Description of Artificial Sequence: Synthetic oligonucleotide
  Target: ATXN1; (+) strand; PAM type: NNNNGHTT; PAM sequence: GTATGCTT
gaagggttctttctactcta

SEQ ID NO: 34480 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
atcaaacccagagaagaatt

SEQ ID NO: 34481 - DNA, 20 bp, Artificial Sequence
  Description of Artificial Sequence: Synthetic oligonucleotide
  Target: ATXN1; (+) strand; PAM type: NNNNGHTT; PAM sequence: TATTGTTT
aaatgtacttaataggtatt

SEQ ID NO: 34482 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
cactacaccctgtcaaacaa

SEQ ID NO: 34483 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
aaagtgccaacagctaccct

SEQ ID NO: 34484 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
tgtctttcccatcataagca

SEQ ID NO: 34485 - DNA, 20 bp, Artificial Sequence
  Description of Artificial Sequence: Synthetic oligonucleotide
  Target: ATXN1; (+) strand; PAM type: NNNNGHTT; PAM sequence: AGGGGCTT
gtcacccaaacccattgcct

SEQ ID NO: 34486 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
aatgtcacttgactgtccat

SEQ ID NO: 34487 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
taatgagaggagagcaatta

SEQ ID NO: 34488 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
agaaggctctcgttacactg

SEQ ID NO: 34489 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
ggggccaagagggactgtca

SEQ ID NO: 34490 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
ttccttctgcctcccttgac

SEQ ID NO: 34491 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
caagaaaaactgataccatc

SEQ ID NO: 34492 - DNA, 20 bp, Artificial Sequence
  Description of Artificial Sequence: Synthetic oligonucleotide
  Target: ATXN1; (+) strand; PAM type: NNNNGHTT; PAM sequence: GTGGGATT
taattcatttgttattctcc

SEQ ID NO: 34493 - DNA, 20 bp, Artificial Sequence
  Description of Artificial Sequence: Synthetic oligonucleotide
  Target: ATXN1; (+) strand; PAM type: NNNNGHTT; PAM sequence: TGACGTTT
cccatgatacacttagtaag

SEQ ID NO: 34494 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
atcaccagtggggctaggaa

SEQ ID NO: 34495 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
cgccaatgacagtgatgaga

SEQ ID NO: 34496 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
cactaccctttcatctacat

SEQ ID NO: 34497 - DNA, 20 bp, Artificial Sequence
  Description of Artificial Sequence: Synthetic oligonucleotide
  Target: ATXN1; (+) strand; PAM type: NNNNGHTT; PAM sequence: ACTAGCTT
tgactgagaaggggcaagga

SEQ ID NO: 34498 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
tttagataggagctgcatga

SEQ ID NO: 34499 - DNA, 20 bp, Artificial Sequence
  Description of Artificial Sequence: Synthetic oligonucleotide
  Target: ATXN1; (+) strand; PAM type: NNNNGHTT; PAM sequence: GTTAGTTT
gacatttgcacctttaattt

SEQ ID NO: 34500 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
ccaaacagaaggaaaaaaca

SEQ ID NO: 34501 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
aacaatctgtttggacaagc

SEQ ID NO: 34502 - DNA, 20 bp, Artificial Sequence
  Description of Artificial Sequence: Synthetic oligonucleotide
  Target: ATXN1; (+) strand; PAM type: NNNNGHTT; PAM sequence: TAGGGCTT
ggcaaaggaaaccggaaaac

SEQ ID NO: 34503 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
agttctctttgttctgcagg

SEQ ID NO: 34504 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
gttctgcagggtgagtttta

SEQ ID NO: 34505 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
ttaagactgcctatcaaagt

SEQ ID NO: 34506 - DNA, 20 bp, Artificial Sequence
  Description of Artificial Sequence: Synthetic oligonucleotide
  Target: ATXN1; (+) strand; PAM type: NNNNGHTT; PAM sequence: AAAGGCTT
ttcaattctatgcaagccac

SEQ ID NO: 34507 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
gctggtgaggatggctgatg

SEQ ID NO: 34508 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
actgggaaatgatcacaaga

SEQ ID NO: 34509 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
gcatgatgataaaaacctgt

SEQ ID NO: 34510 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
cctgtctgagttttggaaat

SEQ ID NO: 34511 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
gatagccatttgtataccat

SEQ ID NO: 34512 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
aaggagactctccttaagca

SEQ ID NO: 34513 - DNA, 20 bp, Artificial Sequence
  Description of Artificial Sequence: Synthetic oligonucleotide
  Target: ATXN1; (+) strand; PAM type: NNNNGHTT; PAM sequence: ATAGGTTT
gaaaacttaatttctctaac

SEQ ID NO: 34514 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
ttttctgaatcatgtaacat

SEQ ID NO: 34515 - DNA, 20 bp, Artificial Sequence
  Description of Artificial Sequence: Synthetic oligonucleotide
  Target: ATXN1; (+) strand; PAM type: NNNNGHTT; PAM sequence: TCAGGATT
ggaaaaggttaacataatct

SEQ ID NO: 34516 - DNA, 20 bp, Artificial Sequence
  Description of Artificial Sequence: Synthetic oligonucleotide
  Target: ATXN1; (+) strand; PAM type: NNNNGHTT; PAM sequence: GATGGATT
aatcttcaggatttatagaa

SEQ ID NO: 34517 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
gttaatatttttatggtata

SEQ ID NO: 34518 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
atgaagttacctttctattt

SEQ ID NO: 34519 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
tttatgtgttgttaagaacc

SEQ ID NO: 34520 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tgttgttaagaaccaataga

SEQ ID NO: 34521 - DNA, 20 bp, Artificial Sequence
  Description of Artificial Sequence: Synthetic oligonucleotide
  Target: ATXN1; (+) strand; PAM type: NNNNGHTT; PAM sequence: TGTGGATT
tcatccctgcccttctttat

SEQ ID NO: 34522 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
taccacctaaaaaatacatc

SEQ ID NO: 34523 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
cctaaaaaatacatctttag

SEQ ID NO: 34524 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
aaatacatctttagttttgt

SEQ ID NO: 34525 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
attctttaggcatcccaagt

SEQ ID NO: 34526 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
tgggcagatcacttgagctc

SEQ ID NO: 34527 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
ttgggaggctgaggcaggag

SEQ ID NO: 34528 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
atgtgctacaaatcctcatg

SEQ ID NO: 34529 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
atattgggttgaaattccac

SEQ ID NO: 34530 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
gagtctcaaagggcagtaag

SEQ ID NO: 34531 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
cagcctgaccaggctgttga

SEQ ID NO: 34532 - DNA, 20 bp, Artificial Sequence
  Description of Artificial Sequence: Synthetic oligonucleotide
  Target: ATXN1; (+) strand; PAM type: NNNNGHTT; PAM sequence: CTACGCTT
aagggtgtgcctgggatggg

SEQ ID NO: 34533 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
atctgcaggagcattacaag

SEQ ID NO: 34534 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
caagcaaggatttaagaaaa

SEQ ID NO: 34535 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
ctcctgaccctcttatctac

SEQ ID NO: 34536 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
gacagacacagagggaaatt

SEQ ID NO: 34537 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
tgtgtgcaattctcttagtc

SEQ ID NO: 34538 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
gacttacacagacagcataa

SEQ ID NO: 34539 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
ctagcacaatgcctccctaa

SEQ ID NO: 34540 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
acacaccacagagacattaa

SEQ ID NO: 34541 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
ccccacacccttaaactgct

SEQ ID NO: 34542 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
gaataccatccctccttttg

SEQ ID NO: 34543 - DNA, 20 bp, Artificial Sequence
  Description of Artificial Sequence: Synthetic oligonucleotide
  Target: ATXN1; (+) strand; PAM type: NNNNGHTT; PAM sequence: TGATGATT
tgcagactagttgaggagac

SEQ ID NO: 34544 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
aaataaatatataatatgta

SEQ ID NO: 34545 - DNA, 20 bp, Artificial Sequence
  Description of Artificial Sequence: Synthetic oligonucleotide
  Target: ATXN1; (+) strand; PAM type: NNNNGHTT; PAM sequence: GGCTGCTT
attttatgtagatcagggaa

SEQ ID NO: 34546 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
attcctacttaaggaagcag

SEQ ID NO: 34547 - DNA, 20 bp, Artificial Sequence
  Description of Artificial Sequence: Synthetic oligonucleotide
  Target: ATXN1; (+) strand; PAM type: NNNNGHTT; PAM sequence: CCTTGCTT
tgaaatatggatcactttct

SEQ ID NO: 34548 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
aaccaatatttgagcacaga

SEQ ID NO: 34549 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
aactcaagttcaaaaatcgt

SEQ ID NO: 34550 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
gcccaggagggtcttgtgga

SEQ ID NO: 34551 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
tttaaccctaagactgtgct

SEQ ID NO: 34552 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
taaatgaggtagtgccaaat

SEQ ID NO: 34553 - DNA, 20 bp, Artificial Sequence
  Description of Artificial Sequence: Synthetic oligonucleotide
  Target: ATXN1; (+) strand; PAM type: NNNNGHTT; PAM sequence: AGGTGATT
agggtaaaaaccaccactgg

SEQ ID NO: 34554 - DNA, 20 bp, Artificial Sequence
  Description of Artificial Sequence: Synthetic oligonucleotide
  Target: ATXN1; (+) strand; PAM type: NNNNGHTT; PAM sequence: GGCAGATT
gccatctgctggcaagtggt

SEQ ID NO: 34555 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
accactacttccaatggctg

SEQ ID NO: 34556 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
tttatacacccactcctaga

SEQ ID NO: 34557 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
ctgcaacagttctccatggc

SEQ ID NO: 34558 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
taatgaaaggttaccaacat

SEQ ID NO: 34559 - DNA, 20 bp, Artificial Sequence
  Description of Artificial Sequence: Synthetic oligonucleotide
  Target: ATXN1; (+) strand; PAM type: NNNNGHTT; PAM sequence: TGCGGTTT
cactgcccctaccaagcaaa

SEQ ID NO: 34560 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
ctcaacacactccatttaca

SEQ ID NO: 34561 - DNA, 20 bp, Artificial Sequence
  Description of Artificial Sequence: Synthetic oligonucleotide
  Target: ATXN1; (+) strand; PAM type: NNNNGHTT; PAM sequence: ACTAGATT
aacaacaacaaaaaaccccc

SEQ ID NO: 34562 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
tagatttgaaacaaaagcta

SEQ ID NO: 34563 - DNA, 20 bp, Artificial Sequence
  Description of Artificial Sequence: Synthetic oligonucleotide
  Target: ATXN1; (+) strand; PAM type: NNNNGHTT; PAM sequence: AGCAGTTT
aaatagagcctgaaacctaa

SEQ ID NO: 34564 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
aaagcagttttacataagac

SEQ ID NO: 34565 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
acacttgtttcctaggataa

SEQ ID NO: 34566 - DNA, 20 bp, Artificial Sequence
  Description of Artificial Sequence: Synthetic oligonucleotide
  Target: ATXN1; (+) strand; PAM type: NNNNGHTT; PAM sequence: ACCTGATT
agaagtgcattctaacagtt

SEQ ID NO: 34567 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
taacagttacctgattggga

SEQ ID NO: 34568 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
agtgacagaaacttttacaa

SEQ ID NO: 34569 - DNA, 20 bp, Artificial Sequence
  Description of Artificial Sequence: Synthetic oligonucleotide
  Target: ATXN1; (+) strand; PAM type: NNNNGHTT; PAM sequence: TAGTGCTT
ttttaaaaaaataagtaaaa

SEQ ID NO: 34570 - DNA, 20 bp, Artificial Sequence
  Description of Artificial Sequence: Synthetic oligonucleotide
  Target: ATXN1; (+) strand; PAM type: NNNNGHTT; PAM sequence: TGCTGATT
atgaggaccctaaaccaaga

SEQ ID NO: 34571 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ggaccctaaaccaagatgct

SEQ ID NO: 34572 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
ggctgaggtgggagggtcac

SEQ ID NO: 34573 - DNA, 20 bp, Artificial Sequence
  Description of Artificial Sequence: Synthetic oligonucleotide
  Target: ATXN1; (+) strand; PAM type: NNNNGHTT; PAM sequence: TATTGTTT
caatacacagacttgcaaaa

SEQ ID NO: 34574 - DNA, 20 bp, Artificial Sequence
  Description of Artificial Sequence: Synthetic oligonucleotide
  Target: ATXN1; (+) strand; PAM type: NNNNGHTT; PAM sequence: ATAGGATT
acttgatctcaacagtagga

SEQ ID NO: 34575 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
gtaggaataggattcaggtc

SEQ ID NO: 34576 - DNA, 20 bp, Artificial Sequence
  Description of Artificial Sequence: Synthetic oligonucleotide
  Target: ATXN1; (+) strand; PAM type: NNNNGHTT; PAM sequence: GACTGATT
aggtcagctgattccaggct

SEQ ID NO: 34577 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
tgtacagaatggaaacacaa

SEQ ID NO: 34578 - DNA, 20 bp, Artificial Sequence
  Description of Artificial Sequence: Synthetic oligonucleotide
  Target: ATXN1; (+) strand; PAM type: NNNNGHTT; PAM sequence: GTCTGCTT
aagcttcagtgtctcccact

SEQ ID NO: 34579 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
taataagctcatattaatat

SEQ ID NO: 34580 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
acatatgcatattttaatac

SEQ ID NO: 34581 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
aataggtaatacatgttcaa

SEQ ID NO: 34582 - DNA, 20 bp, Artificial Sequence
  Description of Artificial Sequence: Synthetic oligonucleotide
  Target: ATXN1; (+) strand; PAM type: NNNNGHTT; PAM sequence: ATTGGCTT
acaacaaaaacctagaagaa

SEQ ID NO: 34583 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
agaggtattcataggccatc

SEQ ID NO: 34584 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
tcctggtcaaaatctcctaa

SEQ ID NO: 34585 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
gtaagggaagcaccaaacat

SEQ ID NO: 34586 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
ctgcttgtaacttgcatacc

SEQ ID NO: 34587 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
gaataattgctggatggaaa

SEQ ID NO: 34588 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
acctaaaagaactgcaacag

SEQ ID NO: 34589 - DNA, 20 bp, Artificial Sequence
  Description of Artificial Sequence: Synthetic oligonucleotide
  Target: ATXN1; (+) strand; PAM type: NNNNGHTT; PAM sequence: GATAGTTT
atccttttattcctgaagta

SEQ ID NO: 34590 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
acacctggctcggttacatc

SEQ ID NO: 34591 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
aaaagcctcaaaacaggcca

SEQ ID NO: 34592 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
cgtctgcatgccctactgtg

SEQ ID NO: 34593 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
gttatttggtacacggctcc

SEQ ID NO: 34594 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
gtacacggctccctcagatt

SEQ ID NO: 34595 - DNA, 20 bp, Artificial Sequence
  Description of Artificial Sequence: Synthetic oligonucleotide
  Target: ATXN1; (+) strand; PAM type: NNNNGHTT; PAM sequence: CAGCGTTT
tccctcagattgctggtttg

SEQ ID NO: 34596 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
tttgcagcgtttcgtgcact

SEQ ID NO: 34597 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
cacagcgaggccctgctgga

SEQ ID NO: 34598 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tggaaaaggattggataact

SEQ ID NO: 34599 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
ataactttttgtttatttgc

SEQ ID NO: 34600 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
gatcattaatattttccaca

SEQ ID NO: 34601 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
atattttccacacctggatt

SEQ ID NO: 34602 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
cctttcaaggctgacccagg

SEQ ID NO: 34603 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
gaggcaaaggaacttgtatt

SEQ ID NO: 34604 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
taagtgctacactagaatct

SEQ ID NO: 34605 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
acatcatcgacaaaggccag

SEQ ID NO: 34606 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
aagaatgaataataacaaat

SEQ ID NO: 34607 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
accatcactttcataatgaa

SEQ ID NO: 34608 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
cataatgaatacagtttacc

SEQ ID NO: 34609 - DNA, 20 bp, Artificial Sequence
  Description of Artificial Sequence: Synthetic oligonucleotide
  Target: ATXN1; (+) strand; PAM type: NNNNGHTT; PAM sequence: ATTCGCTT
gctttctcattaattaaatc

SEQ ID NO: 34610 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
ggacagaattaaataattat

SEQ ID NO: 34611 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
atatgaaggaaaaatgaaca

SEQ ID NO: 34612 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
acttagaaggagggtctcag

SEQ ID NO: 34613 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
gagcagaagttagccaggca

SEQ ID NO: 34614 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
tctccataccttgaaataag

SEQ ID NO: 34615 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
cagagcaacacacaccttct

SEQ ID NO: 34616 - DNA, 20 bp, Artificial Sequence
  Description of Artificial Sequence: Synthetic oligonucleotide
  Target: ATXN1; (+) strand; PAM type: NNNNGHTT; PAM sequence: ACCAGATT
tttaggaccttggatcaggt

SEQ ID NO: 34617 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
cttggatcaggtaccagatt

SEQ ID NO: 34618 - DNA, 20 bp, Artificial Sequence
  Description of Artificial Sequence: Synthetic oligonucleotide
  Target: ATXN1; (+) strand; PAM type: NNNNGHTT; PAM sequence: TGATGATT
ccagatttctggcttcccct

SEQ ID NO: 34619 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
ctatttctctcttggactta

SEQ ID NO: 34620 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
tcttggttcttggttcagtg

SEQ ID NO: 34621 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
ggaaatgtcatgttcatctg

SEQ ID NO: 34622 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
ttcttccactaaggaaaatc

SEQ ID NO: 34623 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
tccactaaggaaaatcagta

SEQ ID NO: 34624 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
gataaaatgtaatttatcct

SEQ ID NO: 34625 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
ctgggaaattacgccaggct

SEQ ID NO: 34626 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
atactgtctttttatactcc

SEQ ID NO: 34627 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
atttaagtcttgaaggctca

SEQ ID NO: 34628 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
aacagcatctagtggaagag

SEQ ID NO: 34629 - DNA, 20 bp, Artificial Sequence
  Description of Artificial Sequence: Synthetic oligonucleotide
  Target: ATXN1; (+) strand; PAM type: NNNNGHTT; PAM sequence: CTATGCTT
aaagaatcaccagtctacag

SEQ ID NO: 34630 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
tgaacagttgtcatctcctt

SEQ ID NO: 34631 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
tcccccatttcctcatcacc

SEQ ID NO: 34632 - DNA, 20 bp, Artificial Sequence
  Description of Artificial Sequence: Synthetic oligonucleotide
  Target: ATXN1; (+) strand; PAM type: NNNNGHTT; PAM sequence: CATAGCTT
cagcttacatcactagctct

SEQ ID NO: 34633 - DNA, 20 bp, Artificial Sequence
  Description of Artificial Sequence: Synthetic oligonucleotide
  Target: ATXN1; (+) strand; PAM type: NNNNGHTT; PAM sequence: GGTGGCTT
ttgggaggctgaggcaggaa

SEQ ID NO: 34634 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
ctaagacccatctgtagaat

SEQ ID NO: 34635 - DNA, 20 bp, Artificial Sequence
  Description of Artificial Sequence: Synthetic oligonucleotide
  Target: ATXN1; (+) strand; PAM type: NNNNGHTT; PAM sequence: GTAGGCTT
tctgtagaatttctgattca

SEQ ID NO: 34636 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
agaaccacttctctaaggtt

SEQ ID NO: 34637 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
ccaaatggctgtcctctctc

SEQ ID NO: 34638 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
ccgcctacatcttaaaactc

SEQ ID NO: 34639 - DNA, 20 bp, Artificial Sequence
  Description of Artificial Sequence: Synthetic oligonucleotide
  Target: ATXN1; (+) strand; PAM type: NNNNGHTT; PAM sequence: GCTTGATT
ctacatcttaaaactctgga

SEQ ID NO: 34640 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
cttctcctccaaaggtcaag

SEQ ID NO: 34641 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
ggagcatgatgctactaaca

SEQ ID NO: 34642 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
acagaaagcccactggagaa

SEQ ID NO: 34643 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
tcctgatgacagtaaagtcc

SEQ ID NO: 34644 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
tgccagaagttagacggatc

SEQ ID NO: 34645 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgactcagcctcccgagtag

SEQ ID NO: 34646 - DNA, 20 bp, Artificial Sequence
  Description of Artificial Sequence: Synthetic oligonucleotide
  Target: ATXN1; (+) strand; PAM type: NNNNGHTT; PAM sequence: CAAGGTTT
ttttttttttttttttgata

SEQ ID NO: 34647 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
tttggtatttttagtagaga

SEQ ID NO: 34648 - DNA, 20 bp, Artificial Sequence
  Description of Artificial Sequence: Synthetic oligonucleotide
  Target: ATXN1; (+) strand; PAM type: NNNNGHTT; PAM sequence: CCGGGATT
tgcctcagcctcccaaagtg

SEQ ID NO: 34649 - DNA, 20 bp, Artificial Sequence
  Description of Artificial Sequence: Synthetic oligonucleotide
  Target: ATXN1; (+) strand; PAM type: NNNNGHTT; PAM sequence: ACAAGATT
accaaattctaacgtagccc

SEQ ID NO: 34650 - DNA, 20 bp, Artificial Sequence
  Description of Artificial Sequence: Synthetic oligonucleotide
  Target: ATXN1; (+) strand; PAM type: NNNNGHTT; PAM sequence: AAGGGATT
atcaaggttctgctgttgtg

SEQ ID NO: 34651 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
agtcaaccaaccttaaaata

SEQ ID NO: 34652 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
taagagaaccctaaaaggga

SEQ ID NO: 34653 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
gggatggggctttaccagga

SEQ ID NO: 34654 - DNA, 20 bp, Artificial Sequence
  Description of Artificial Sequence: Synthetic oligonucleotide
  Target: ATXN1; (+) strand; PAM type: NNNNGHTT; PAM sequence: GTGAGCTT
aactaaatacaaaaaaccat

SEQ ID NO: 34655 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
cacaaaaaaaaataaatagg

SEQ ID NO: 34656 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
gttgtttaagtcactatatt

SEQ ID NO: 34657 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
tacaatacatttcttttttt

SEQ ID NO: 34658 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
ttttttttgcttgaatcact

SEQ ID NO: 34659 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
attactccttatggcccctc

SEQ ID NO: 34660 - DNA, 20 bp, Artificial Sequence
  Description of Artificial Sequence: Synthetic oligonucleotide
  Target: ATXN1; (+) strand; PAM type: NNNNGHTT; PAM sequence: GACAGATT
tgttctttctaactctaggg

SEQ ID NO: 34661 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
tcagttctattcactttcta

SEQ ID NO: 34662 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
tttctataatgatttccttc

SEQ ID NO: 34663 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
atatatgcagtggaaacaaa

SEQ ID NO: 34664 - DNA, 20 bp, Artificial Sequence
  Description of Artificial Sequence: Synthetic oligonucleotide
  Target: ATXN1; (+) strand; PAM type: NNNNGHTT; PAM sequence: ATCGGTTT
tactctttctcccacattcc

SEQ ID NO: 34665 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
ctgctcattggtcttcttgt

SEQ ID NO: 34666 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
tccataccttcattggttcc

SEQ ID NO: 34667 - DNA, 20 bp, Artificial Sequence
  Description of Artificial Sequence: Synthetic oligonucleotide
  Target: ATXN1; (+) strand; PAM type: NNNNGHTT; PAM sequence: GCATGCTT
atcttcacaatctggcccca

SEQ ID NO: 34668 - DNA, 20 bp, Artificial Sequence
  Description of Artificial Sequence: Synthetic oligonucleotide
  Target: ATXN1; (+) strand; PAM type: NNNNGHTT; PAM sequence: GTGAGCTT
tgcacactgaagcagccaca

SEQ ID NO: 34669 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
attctacaactttctcaatc

SEQ ID NO: 34670 - DNA, 20 bp, Artificial Sequence
  Description of Artificial Sequence: Synthetic oligonucleotide
  Target: ATXN1; (+) strand; PAM type: NNNNGHTT; PAM sequence: GGTTGTTT
gttttttttttttttttttt

SEQ ID NO: 34671 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tttttttttttttttggttg

SEQ ID NO: 34672 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
tgtttttgcatgtgaatgcc

SEQ ID NO: 34673 - DNA, 20 bp, Artificial Sequence
  Description of Artificial Sequence: Synthetic oligonucleotide
  Target: ATXN1; (+) strand; PAM type: NNNNGHTT; PAM sequence: TAGGGTTT
tgtggtaacttccgtaaagg

SEQ ID NO: 34674 - DNA, 20 bp, Artificial Sequence
  Description of Artificial Sequence: Synthetic oligonucleotide
  Target: ATXN1; (+) strand; PAM type: NNNNGHTT; PAM sequence: GTAAGCTT
tttatgtctgtcttcttttt

SEQ ID NO: 34675 - DNA, 20 bp, Artificial Sequence
  Description of Artificial Sequence: Synthetic oligonucleotide
  Target: ATXN1; (+) strand; PAM type: NNNNGHTT; PAM sequence: CGGGGCTT
tcttctttttgtaagcttca

SEQ ID NO: 34676 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
ataactctttgatcaatatt

SEQ ID NO: 34677 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
ttgatcaatatttgttgatt

SEQ ID NO: 34678 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
ctggcaattgcagagttcag

SEQ ID NO: 34679 - DNA, 20 bp, Artificial Sequence
  Description of Artificial Sequence: Synthetic oligonucleotide
  Target: ATXN1; (+) strand; PAM type: NNNNGHTT; PAM sequence: AGGAGCTT
tgtctccaccctgcccacca

SEQ ID NO: 34680 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
aactcaaggtattctgaaga

SEQ ID NO: 34681 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
aatattctctgtgtatatta

SEQ ID NO: 34682 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
ctggaaaaatgtctatcctc

SEQ ID NO: 34683 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
tatttcatgttgatccatgt

SEQ ID NO: 34684 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
tcactgcttcttatcattag

SEQ ID NO: 34685 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
catggcttatcacataaagg

SEQ ID NO: 34686 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
atctccttatggacgtagtg

SEQ ID NO: 34687 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
cacgcaccttctgcccagag

SEQ ID NO: 34688 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
cagaggagagttttattcat

SEQ ID NO: 34689 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
tcatgcctgcttgaaaaggt

SEQ ID NO: 34690 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
tcagtgtttaggtgttgcag

SEQ ID NO: 34691 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
gctgaaacacagcctgtgcc

SEQ ID NO: 34692 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
gtccagtcctctgactttaa

SEQ ID NO: 34693 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
gctacagctgggacatcaaa

SEQ ID NO: 34694 - DNA, 20 bp, Artificial Sequence
  Description of Artificial Sequence: Synthetic oligonucleotide
  Target: ATXN1; (+) strand; PAM type: NNNNGHTT; PAM sequence: GGTGGCTT
ttagtattggggctaggcgt

SEQ ID NO: 34695 - DNA, 20 bp, Artificial Sequence
  Description of Artificial Sequence: Synthetic oligonucleotide
  Target: ATXN1; (+) strand; PAM type: NNNNGHTT; PAM sequence: GCCAGATT
ttctgaaattcaaaatcagt

SEQ ID NO: 34696 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
cagatttaactacttttgca

SEQ ID NO: 34697 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
actcattttctttttggtct

SEQ ID NO: 34698 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
actattccgagtaactgcct

SEQ ID NO: 34699 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
aaaacttctctttttttgga

SEQ ID NO: 34700 - DNA, 20 bp, Artificial Sequence
  Description of Artificial Sequence: Synthetic oligonucleotide
  Target: ATXN1; (+) strand; PAM type: NNNNGHTT; PAM sequence: TCTAGCTT
aggaggcttcataaaagcat

SEQ ID NO: 34701 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
aaaagcattctagcttaaaa

SEQ ID NO: 34702 - DNA, 20 bp, Artificial Sequence
  Description of Artificial Sequence: Synthetic oligonucleotide
  Target: ATXN1; (+) strand; PAM type: NNNNGHTT; PAM sequence: TAGGGATT
atgccacttggcattatatc

SEQ ID NO: 34703 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
tctttctatgaatgtggcgc

SEQ ID NO: 34704 - DNA, 20 bp, Artificial Sequence
  Description of Artificial Sequence: Synthetic oligonucleotide
  Target: ATXN1; (+) strand; PAM type: NNNNGHTT; PAM sequence: CGTGGTTT
ggacgctggcaagatgcagc

SEQ ID NO: 34705 - DNA, 20 bp, Artificial Sequence
  Description of Artificial Sequence: Synthetic oligonucleotide
  Target: ATXN1; (+) strand; PAM type: NNNNGHTT; PAM sequence: TCGCGTTT
tcagttaaaatacctgatga

SEQ ID NO: 34706 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
ctttacaccatgagcattct

SEQ ID NO: 34707 - DNA, 20 bp, Artificial Sequence
  Description of Artificial Sequence: Synthetic oligonucleotide
  Target: ATXN1; (+) strand; PAM type: NNNNGHTT; PAM sequence: ACAGGATT
ttctattaggagaaagaata

SEQ ID NO: 34708 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
tctcccctcctccttcatct

SEQ ID NO: 34709 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
ctccttcatcttgcagattt

SEQ ID NO: 34710 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
ttatcctagtatcatggctc

SEQ ID NO: 34711 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
aaaaggagaaaatctctctt

SEQ ID NO: 34712 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
aaaatctctcttcactgctt

SEQ ID NO: 34713 - DNA, 20 bp, Artificial Sequence
  Description of Artificial Sequence: Synthetic oligonucleotide
  Target: ATXN1; (+) strand; PAM type: NNNNGHTT; PAM sequence: GACAGCTT
cttcgttatggaaatgaagt

SEQ ID NO: 34714 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
acagaaaatgctatttttaa

SEQ ID NO: 34715 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
tgatgtaaaaagaaaaaaaa

SEQ ID NO: 34716 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
agaaagaaagaaaattaaat

SEQ ID NO: 34717 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
aaaattaaataaatgattaa

SEQ ID NO: 34718 - DNA, 20 bp, Artificial Sequence
  Description of Artificial Sequence: Synthetic oligonucleotide
  Target: ATXN1; (+) strand; PAM type: NNNNGHTT; PAM sequence: GTGGGCTT
ttccacttttagaccgttct

SEQ ID NO: 34719 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
ttcgtgtgactttcactctc

SEQ ID NO: 34720 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
aacgccgtgcaagttcctcc

SEQ ID NO: 34721 - DNA, 20 bp, Artificial Sequence
  Description of Artificial Sequence: Synthetic oligonucleotide
  Target: ATXN1; (+) strand; PAM type: NNNNGHTT; PAM sequence: ACTTGATT
gtggcagggccatgctggga

SEQ ID NO: 34722 - DNA, 20 bp, Artificial Sequence
  Description of Artificial Sequence: Synthetic oligonucleotide
  Target: ATXN1; (+) strand; PAM type: NNNNGHTT; PAM sequence: CCAAGCTT
ttctagtaaggaagaggtgc

SEQ ID NO: 34723 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
taaggaagaggtgcccaagc

SEQ ID NO: 34724 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
gaatcacaaagggtaaaatg

SEQ ID NO: 34725 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
actggtttaaggctatatgt

SEQ ID NO: 34726 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
aaaacaaaattcagcatttt

SEQ ID NO: 34727 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
gtttttaaagtgtgtaagtc

SEQ ID NO: 34728 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
catcatcactatctaattcc

SEQ ID NO: 34729 - DNA, 20 bp, Artificial Sequence
  Description of Artificial Sequence: Synthetic oligonucleotide
  Target: ATXN1; (+) strand; PAM type: NNNNGHTT; PAM sequence: GGCTGCTT
atatgtggccttttgtgtct

SEQ ID NO: 34730 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
ctggctgctttctcttggca

SEQ ID NO: 34731 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
aacatgtaccagtacttcat

SEQ ID NO: 34732 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
cgtcagttgatggacatttg

SEQ ID NO: 34733 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
gctgctatgaacattcatgt

SEQ ID NO: 34734 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
atgaacattcatgtacatgt

SEQ ID NO: 34735 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
gtacatgtttttgtttgaat

SEQ ID NO: 34736 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
agctatttgaggacttgcca

SEQ ID NO: 34737 - DNA, 20 bp, Artificial Sequence
  Description of Artificial Sequence: Synthetic oligonucleotide
  Target: ATXN1; (+) strand; PAM type: NNNNGHTT; PAM sequence: TAGTGATT
acttgccaaattgttttcta

SEQ ID NO: 34738 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
acattcccaccagccaggta

SEQ ID NO: 34739 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
ggaagattaccattttttcc

SEQ ID NO: 34740 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
ataataaagtggtatctcat

SEQ ID NO: 34741 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
aaagtggtatctcattgtgg

SEQ ID NO: 34742 - DNA, 20 bp, Artificial Sequence
  Description of Artificial Sequence: Synthetic oligonucleotide
  Target: ATXN1; (+) strand; PAM type: NNNNGHTT; PAM sequence: ATAAGCTT
atgatgttggacatcttttc

SEQ ID NO: 34743 - DNA, 20 bp, Artificial Sequence
  Description of Artificial Sequence: Synthetic oligonucleotide
  Target: ATXN1; (+) strand; PAM type: NNNNGHTT; PAM sequence: AAAGGCTT
gacagtgccctttggttcac

SEQ ID NO: 34744 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
atgcatctatttttttcttt

SEQ ID NO: 34745 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
ctatttttttcttttgttgt

SEQ ID NO: 34746 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
tattgccaaatccatggtca

SEQ ID NO: 34747 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
ccatggtcatgaagatttac

SEQ ID NO: 34748 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
atttactcctgttttcattt

SEQ ID NO: 34749 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
ctgttttcatttaaaagttt

SEQ ID NO: 34750 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
caattgttgaaaagaggtaa

SEQ ID NO: 34751 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
taagagagattttgagtatg

SEQ ID NO: 34752 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
attattttaaaaattaattt

SEQ ID NO: 34753 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
actgtattcagccactattt

SEQ ID NO: 34754 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
tcccacattttaaagatgca

SEQ ID NO: 34755 - DNA, 20 bp, Artificial Sequence
  Description of Artificial Sequence: Synthetic oligonucleotide
  Target: ATXN1; (+) strand; PAM type: NNNNGHTT; PAM sequence: CTGAGCTT
gacccaccagagccatgatg

SEQ ID NO: 34756 - DNA, 20 bp, Artificial Sequence
  Description of Artificial Sequence: Synthetic oligonucleotide
  Target: ATXN1; (+) strand; PAM type: NNNNGHTT; PAM sequence: TGGTGCTT
aagccaaccacctcttgagg

SEQ ID NO: 34757 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
aactaattttcaaaagcaac

SEQ ID NO: 34758 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
actttgggttgcatttgcct

SEQ ID NO: 34759 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
ccaagcccgacacccaccca

SEQ ID NO: 34760 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
ttttggcatgatacctaaga

SEQ ID NO: 34761 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
ctacacattgtgaccaccca

SEQ ID NO: 34762 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
agaattttggaaagctcccc

SEQ ID NO: 34763 - DNA, 20 bp, Artificial Sequence
  Description of Artificial Sequence: Synthetic oligonucleotide
  Target: ATXN1; (+) strand; PAM type: NNNNGHTT; PAM sequence: ACATGATT
gcaattagggatgtacattt

SEQ ID NO: 34764 - DNA, 20 bp, Artificial Sequence
  Description of Artificial Sequence: Synthetic oligonucleotide
  Target: ATXN1; (+) strand; PAM type: NNNNGHTT; PAM sequence: GTCCGATT
gattttaaaagtcttatgat

SEQ ID NO: 34765 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
ttctcaacaaccgtgtgaaa

SEQ ID NO: 34766 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
cacacgaggaaacaaactct

SEQ ID NO: 34767 - DNA, 20 bp, Artificial Sequence
  Description of Artificial Sequence: Synthetic oligonucleotide
  Target: ATXN1; (+) strand; PAM type: NNNNGHTT; PAM sequence: AATTGATT
agaacttggaagtggcagaa

SEQ ID NO: 34768 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
cagaaaattgattttaatac

SEQ ID NO: 34769 - DNA, 20 bp, Artificial Sequence
  Description of Artificial Sequence: Synthetic oligonucleotide
  Target: ATXN1; (+) strand; PAM type: NNNNGHTT; PAM sequence: TAGGGTTT
actacaagaaggtacctggg

SEQ ID NO: 34770 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
aaactaccaattcattcatt

SEQ ID NO: 34771 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
ggattcatctaatgcccata

SEQ ID NO: 34772 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
taatgcccatatatagatta

SEQ ID NO: 34773 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
atgatggtagaaattgggaa

SEQ ID NO: 34774 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
aaactggtgcactcaaatgt

SEQ ID NO: 34775 - DNA, 20 bp, Artificial Sequence
  Description of Artificial Sequence: Synthetic oligonucleotide
  Target: ATXN1; (+) strand; PAM type: NNNNGHTT; PAM sequence: CAAGGCTT
tgcatacacacaatcacaca

SEQ ID NO: 34776 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
ggagggttgtcatgttatta

SEQ ID NO: 34777 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
gggatacatgtgcagaacat

SEQ ID NO: 34778 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
cataggtatacatgtgccat

SEQ ID NO: 34779 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
tgcacctatcaacccatcat

SEQ ID NO: 34780 - DNA, 20 bp, Artificial Sequence
  Description of Artificial Sequence: Synthetic oligonucleotide
  Target: ATXN1; (+) strand; PAM type: NNNNGHTT; PAM sequence: CGGTGTTT
ctactatgagtgagaacatg

SEQ ID NO: 34781 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
atgagtgagaacatgcggtg

SEQ ID NO: 34782 - DNA, 20 bp, Artificial Sequence
  Description of Artificial Sequence: Synthetic oligonucleotide
  Target: ATXN1; (+) strand; PAM type: NNNNGHTT; PAM sequence: GTTAGTTT
gtttggttttctgttcctgt

SEQ ID NO: 34783 - DNA, 20 bp, Artificial Sequence
  Description of Artificial Sequence: Synthetic oligonucleotide
  Target: ATXN1; (+) strand; PAM type: NNNNGHTT; PAM sequence: TGAGGCTT
ctgtgttagtttgctgagaa

SEQ ID NO: 34784 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
agtttgctgagaatgaggct

SEQ ID NO: 34785 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
tatcattgatgggcatttgg

SEQ ID NO: 34786 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
gtgcatgtgtctttataaca

SEQ ID NO: 34787 - DNA, 20 bp, Artificial Sequence
  Description of Artificial Sequence: Synthetic oligonucleotide
  Target: ATXN1; (+) strand; PAM type: NNNNGHTT; PAM sequence: ACGGGATT
ctttgggtatataaccagta

SEQ ID NO: 34788 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
aaactggaagaattctatac

SEQ ID NO: 34789 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
atttaggagctgcaaaggag

SEQ ID NO: 34790 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
gcaaaggagtaaggatttgc

SEQ ID NO: 34791 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
ttagaagttggttagatgag

SEQ ID NO: 34792 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
aagttaactacttctcaaag

SEQ ID NO: 34793 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
ctgacatcttcaaccacatt

SEQ ID NO: 34794 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
ttagaatctatctaaatttg

SEQ ID NO: 34795 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
cttgacagccaatctcttga

SEQ ID NO: 34796 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
tcaagacatttaagagaaaa

SEQ ID NO: 34797 - DNA, 20 bp, Artificial Sequence
  Description of Artificial Sequence: Synthetic oligonucleotide
  Target: ATXN1; (+) strand; PAM type: NNNNGHTT; PAM sequence: GTAGGATT
tttaaacaaattgaaaaaca

SEQ ID NO: 34798 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
tgagaataaaaggcaagtta

SEQ ID NO: 34799 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
ttcccactgaacatttcatt

SEQ ID NO: 34800 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
gaggttcagaaatggagaaa

SEQ ID NO: 34801 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
agaaatggagaaagaaggtt

SEQ ID NO: 34802 - DNA, 20 bp, Artificial Sequence
  Description of Artificial Sequence: Synthetic oligonucleotide
  Target: ATXN1; (+) strand; PAM type: NNNNGHTT; PAM sequence: TATTGATT
ttattgctttgaatgcagaa

SEQ ID NO: 34803 - DNA, 20 bp, Artificial Sequence
  Description of Artificial Sequence: Synthetic oligonucleotide
  Target: ATXN1; (+) strand; PAM type: NNNNGHTT; PAM sequence: TTATGATT
tcaccaactataataatttt

SEQ ID NO: 34804 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
tgattcctcattgccaacag

SEQ ID NO: 34805 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
ccaacagcaatgattttcaa

SEQ ID NO: 34806 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
aattgaggctacttacacta

SEQ ID NO: 34807 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
acatggcctatgagaccctc

SEQ ID NO: 34808 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
tccctgcacacactgcacca

SEQ ID NO: 34809 - DNA, 20 bp, Artificial Sequence
  Description of Artificial Sequence: Synthetic oligonucleotide
  Target: ATXN1; (+) strand; PAM type: NNNNGHTT; PAM sequence: CTGTGCTT
tgcaccatgctgtttgttcc

SEQ ID NO: 34810 - DNA, 20 bp, Artificial Sequence
  Description of Artificial Sequence: Synthetic oligonucleotide
  Target: ATXN1; (+) strand; PAM type: NNNNGHTT; PAM sequence: TATGGCTT
tggctggtaattattgttca

SEQ ID NO: 34811 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
aaatgtattcatagttatat

SEQ ID NO: 34812 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
aacacagatgttgacctaac

SEQ ID NO: 34813 - DNA, 20 bp, Artificial Sequence
  Description of Artificial Sequence: Synthetic oligonucleotide
  Target: ATXN1; (+) strand; PAM type: NNNNGHTT; PAM sequence: ACTAGCTT
ggtcaatgaaactcctgcct

SEQ ID NO: 34814 - DNA, 20 bp, Artificial Sequence
  Description of Artificial Sequence: Synthetic oligonucleotide
  Target: ATXN1; (+) strand; PAM type: NNNNGHTT; PAM sequence: AGCAGTTT
tactagcttagctactagct

SEQ ID NO: 34815 - DNA, 20 bp, Artificial Sequence
  Description of Artificial Sequence: Synthetic oligonucleotide
  Target: ATXN1; (+) strand; PAM type: NNNNGHTT; PAM sequence: GCCAGCTT
actcgcatgtattgctagga

SEQ ID NO: 34816 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
agccagctttcactcctggg

SEQ ID NO: 34817 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
ctttcactcctgggactggt

SEQ ID NO: 34818 - DNA, 20 bp, Artificial Sequence
  Description of Artificial Sequence: Synthetic oligonucleotide
  Target: ATXN1; (+) strand; PAM type: NNNNGHTT; PAM sequence: CATAGCTT
aacagcctgtatacaacaca

SEQ ID NO: 34819 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
atagcttatatatgacaacc

SEQ ID NO: 34820 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
gaactcaggacttattttat

SEQ ID NO: 34821 - DNA, 20 bp, Artificial Sequence
  Description of Artificial Sequence: Synthetic oligonucleotide
  Target: ATXN1; (+) strand; PAM type: NNNNGHTT; PAM sequence: AATCGTTT
tctatttcatatttgcacag

SEQ ID NO: 34822 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
acagaatcgtttttaatttt

SEQ ID NO: 34823 - DNA, 20 bp, Artificial Sequence
  Description of Artificial Sequence: Synthetic oligonucleotide
  Target: ATXN1; (+) strand; PAM type: NNNNGHTT; PAM sequence: ACGTGCTT
ccagtgttaagctgttcctg

SEQ ID NO: 34824 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
cctcctcctgcaatcagctc

SEQ ID NO: 34825 - DNA, 20 bp, Artificial Sequence
  Description of Artificial Sequence: Synthetic oligonucleotide
  Target: ATXN1; (+) strand; PAM type: NNNNGHTT; PAM sequence: TTTAGCTT
gtttcctttttttttttttt

SEQ ID NO: 34826 - DNA, 20 bp, Artificial Sequence
  Description of Artificial Sequence: Synthetic oligonucleotide
  Target: ATXN1; (+) strand; PAM type: NNNNGHTT; PAM sequence: CCCTGCTT
caaactcagctggacacaat

SEQ ID NO: 34827 - DNA, 20 bp, Artificial Sequence
  Description of Artificial Sequence: Synthetic oligonucleotide
  Target: ATXN1; (+) strand; PAM type: NNNNGHTT; PAM sequence: GCAAGCTT
tcaaccttcttcactaacag

SEQ ID NO: 34828 - DNA, 20 bp, Artificial Sequence
  Description of Artificial Sequence: Synthetic oligonucleotide
  Target: ATXN1; (+) strand; PAM type: NNNNGHTT; PAM sequence: ATAAGCTT
gaaagaacgcataaacgcat

SEQ ID NO: 34829 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
atagaaagttaaatacagca

SEQ ID NO: 34830 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
ggccttaataggaacacaag

SEQ ID NO: 34831 - DNA, 20 bp, Artificial Sequence
  Description of Artificial Sequence: Synthetic oligonucleotide
  Target: ATXN1; (+) strand; PAM type: NNNNGHTT; PAM sequence: GACAGTTT
tagcactctcagggagaacc

SEQ ID NO: 34832 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
aaacacttaagtaattttag

SEQ ID NO: 34833 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
agtaaatgagttataaaaac

SEQ ID NO: 34834 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
cataaggaataatcctcttt

SEQ ID NO: 34835 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
gaggcccaggctgagagcat

SEQ ID NO: 34836 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
aactcagaaaatcttggcat

SEQ ID NO: 34837 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
aaatatttctagggtagcac

SEQ ID NO: 34838 - DNA, 20 bp, Artificial Sequence
  Description of Artificial Sequence: Synthetic oligonucleotide
  Target: ATXN1; (+) strand; PAM type: NNNNGHTT; PAM sequence: TGGTGATT
cagaagtttggccttttcgc

SEQ ID NO: 34839 - DNA, 20 bp, Artificial Sequence
  Description of Artificial Sequence: Synthetic oligonucleotide
  Target: ATXN1; (+) strand; PAM type: NNNNGHTT; PAM sequence: CATCGTTT
gggtgacatggagcaggcag

SEQ ID NO: 34840 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
gcaatgagtcaaatgaagaa

SEQ ID NO: 34841 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
taagggaaatggtcattttc

SEQ ID NO: 34842 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
tttctaatgatttttctcta

SEQ ID NO: 34843 - DNA, 20 bp, Artificial Sequence
  Description of Artificial Sequence: Synthetic oligonucleotide
  Target: ATXN1; (+) strand; PAM type: NNNNGHTT; PAM sequence: AATAGTTT
tctctagtatgattttattt

SEQ ID NO: 34844 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gtagttcagaaaagggtaat

SEQ ID NO: 34845 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
gtgaaatgaacattatcatt

SEQ ID NO: 34846 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
ggcaaaatgtggtctagtgg

SEQ ID NO: 34847 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
agtgggcctgattaggaaac

SEQ ID NO: 34848 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
taagggagtaaagggcatgc

SEQ ID NO: 34849 - DNA, 20 bp, Artificial Sequence
  Description of Artificial Sequence: Synthetic oligonucleotide
  Target: ATXN1; (+) strand; PAM type: NNNNGHTT; PAM sequence: GGCTGCTT
tcctccgtgttatatattaa

SEQ ID NO: 34850 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
atcactgtagaagcagatca

SEQ ID NO: 34851 - DNA, 20 bp, Artificial Sequence
  Description of Artificial Sequence: Synthetic oligonucleotide
  Target: ATXN1; (+) strand; PAM type: NNNNGHTT; PAM sequence: GATGGATT
tgctttaagccttagaatat

SEQ ID NO: 34852 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
tcaattactgcatcatatct

SEQ ID NO: 34853 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
ttttcagtaatgcaaaactt

SEQ ID NO: 34854 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
tgtcagccaaactcataaaa

SEQ ID NO: 34855 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
gaaattctctgcactataga

SEQ ID NO: 34856 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
aatgggctcaatcactatat

SEQ ID NO: 34857 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
caatcactatattagtgttt

SEQ ID NO: 34858 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
ccttaatttttgagttctta

SEQ ID NO: 34859 - DNA, 20 bp, Artificial Sequence
  Description of Artificial Sequence: Synthetic oligonucleotide
  Target: ATXN1; (+) strand; PAM type: NNNNGHTT; PAM sequence: GCTAGTTT
ttaaaactaccttgataaat

SEQ ID NO: 34860 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
ccttgataaatgctagtttg

SEQ ID NO: 34861 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
atataacagccacctaacag

SEQ ID NO: 34862 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
cctaacagaactgtttttcc

SEQ ID NO: 34863 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
ctataaataaaaaagcattt

SEQ ID NO: 34864 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
agaaaaacatctcttaataa

SEQ ID NO: 34865 - DNA, 20 bp, Artificial Sequence
  Description of Artificial Sequence: Synthetic oligonucleotide
  Target: ATXN1; (+) strand; PAM type: NNNNGHTT; PAM sequence: GTGGGCTT
tagccatgctcacattaact

SEQ ID NO: 34866 - DNA, 20 bp, Artificial Sequence
  Description of Artificial Sequence: Synthetic oligonucleotide
  Target: ATXN1; (+) strand; PAM type: NNNNGHTT; PAM sequence: TGCGGCTT
cgaatataggaatgggcact

SEQ ID NO: 34867 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
agtagatgaacgtcaagatg

SEQ ID NO: 34868 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
atatattatttaaaatgtct

SEQ ID NO: 34869 - DNA, 20 bp, Artificial Sequence
  Description of Artificial Sequence: Synthetic oligonucleotide
  Target: ATXN1; (+) strand; PAM type: NNNNGHTT; PAM sequence: GATGGTTT
aataatttaagcacaaatct

SEQ ID NO: 34870 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
atagaaatctctaaatcctt

SEQ ID NO: 34871 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
ccaaaaggtggaaacaaccc

SEQ ID NO: 34872 - DNA, 20 bp, Artificial Sequence
  Description of Artificial Sequence: Synthetic oligonucleotide
  Target: ATXN1; (+) strand; PAM type: NNNNGHTT; PAM sequence: GTGTGATT
gtcacaaaaggacaaaccct

SEQ ID NO: 34873 - DNA, 20 bp, Artificial Sequence
  Description of Artificial Sequence: Synthetic oligonucleotide
  Target: ATXN1; (+) strand; PAM type: NNNNGHTT; PAM sequence: TGGTGATT
catagaggcagaaagtagaa

SEQ ID NO: 34874 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
aatttattgtctaatgggta

SEQ ID NO: 34875 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
cattttctatcctgtcaact

SEQ ID NO: 34876 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
acaggtttcttacctggcct

SEQ ID NO: 34877 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
ccagatgaatctttctaaac

SEQ ID NO: 34878 - DNA, 20 bp, Artificial Sequence
  Description of Artificial Sequence: Synthetic oligonucleotide
  Target: ATXN1; (+) strand; PAM type: NNNNGHTT; PAM sequence: TCTCGTTT
actgcagtttcaatcttctt

SEQ ID NO: 34879 - DNA, 20 bp, Artificial Sequence
  Description of Artificial Sequence: Synthetic oligonucleotide
  Target: ATXN1; (+) strand; PAM type: NNNNGHTT; PAM sequence: CTTCGCTT
atctcttgttgctggttcct

SEQ ID NO: 34880 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
ttcgcttcctgaattaagtc

SEQ ID NO: 34881 - DNA, 20 bp, Artificial Sequence
  Description of Artificial Sequence: Synthetic oligonucleotide
  Target: ATXN1; (+) strand; PAM type: NNNNGHTT; PAM sequence: TATGGCTT
gactgtctgacagtctacaa

SEQ ID NO: 34882 - DNA, 20 bp, Artificial Sequence
  Description of Artificial Sequence: Synthetic oligonucleotide
  Target: ATXN1; (+) strand; PAM type: NNNNGHTT; PAM sequence: GCGTGTTT
tctatctttaaccctctgaa

SEQ ID NO: 34883 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
agcgtgtttttacttttata

SEQ ID NO: 34884 - DNA, 20 bp, Artificial Sequence
  Description of Artificial Sequence: Synthetic oligonucleotide
  Target: ATXN1; (+) strand; PAM type: NNNNGHTT; PAM sequence: ATAGGATT
tcctagttccttttcagatc

SEQ ID NO: 34885 - DNA, 20 bp, Artificial Sequence
  Description of Artificial Sequence: Synthetic oligonucleotide
  Target: ATXN1; (+) strand; PAM type: NNNNGHTT; PAM sequence: TATGGCTT
taggatttttgaaaatcaaa

SEQ ID NO: 34886 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
tgcattttaacaatattccc

SEQ ID NO: 34887 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
caaagatcattgtgagtgac

SEQ ID NO: 34888 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
ataaaactagggccaggcac

SEQ ID NO: 34889 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
ttgggaggctaaggtgggag

SEQ ID NO: 34890 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
tggccaaccaaatagatctg

SEQ ID NO: 34891 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
gggaagattttgtcttttta

SEQ ID NO: 34892 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
gggtgggaagtcagcagaaa

SEQ ID NO: 34893 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
ggctgtgaaaatatgtgcat

SEQ ID NO: 34894 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
atatgtgcatcaaagtttta

SEQ ID NO: 34895 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
cacatccagtagacttataa

SEQ ID NO: 34896 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
taatacagattgctacagat

SEQ ID NO: 34897 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
ctacgttctttgaactgtaa

SEQ ID NO: 34898 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
tctttgaactgtaacaaagc

SEQ ID NO: 34899 - DNA, 20 bp, Artificial Sequence
  Description of Artificial Sequence: Synthetic oligonucleotide
  Target: ATXN1; (+) strand; PAM type: NNNNGHTT; PAM sequence: GGGTGCTT
atactcaactactgtaaagt

SEQ ID NO: 34900 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
ggggtggaagctggggaaag

SEQ ID NO: 34901 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
ttaacatgtgaataaaatca

SEQ ID NO: 34902 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
gaataaaatcatcctgattt

SEQ ID NO: 34903 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
atgcatgggaattaatgggg

SEQ ID NO: 34904 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
gaagtatatctaaactcttt

SEQ ID NO: 34905 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
gagccatgctagctccagga

SEQ ID NO: 34906 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
gctccaggactaggattgac

SEQ ID NO: 34907 - DNA, 20 bp, Artificial Sequence
  Description of Artificial Sequence: Synthetic oligonucleotide
  Target: ATXN1; (+) strand; PAM type: NNNNGHTT; PAM sequence: GCCCGATT
acatatgtttccttcagggt

SEQ ID NO: 34908 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
cactttgggaagccaaagtg

SEQ ID NO: 34909 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttgggaagccaaagtgagag

SEQ ID NO: 34910 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
aacttccaaaaacttctcca

SEQ ID NO: 34911 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
ttctgaggagaatgagcggg

SEQ ID NO: 34912 - DNA, 20 bp, Artificial Sequence
  Description of Artificial Sequence: Synthetic oligonucleotide
  Target: ATXN1; (+) strand; PAM type: NNNNGHTT; PAM sequence: GGTAGCTT
tgccacgaggtggccttcca

SEQ ID NO: 34913 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
cgaggtggccttccaggtag

SEQ ID NO: 34914 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
agcttggcttccttctgcac

SEQ ID NO: 34915 - DNA, 20 bp, Artificial Sequence
  Description of Artificial Sequence: Synthetic oligonucleotide
  Target: ATXN1; (+) strand; PAM type: NNNNGHTT; PAM sequence: AAAGGCTT
ctgccaccacggcagatatg

SEQ ID NO: 34916 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
agatatgaaaggctttacca

SEQ ID NO: 34917 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
cttcttcctcagaaagcacc

SEQ ID NO: 34918 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
acagaagacacaatttgctc

SEQ ID NO: 34919 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
aattaaaagcaaagtcattg

SEQ ID NO: 34920 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
cccaggacagtgtcagcata

SEQ ID NO: 34921 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
attctcttttaaagataaag

SEQ ID NO: 34922 - DNA, 20 bp, Artificial Sequence
  Description of Artificial Sequence: Synthetic oligonucleotide
  Target: ATXN1; (+) strand; PAM type: NNNNGHTT; PAM sequence: GTCTGCTT
aatatatagcaggctctgtg

SEQ ID NO: 34923 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
ctttttctaaaagttctgcc

SEQ ID NO: 34924 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
ctttaaaagagagacaggag

SEQ ID NO: 34925 - DNA, 20 bp, Artificial Sequence
  Description of Artificial Sequence: Synthetic oligonucleotide
  Target: ATXN1; (+) strand; PAM type: NNNNGHTT; PAM sequence: TCACGTTT
atcatgtgtccttcttgcac

SEQ ID NO: 34926 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
tgggaatcaccattgaaaca

SEQ ID NO: 34927 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
agttcagccaacggctagga

SEQ ID NO: 34928 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
gacatattaaaaacccagca

SEQ ID NO: 34929 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
atatacaacagggcagagat

SEQ ID NO: 34930 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
atggaaagtgatcaaaagcc

SEQ ID NO: 34931 - DNA, 20 bp, Artificial Sequence
  Description of Artificial Sequence: Synthetic oligonucleotide
  Target: ATXN1; (+) strand; PAM type: NNNNGHTT; PAM sequence: TCGTGCTT
tagctgactctgaagcctgc

SEQ ID NO: 34932 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
actctgaagcctgctcgtgc

SEQ ID NO: 34933 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
caaaagaatatagatatcac

SEQ ID NO: 34934 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tagatatcactggagattct

SEQ ID NO: 34935 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
tctctaggactagcaagaaa

SEQ ID NO: 34936 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
acaatacattacaatctata

SEQ ID NO: 34937 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
atctataaatagcttaggct

SEQ ID NO: 34938 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
gcacctcccccggaaaagat

SEQ ID NO: 34939 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
caagtggggtcctatgcctt

SEQ ID NO: 34940 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
agggagggagacagtgactt

SEQ ID NO: 34941 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
tctagcctaaatgcagggga

SEQ ID NO: 34942 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
ccagggagctcaggagctca

SEQ ID NO: 34943 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
atgcctcctctcgcccatca

SEQ ID NO: 34944 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
cgcaatgtgcagtagccttg

SEQ ID NO: 34945 - DNA, 20 bp, Artificial Sequence
  Description of Artificial Sequence: Synthetic oligonucleotide
  Target: ATXN1; (+) strand; PAM type: NNNNGHTT; PAM sequence: GTCAGCTT
aagaaaaacaaaaaaagact

SEQ ID NO: 34946 - DNA, 20 bp, Artificial Sequence
  Description of Artificial Sequence: Synthetic oligonucleotide
  Target: ATXN1; (+) strand; PAM type: NNNNGHTT; PAM sequence: TTCCGTTT
ctagactcagcaaccacaca

SEQ ID NO: 34947 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
tggagatgaaatttcagcct

SEQ ID NO: 34948 - DNA, 20 bp, Artificial Sequence
  Description of Artificial Sequence: Synthetic oligonucleotide
  Target: ATXN1; (+) strand; PAM type: NNNNGHTT; PAM sequence: TGCTGATT
tttcagcctggcagttttgc

SEQ ID NO: 34949 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
ctggcagttttgctgctgat

SEQ ID NO: 34950 - DNA, 20 bp, Artificial Sequence
  Description of Artificial Sequence: Synthetic oligonucleotide
  Target: ATXN1; (+) strand; PAM type: NNNNGHTT; PAM sequence: CATTGTTT
atctctgactccattccttt

SEQ ID NO: 34951 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
ttgtttctaatacccagttg

SEQ ID NO: 34952 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
ggactcagtcctcctcgcag

SEQ ID NO: 34953 - DNA, 20 bp, Artificial Sequence
  Description of Artificial Sequence: Synthetic oligonucleotide
  Target: ATXN1; (+) strand; PAM type: NNNNGHTT; PAM sequence: CGGAGCTT
tctccgtgttgagtcctaca

SEQ ID NO: 34954 - DNA, 20 bp, Artificial Sequence
  Description of Artificial Sequence: Synthetic oligonucleotide
  Target: ATXN1; (+) strand; PAM type: NNNNGHTT; PAM sequence: GTTAGATT
gcttcccacttactttacat

SEQ ID NO: 34955 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
ttactttacatgttagattg

SEQ ID NO: 34956 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
acaggttaactttgccttaa

SEQ ID NO: 34957 - DNA, 20 bp, Artificial Sequence
  Description of Artificial Sequence: Synthetic oligonucleotide
  Target: ATXN1; (+) strand; PAM type: NNNNGHTT; PAM sequence: CGGGGCTT
aaggccaatgtctggcaggc

SEQ ID NO: 34958 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
tggcaggccggggctttagc

SEQ ID NO: 34959 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
aagtttagccacctgctaaa

SEQ ID NO: 34960 - DNA, 20 bp, Artificial Sequence
  Description of Artificial Sequence: Synthetic oligonucleotide
  Target: ATXN1; (+) strand; PAM type: NNNNGHTT; PAM sequence: TTATGATT
agtttaatttgcccgtgtcc

SEQ ID NO: 34961 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
cagatctgactgttccaagc

SEQ ID NO: 34962 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
gttatacaaaaagctaaaag

SEQ ID NO: 34963 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
gacaagtgtcccttctaggc

SEQ ID NO: 34964 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
ttttattttgctaagctact

SEQ ID NO: 34965 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
agggttgacctttctgcaac

SEQ ID NO: 34966 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
tatcctatcctgactaatac

SEQ ID NO: 34967 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
atgtctaacaatgccttgtg

SEQ ID NO: 34968 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
agcctcttgaagacagtgac

SEQ ID NO: 34969 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
gtgaccttggcttgtacttt

SEQ ID NO: 34970 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
ttgtgagcctcgcaagcagt

SEQ ID NO: 34971 - DNA, 20 bp, Artificial Sequence
  Description of Artificial Sequence: Synthetic oligonucleotide
  Target: ATXN1; (+) strand; PAM type: NNNNGHTT; PAM sequence: CCTTGATT
tgaatttatcttagccatgg

SEQ ID NO: 34972 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
ctaatgtctttaggtctatt

SEQ ID NO: 34973 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
gtctatttaatgattttggt

SEQ ID NO: 34974 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
tcattcacacaaatacagta

SEQ ID NO: 34975 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
ccacttgacctcttcatgtc

SEQ ID NO: 34976 - DNA, 20 bp, Artificial Sequence
  Description of Artificial Sequence: Synthetic oligonucleotide
  Target: ATXN1; (+) strand; PAM type: NNNNGHTT; PAM sequence: ACGAGTTT
ccagtttcctttcccacaaa

SEQ ID NO: 34977 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
agcagtactgggcatgttgt

SEQ ID NO: 34978 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
ggcagatattagaggaacaa

SEQ ID NO: 34979 - DNA, 20 bp, Artificial Sequence
  Description of Artificial Sequence: Synthetic oligonucleotide
  Target: ATXN1; (+) strand; PAM type: NNNNGHTT; PAM sequence: CCACGATT
acatacagagcaagaagaga

SEQ ID NO: 34980 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
agaggcatcaaacaacatct

SEQ ID NO: 34981 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
atattgatcaaatgcctcct

SEQ ID NO: 34982 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
aatgcctcctatgtgcttgg

SEQ ID NO: 34983 - DNA, 20 bp, Artificial Sequence
  Description of Artificial Sequence: Synthetic oligonucleotide
  Target: ATXN1; (+) strand; PAM type: NNNNGHTT; PAM sequence: CAAGGCTT
catgcagtccatgagaccga

SEQ ID NO: 34984 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
gtccatgagaccgacaaggc

SEQ ID NO: 34985 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
acgaagaaaacaacaggtaa

SEQ ID NO: 34986 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
aaggaaacgccacgccccac

SEQ ID NO: 34987 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
ccaccccagctttctatggg

SEQ ID NO: 34988 - DNA, 20 bp, Artificial Sequence
  Description of Artificial Sequence: Synthetic oligonucleotide
  Target: ATXN1; (+) strand; PAM type: NNNNGHTT; PAM sequence: CAGGGATT
ataattttgagcagggttag

SEQ ID NO: 34989 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
gaagagaactcttgtaagat

SEQ ID NO: 34990 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
tgggagtgaggtgggaaaaa

SEQ ID NO: 34991 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
cacattaggaaaataatttc

SEQ ID NO: 34992 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
tttaagaggaagaagaagat

SEQ ID NO: 34993 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
atacatgtttcgtatccttg

SEQ ID NO: 34994 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
gagcaatgtcaaatggatgg

SEQ ID NO: 34995 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
tggatggtaaagatttttaa

SEQ ID NO: 34996 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
agttcttacaattctttcat

SEQ ID NO: 34997 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
tgcagcatattaaatgagca

SEQ ID NO: 34998 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
ttaaatgagcactctgtttc

SEQ ID NO: 34999 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
cactggctgtcacagtcatt

SEQ ID NO: 35000 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
agcgctggcaagagcatttc

SEQ ID NO: 35001 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
gagataccattgatggtgag

SEQ ID NO: 35002 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
ccattgatggtgagtgctgt

SEQ ID NO: 35003 - DNA, 20 bp, Artificial Sequence
  Description of Artificial Sequence: Synthetic oligonucleotide
  Target: ATXN1; (+) strand; PAM type: NNNNGHTT; PAM sequence: TCACGTTT
atgaaactgagcccagggac

SEQ ID NO: 35004 - DNA, 20 bp, Artificial Sequence
  Description of Artificial Sequence: Synthetic oligonucleotide
  Target: ATXN1; (+) strand; PAM type: NNNNGHTT; PAM sequence: GCCAGCTT
aggtatatatgcatgtgggg

SEQ ID NO: 35005 - DNA, 20 bp, Artificial Sequence
  Description of Artificial Sequence: Synthetic oligonucleotide
  Target: ATXN1; (+) strand; PAM type: NNNNGHTT; PAM sequence: CTGAGCTT
atgcatgtgggggccagctt

SEQ ID NO: 35006 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
tttttagggagaaaaatact

SEQ ID NO: 35007 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
aaaatactcatggcttctat

SEQ ID NO: 35008 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
actcatggcttctatctgtg

SEQ ID NO: 35009 - DNA, 20 bp, Artificial Sequence
  Description of Artificial Sequence: Synthetic oligonucleotide
  Target: ATXN1; (+) strand; PAM type: NNNNGHTT; PAM sequence: TACGGCTT
atttggtaaaataaaaaaat

SEQ ID NO: 35010 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
cttgcctcagacccttctct

SEQ ID NO: 35011 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
gtgctctgagaataaacttt

SEQ ID NO: 35012 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
tctagttagggaagaagaca

SEQ ID NO: 35013 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
accactccctaggtgagatg

SEQ ID NO: 35014 - DNA, 20 bp, Artificial Sequence
  Description of Artificial Sequence: Synthetic oligonucleotide
  Target: ATXN1; (+) strand; PAM type: NNNNGHTT; PAM sequence: GCCAGATT
ctaaatgaacacaatttgaa

SEQ ID NO: 35015 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
caaacaaaccacacacacag

SEQ ID NO: 35016 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacacagtcaagtttacctt

SEQ ID NO: 35017 - DNA, 20 bp, Artificial Sequence
  Description of Artificial Sequence: Synthetic oligonucleotide
  Target: ATXN1; (+) strand; PAM type: NNNNGHTT; PAM sequence: CGGAGCTT
aatggcgtgaacccgggagg

SEQ ID NO: 35018 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
aacaaataaaataaaagaat

SEQ ID NO: 35019 - DNA, 20 bp, Artificial Sequence
  Description of Artificial Sequence: Synthetic oligonucleotide
  Target: ATXN1; (+) strand; PAM type: NNNNGHTT; PAM sequence: GTCAGATT
tctcaaaagtctctatgaag

SEQ ID NO: 35020 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
caacgtggcattgcagatgc

SEQ ID NO: 35021 - DNA, 20 bp, Artificial Sequence
  Description of Artificial Sequence: Synthetic oligonucleotide
  Target: ATXN1; (+) strand; PAM type: NNNNGHTT; PAM sequence: ATAAGCTT
tggaaagggcgcagaagaaa

SEQ ID NO: 35022 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
cccctttacttagtagccaa

SEQ ID NO: 35023 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
ttgccttaggggtgatcatt

SEQ ID NO: 35024 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
ctacagcctcaaaaagaatc

SEQ ID NO: 35025 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
tgatgtgggtaaaaatacat

SEQ ID NO: 35026 - DNA, 20 bp, Artificial Sequence
  Description of Artificial Sequence: Synthetic oligonucleotide
  Target: ATXN1; (+) strand; PAM type: NNNNGHTT; PAM sequence: CGTCGATT
ctcaccctatgaaaacagca

SEQ ID NO: 35027 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
ttggaaaactggaatagaaa

SEQ ID NO: 35028 - DNA, 20 bp, Artificial Sequence
  Description of Artificial Sequence: Synthetic oligonucleotide
  Target: ATXN1; (+) strand; PAM type: NNNNGHTT; PAM sequence: GCGTGATT
atgtctgaagaacaatagat

SEQ ID NO: 35029 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
gactatatgaattttaaaag

SEQ ID NO: 35030 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
tatgtagagaacaatcacag

SEQ ID NO: 35031 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
catgtcctccatgcccacca

SEQ ID NO: 35032 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
ttttttgtatttttttgaag

SEQ ID NO: 35033 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
cacctcagcctcccaaagtg

SEQ ID NO: 35034 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
cctcccaaagtgttgggatt

SEQ ID NO: 35035 - DNA, 20 bp, Artificial Sequence
  Description of Artificial Sequence: Synthetic oligonucleotide
  Target: ATXN1; (+) strand; PAM type: NNNNGHTT; PAM sequence: CCGTGTTT
gtttgagccatcgtacccag

SEQ ID NO: 35036 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
tttatttttttgagataggg

SEQ ID NO: 35037 - DNA, 20 bp, Artificial Sequence
  Description of Artificial Sequence: Synthetic oligonucleotide
  Target: ATXN1; (+) strand; PAM type: NNNNGHTT; PAM sequence: CCGGGTTT
atagggtcttgctttgttac

SEQ ID NO: 35038 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
tacaggcatgtgccaccaca

SEQ ID NO: 35039 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
accacacctggattaaaatg

SEQ ID NO: 35040 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
tttttctttatttgcggaga

SEQ ID NO: 35041 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
ctttcccaaaatggtatacc

SEQ ID NO: 35042 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
actattttaaagacgccttt

SEQ ID NO: 35043 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
cagctcctgatgttctgtgg

SEQ ID NO: 35044 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
atgttctgtgggcaagtttc

SEQ ID NO: 35045 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
ttcccaggattccagcatct

SEQ ID NO: 35046 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
ttctatgagctgtggaaggc

SEQ ID NO: 35047 - DNA, 20 bp, Artificial Sequence
  Description of Artificial Sequence: Synthetic oligonucleotide
  Target: ATXN1; (+) strand; PAM type: NNNNGHTT; PAM sequence: TAGAGCTT
ggccggccaccagggcagga

SEQ ID NO: 35048 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
ggatggcccaccagcctgca

SEQ ID NO: 35049 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
agtcccacagagcagcccac

SEQ ID NO: 35050 - DNA, 20 bp, Artificial Sequence
  Description of Artificial Sequence: Synthetic oligonucleotide
  Target: ATXN1; (+) strand; PAM type: NNNNGHTT; PAM sequence: CTTCGTTT
gcaaaatctctgagtatctt

SEQ ID NO: 35051 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
cgaattcttgagaccacgaa

SEQ ID NO: 35052 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
ataacaatatcgacttcata

SEQ ID NO: 35053 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
tatcgacttcatagaatgtt

SEQ ID NO: 35054 - DNA, 20 bp, Artificial Sequence
  Description of Artificial Sequence: Synthetic oligonucleotide
  Target: ATXN1; (+) strand; PAM type: NNNNGHTT; PAM sequence: TGGCGCTT
aatgtttctagtttttagtg

SEQ ID NO: 35055 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ttgggaagctgaggcaggaa

SEQ ID NO: 35056 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
tgaggaaaaatctgcacttc

SEQ ID NO: 35057 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
acttcctctgtttgttacag

SEQ ID NO: 35058 - DNA, 20 bp, Artificial Sequence
  Description of Artificial Sequence: Synthetic oligonucleotide
  Target: ATXN1; (+) strand; PAM type: NNNNGHTT; PAM sequence: CTAAGATT
tacagcactgtttacaatag

SEQ ID NO: 35059 - DNA, 20 bp, Artificial Sequence
  Description of Artificial Sequence: Synthetic oligonucleotide
  Target: ATXN1; (+) strand; PAM type: NNNNGHTT; PAM sequence: GTGGGATT
tagcatgttctcacttatct

SEQ ID NO: 35060 - DNA, 20 bp, Artificial Sequence
  Description of Artificial Sequence: Synthetic oligonucleotide
  Target: ATXN1; (+) strand; PAM type: NNNNGHTT; PAM sequence: GAGTGTTT
taaaataaagagtataactg

SEQ ID NO: 35061 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
gagtgtttgttgtaatggat

SEQ ID NO: 35062 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
tggataccccattcttcatg

SEQ ID NO: 35063 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
acagagtctaccaaagtgtc

SEQ ID NO: 35064 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
ttctttttcttctacatttt

SEQ ID NO: 35065 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
aaaaagccttaacagcaaaa

SEQ ID NO: 35066 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
ccttaacagcaaaaagttgt

SEQ ID NO: 35067 - DNA, 20 bp, Artificial Sequence
  Description of Artificial Sequence: Synthetic oligonucleotide
  Target: ATXN1; (+) strand; PAM type: NNNNGHTT; PAM sequence: GGTGGATT
cactttgggaggccaaggcg

SEQ ID NO: 35068 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
actaaaaatacaaaaattag

SEQ ID NO: 35069 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
gtctgaagtcaagcaaatgt

SEQ ID NO: 35070 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
gttccttctcaaagagaatg

SEQ ID NO: 35071 - DNA, 20 bp, Artificial Sequence
  Description of Artificial Sequence: Synthetic oligonucleotide
  Target: ATXN1; (+) strand; PAM type: NNNNGHTT; PAM sequence: ATAGGATT
gtttggtaaaaatatatgtg

SEQ ID NO: 35072 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
ccttacaacaaatgctccct

SEQ ID NO: 35073 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
gtacaattcaggacctggtg

SEQ ID NO: 35074 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
caatgcacttcttataggga

SEQ ID NO: 35075 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
acttcttatagggacagagt

SEQ ID NO: 35076 - DNA, 20 bp, Artificial Sequence
  Description of Artificial Sequence: Synthetic oligonucleotide
  Target: ATXN1; (+) strand; PAM type: NNNNGHTT; PAM sequence: CACCGCTT
ttgcccaactctctcgtggt

SEQ ID NO: 35077 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
ggctgtgttgtgtgctatac

SEQ ID NO: 35078 - DNA, 20 bp, Artificial Sequence
  Description of Artificial Sequence: Synthetic oligonucleotide
  Target: ATXN1; (+) strand; PAM type: NNNNGHTT; PAM sequence: CATTGCTT
aagaaaaacactaaatcata

SEQ ID NO: 35079 - DNA, 20 bp, Artificial Sequence
  Description of Artificial Sequence: Synthetic oligonucleotide
  Target: ATXN1; (+) strand; PAM type: NNNNGHTT; PAM sequence: TGCGGTTT
cagatctagccataaaacca

SEQ ID NO: 35080 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
ctagccataaaaccatgcgg

SEQ ID NO: 35081 - DNA, 20 bp, Artificial Sequence
  Description of Artificial Sequence: Synthetic oligonucleotide
  Target: ATXN1; (+) strand; PAM type: NNNNGHTT; PAM sequence: ATAGGTTT
cctgacaaaatctctgtaaa

SEQ ID NO: 35082 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
gtcaccagtaagtgacaaag

SEQ ID NO: 35083 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
agtgacaaagctaggtttgt

SEQ ID NO: 35084 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
agctccctggcaacatgcac

SEQ ID NO: 35085 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ttgggaggctgaggcaggag

SEQ ID NO: 35086 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
aaaaaaaaaaaaatctttgt

SEQ ID NO: 35087 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
aaaaaatctttgtcagggtt

SEQ ID NO: 35088 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
ctaacaattactttgcatca

SEQ ID NO: 35089 - DNA, 20 bp, Artificial Sequence
  Description of Artificial Sequence: Synthetic oligonucleotide
  Target: ATXN1; (+) strand; PAM type: NNNNGHTT; PAM sequence: GGCAGATT
tactttagttatcaaagtgt

SEQ ID NO: 35090 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
cagagtagatacatattatt

SEQ ID NO: 35091 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
taaattgagttaggacttaa

SEQ ID NO: 35092 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
ttgtgacccagctctgatag

SEQ ID NO: 35093 - DNA, 20 bp, Artificial Sequence
  Description of Artificial Sequence: Synthetic oligonucleotide
  Target: ATXN1; (+) strand; PAM type: NNNNGHTT; PAM sequence: GCATGCTT
cagagaatcataaataaaag

SEQ ID NO: 35094 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
aaatttgtctaaaattgaaa

SEQ ID NO: 35095 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
caaagctctattttcaacat

SEQ ID NO: 35096 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
ggggcagagagtattttgag

SEQ ID NO: 35097 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
aaccagatccagaagagaaa

SEQ ID NO: 35098 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
aaaagtaaagaaaagggcct

SEQ ID NO: 35099 - DNA, 20 bp, Artificial Sequence
  Description of Artificial Sequence: Synthetic oligonucleotide
  Target: ATXN1; (+) strand; PAM type: NNNNGHTT; PAM sequence: GTACGATT
ctcaaaaagttagtgaagca

SEQ ID NO: 35100 - DNA, 20 bp, Artificial Sequence
  Description of Artificial Sequence: Synthetic oligonucleotide
  Target: ATXN1; (+) strand; PAM type: NNNNGHTT; PAM sequence: AGCAGATT
ggagcaaaaggtaacctctt

SEQ ID NO: 35101 - DNA, 20 bp, Artificial Sequence
  Description of Artificial Sequence: Synthetic oligonucleotide
  Target: ATXN1; (+) strand; PAM type: NNNNGHTT; PAM sequence: CATCGTTT
actgtacaaaacgactaccc

SEQ ID NO: 35102 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
ggaaaaataactaatggtta

SEQ ID NO: 35103 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
gtaaaacaaacccccatgac

SEQ ID NO: 35104 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
catccacacatagaagtcaa

SEQ ID NO: 35105 - DNA, 20 bp, Artificial Sequence
  Description of Artificial Sequence: Synthetic oligonucleotide
  Target: ATXN1; (+) strand; PAM type: NNNNGHTT; PAM sequence: TTATGATT
acatagaagtcaatcaggtt

SEQ ID NO: 35106 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
gcatttctttcccattatct

SEQ ID NO: 35107 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
ttatacataattttttaagt

SEQ ID NO: 35108 - DNA, 20 bp, Artificial Sequence
  Description of Artificial Sequence: Synthetic oligonucleotide
  Target: ATXN1; (+) strand; PAM type: NNNNGHTT; PAM sequence: ATAAGTTT
taagtcctctaacagctagc

SEQ ID NO: 35109 - DNA, 20 bp, Artificial Sequence
  Description of Artificial Sequence: Synthetic oligonucleotide
  Target: ATXN1; (+) strand; PAM type: NNNNGHTT; PAM sequence: CTACGTTT
ggcagcaagttgcctgtggt

SEQ ID NO: 35110 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
aaagatcagagctacttcac

SEQ ID NO: 35111 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
atcacagaggaaaggcagaa

SEQ ID NO: 35112 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
tcaggaggctgaggcaggag

SEQ ID NO: 35113 - DNA, 20 bp, Artificial Sequence
  Description of Artificial Sequence: Synthetic oligonucleotide
  Target: ATXN1; (+) strand; PAM type: NNNNGHTT; PAM sequence: ATAAGCTT
aaaacagtaatatctactac

SEQ ID NO: 35114 - DNA, 20 bp, Artificial Sequence
  Description of Artificial Sequence: Synthetic oligonucleotide
  Target: ATXN1; (+) strand; PAM type: NNNNGHTT; PAM sequence: TATTGTTT
aatatctactacataagctt

SEQ ID NO: 35115 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
gctttattgttttcaaagtg

SEQ ID NO: 35116 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
tctataaaggaccagggagc

SEQ ID NO: 35117 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
gggtgatatttggcccatgg

SEQ ID NO: 35118 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
aacttccttcctttcctcta

SEQ ID NO: 35119 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
gcaaatctgagaattccagg

SEQ ID NO: 35120 - DNA, 20 bp, Artificial Sequence
  Description of Artificial Sequence: Synthetic oligonucleotide
  Target: ATXN1; (+) strand; PAM type: NNNNGHTT; PAM sequence: CCTTGATT
gcaacaacaaaaaacaaata

SEQ ID NO: 35121 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
tttcactcacattaagatgg

SEQ ID NO: 35122 - DNA, 20 bp, Artificial Sequence
  Description of Artificial Sequence: Synthetic oligonucleotide
  Target: ATXN1; (+) strand; PAM type: NNNNGHTT; PAM sequence: ACATGATT
caaaaaatttaaaaaatact

SEQ ID NO: 35123 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
ttattcagccctaaagagga

SEQ ID NO: 35124 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
cacatgctacaacatggata

SEQ ID NO: 35125 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
gctacaacatggatatgcag

SEQ ID NO: 35126 - DNA, 20 bp, Artificial Sequence
  Description of Artificial Sequence: Synthetic oligonucleotide
  Target: ATXN1; (+) strand; PAM type: NNNNGHTT; PAM sequence: GGGAGCTT
gtgatcacttgaccttataa

SEQ ID NO: 35127 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
ataagggagcttttcaggtg

SEQ ID NO: 35128 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
gtttggatcaagatatccca

SEQ ID NO: 35129 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
gagagttgaaacttgagagg

SEQ ID NO: 35130 - DNA, 20 bp, Artificial Sequence
  Description of Artificial Sequence: Synthetic oligonucleotide
  Target: ATXN1; (+) strand; PAM type: NNNNGHTT; PAM sequence: CCTCGTTT
aggcagctgatgaactgtga

SEQ ID NO: 35131 - DNA, 20 bp, Artificial Sequence
  Description of Artificial Sequence: Synthetic oligonucleotide
  Target: ATXN1; (+) strand; PAM type: NNNNGHTT; PAM sequence: ATCGGCTT
tcgtttgagtgttccaggaa

SEQ ID NO: 35132 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
aaaaaagaatgtgagagctc

SEQ ID NO: 35133 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
gattcagagtgagctctcac

SEQ ID NO: 35134 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
tgagatttgtaatatggcca

SEQ ID NO: 35135 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
aatgcttgcaatatcctttt

SEQ ID NO: 35136 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
ttctccttcgtcacgcatat

SEQ ID NO: 35137 - DNA, 20 bp, Artificial Sequence
  Description of Artificial Sequence: Synthetic oligonucleotide
  Target: ATXN1; (+) strand; PAM type: NNNNGHTT; PAM sequence: ACTCGTTT
catataactgcttttaggtg

SEQ ID NO: 35138 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
ctatttgcatagcactattc

SEQ ID NO: 35139 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
caagcagaataacgttgagt

SEQ ID NO: 35140 - DNA, 20 bp, Artificial Sequence
  Description of Artificial Sequence: Synthetic oligonucleotide
  Target: ATXN1; (+) strand; PAM type: NNNNGHTT; PAM sequence: TATCGTTT
tctcagctgaaagaaaatga

SEQ ID NO: 35141 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
atgactaccttcaggtgaca

SEQ ID NO: 35142 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
aataaagtagaaggctgggt

SEQ ID NO: 35143 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
caaaaaattttctgaccgtt

SEQ ID NO: 35144 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
ttaaccaatatgcagtaaaa

SEQ ID NO: 35145 - DNA, 20 bp, Artificial Sequence
  Description of Artificial Sequence: Synthetic oligonucleotide
  Target: ATXN1; (+) strand; PAM type: NNNNGHTT; PAM sequence: GACAGTTT
ctctactgtaaccatttttt

SEQ ID NO: 35146 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
gaagccagtggtgtgtgcag

SEQ ID NO: 35147 - DNA, 20 bp, Artificial Sequence
  Description of Artificial Sequence: Synthetic oligonucleotide
  Target: ATXN1; (+) strand; PAM type: NNNNGHTT; PAM sequence: TTCGGCTT
aagcaaagtccttcattatt

SEQ ID NO: 35148 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
atctgttcccacttccatgt

SEQ ID NO: 35149 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
cctaagtctgctcttgtata

SEQ ID NO: 35150 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
gtcgcaccagcccttctgta

SEQ ID NO: 35151 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
ttctctgttactgtcctgtc

SEQ ID NO: 35152 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
aagcacagcaccaagtctga

SEQ ID NO: 35153 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
actaaagtcaatctgtagca

SEQ ID NO: 35154 - DNA, 20 bp, Artificial Sequence
  Description of Artificial Sequence: Synthetic oligonucleotide
  Target: ATXN1; (+) strand; PAM type: NNNNGHTT; PAM sequence: GGCTGATT
ccaggggtctttggagaaat

SEQ ID NO: 35155 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
aacaaaataaacaacatagt

SEQ ID NO: 35156 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
tttgtggactgtccctcaat

SEQ ID NO: 35157 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
agggtggatcacttgagccc

SEQ ID NO: 35158 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
ctactcagggggctaagatg

SEQ ID NO: 35159 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
tcagggggctaagatgggag

SEQ ID NO: 35160 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
gaactaaagccaatatttta

SEQ ID NO: 35161 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
gatggactgcaggatggaca

SEQ ID NO: 35162 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
ttatttgcaaaatctaggtg

SEQ ID NO: 35163 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
acaattcttacaatttactt

SEQ ID NO: 35164 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
acaactctgcccagtcatag

SEQ ID NO: 35165 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
gtcatagaagagtttcccag

SEQ ID NO: 35166 - DNA, 20 bp, Artificial Sequence
  Description of Artificial Sequence: Synthetic oligonucleotide
  Target: ATXN1; (+) strand; PAM type: NNNNGHTT; PAM sequence: TTAGGCTT
gacatctcatttaacaaaaa

SEQ ID NO: 35167 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
tcatttaacaaaaattaggc

SEQ ID NO: 35168 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
ttaaataatagacaaaaggc

SEQ ID NO: 35169 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
gatatgagctctagactctg

SEQ ID NO: 35170 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
atggaccctccaatcatttt

SEQ ID NO: 35171 - DNA, 20 bp, Artificial Sequence
  Description of Artificial Sequence: Synthetic oligonucleotide
  Target: ATXN1; (+) strand; PAM type: NNNNGHTT; PAM sequence: GATGGATT
ccaatcatttttgtggcttg

SEQ ID NO: 35172 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
tcttttttttttttttgata

SEQ ID NO: 35173 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
tcttgaaataggagttaatt

SEQ ID NO: 35174 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
atttaaggaaaacgtacctc

SEQ ID NO: 35175 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
gtacctcttgtgattcaaac

SEQ ID NO: 35176 - DNA, 20 bp, Artificial Sequence
  Description of Artificial Sequence: Synthetic oligonucleotide
  Target: ATXN1; (+) strand; PAM type: NNNNGHTT; PAM sequence: CGATGCTT
catcaaccgtccctgaattc

SEQ ID NO: 35177 - DNA, 20 bp, Artificial Sequence
  Description of Artificial Sequence: Synthetic oligonucleotide
  Target: ATXN1; (+) strand; PAM type: NNNNGHTT; PAM sequence: ATGGGCTT
cctgaggtcaagagttcaag

SEQ ID NO: 35178 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tcggcaggctggggcaggag

SEQ ID NO: 35179 - DNA, 20 bp, Artificial Sequence
  Description of Artificial Sequence: Synthetic oligonucleotide
  Target: ATXN1; (+) strand; PAM type: NNNNGHTT; PAM sequence: CTTCGATT
atgatacaggcaaaaacaga

SEQ ID NO: 35180 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
tgggcggatcacctgaggtc

SEQ ID NO: 35181 - DNA, 20 bp, Artificial Sequence
  Description of Artificial Sequence: Synthetic oligonucleotide
  Target: ATXN1; (+) strand; PAM type: NNNNGHTT; PAM sequence: GTCAGCTT
ggagaatcacttaaacccag

SEQ ID NO: 35182 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
ggtcagcttgctggcaactt

SEQ ID NO: 35183 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
caccggggcagagccaatat

SEQ ID NO: 35184 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
ttgggcaaatcacttaacct

SEQ ID NO: 35185 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
aatttacataacaaaagttg

SEQ ID NO: 35186 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
agcacttagagcagtattat

SEQ ID NO: 35187 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
cttagagcagtattataggt

SEQ ID NO: 35188 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
acaaagagctgactgttatt

SEQ ID NO: 35189 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ttttatttttttaatctttt

SEQ ID NO: 35190 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
tttttgtttttaattatact

SEQ ID NO: 35191 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
agggtacatgtgcacaacat

SEQ ID NO: 35192 - DNA, 20 bp, Artificial Sequence
  Description of Artificial Sequence: Synthetic oligonucleotide
  Target: ATXN1; (+) strand; PAM type: NNNNGHTT; PAM sequence: GGGTGTTT
cacctatgagtgagaacatg

SEQ ID NO: 35193 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
atgagtgagaacatggggtg

SEQ ID NO: 35194 - DNA, 20 bp, Artificial Sequence
  Description of Artificial Sequence: Synthetic oligonucleotide
  Target: ATXN1; (+) strand; PAM type: NNNNGHTT; PAM sequence: TTGCGATT
gggtgtttggttttttgtcc

SEQ ID NO: 35195 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
agccaccacacctggctaat

SEQ ID NO: 35196 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
tcttgttttttcagtagaga

SEQ ID NO: 35197 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcggcctcccaaagtg

SEQ ID NO: 35198 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
aacagcagggatgctggcag

SEQ ID NO: 35199 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
tcacagggctaatgtgttga

SEQ ID NO: 35200 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
atccagcttaaatgtatagc

SEQ ID NO: 35201 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
tccacttttcattttataac

SEQ ID NO: 35202 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
ataacaagggtttttttgca

SEQ ID NO: 35203 - DNA, 20 bp, Artificial Sequence
  Description of Artificial Sequence: Synthetic oligonucleotide
  Target: ATXN1; (+) strand; PAM type: NNNNGHTT; PAM sequence: TGACGCTT
tttgcatgcagattttatca

SEQ ID NO: 35204 - DNA, 20 bp, Artificial Sequence
  Description of Artificial Sequence: Synthetic oligonucleotide
  Target: ATXN1; (+) strand; PAM type: NNNNGHTT; PAM sequence: GCTTGCTT
catgcagattttatcatgac

SEQ ID NO: 35205 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
cacccagatatgggtggcct

SEQ ID NO: 35206 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
ctctcaccaaagggcatgcc

SEQ ID NO: 35207 - DNA, 20 bp, Artificial Sequence
  Description of Artificial Sequence: Synthetic oligonucleotide
  Target: ATXN1; (+) strand; PAM type: NNNNGHTT; PAM sequence: CACCGATT
aaaactattagtcactctca

SEQ ID NO: 35208 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
tataaccagggatccacctc

SEQ ID NO: 35209 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
tcctctctgcaaagcaaagc

SEQ ID NO: 35210 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
tcggaactcttttcttgaca

SEQ ID NO: 35211 - DNA, 20 bp, Artificial Sequence
  Description of Artificial Sequence: Synthetic oligonucleotide
  Target: ATXN1; (+) strand; PAM type: NNNNGHTT; PAM sequence: GAGTGCTT
caccaataataaacattata

SEQ ID NO: 35212 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aacctccgcctcctgggttc

SEQ ID NO: 35213 - DNA, 20 bp, Artificial Sequence
  Description of Artificial Sequence: Synthetic oligonucleotide
  Target: ATXN1; (+) strand; PAM type: NNNNGHTT; PAM sequence: ACGGGTTT
tttttatatttttagtagag

SEQ ID NO: 35214 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcagcctcccagagtg

SEQ ID NO: 35215 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
gcatgagccactgcgcccgg

SEQ ID NO: 35216 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
ttctattattattcccattg

SEQ ID NO: 35217 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
acactgataaatggctgcag

SEQ ID NO: 35218 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
aacagcaatattacataatg

SEQ ID NO: 35219 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
tacataatgttaggtttgtg

SEQ ID NO: 35220 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
gttaggtttgtgttgtgttt

SEQ ID NO: 35221 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
acagtttacaaaatatttgc

SEQ ID NO: 35222 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
tatttgcacatgctttttcc

SEQ ID NO: 35223 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
ggctgagaatatatgactaa

SEQ ID NO: 35224 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
ttgttttgaaataaggaaaa

SEQ ID NO: 35225 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
aaatgacttgtctaaggtca

SEQ ID NO: 35226 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
gagctcatcgtaactaaacc

SEQ ID NO: 35227 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
ctgagggcagcccacagcct

SEQ ID NO: 35228 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
caaagtttatggggagcctc

SEQ ID NO: 35229 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
tctgacccatgggggaaggc

SEQ ID NO: 35230 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
ccatgggggaaggcagagga

SEQ ID NO: 35231 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
ccccagcagagggacctgtt

SEQ ID NO: 35232 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
gagggacctgttcttagctt

SEQ ID NO: 35233 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
ttcccagcttgagcgtctct

SEQ ID NO: 35234 - DNA, 20 bp, Artificial Sequence
  Description of Artificial Sequence: Synthetic oligonucleotide
  Target: ATXN1; (+) strand; PAM type: NNNNGHTT; PAM sequence: CCTGGTTT
aacagggcaacctctggtga

SEQ ID NO: 35235 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
gaagaagtcaaagtgtgctc

SEQ ID NO: 35236 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
actggacgcctttgagaaat

SEQ ID NO: 35237 - DNA, 20 bp, Artificial Sequence
  Description of Artificial Sequence: Synthetic oligonucleotide
  Target: ATXN1; (+) strand; PAM type: NNNNGHTT; PAM sequence: AAGAGCTT
ctgagctagaggaggcctct

SEQ ID NO: 35238 - DNA, 20 bp, Artificial Sequence
  Description of Artificial Sequence: Synthetic oligonucleotide
  Target: ATXN1; (+) strand; PAM type: NNNNGHTT; PAM sequence: TCAGGATT
cgcagtggcacaactaaaac

SEQ ID NO: 35239 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
gccaccaccaagaattactt

SEQ ID NO: 35240 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
gaattacttgaaggcttgtc

SEQ ID NO: 35241 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
aacagaggagggagaagcgc

SEQ ID NO: 35242 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
acaatctgcattcactccag

SEQ ID NO: 35243 - DNA, 20 bp, Artificial Sequence
  Description of Artificial Sequence: Synthetic oligonucleotide
  Target: ATXN1; (+) strand; PAM type: NNNNGHTT; PAM sequence: CTATGCTT
tcttcaaatagcagagagca

SEQ ID NO: 35244 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
atcagcaaacacacggctat

SEQ ID NO: 35245 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
ctctctctagagggaaagta

SEQ ID NO: 35246 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
cccaactacttgggagccca

SEQ ID NO: 35247 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
agtacctttatgtatatcta

SEQ ID NO: 35248 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
ctatacatatacacccatga

SEQ ID NO: 35249 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
atttataaataagtcacagt

SEQ ID NO: 35250 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
tatcttattgcatggcactc

SEQ ID NO: 35251 - DNA, 20 bp, Artificial Sequence
  Description of Artificial Sequence: Synthetic oligonucleotide
  Target: ATXN1; (+) strand; PAM type: NNNNGHTT; PAM sequence: CCACGCTT
ggcactcacctgtttttgta

SEQ ID NO: 35252 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
ctttgggaatgatgggacat

SEQ ID NO: 35253 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
cccatgacaggaaaactgat

SEQ ID NO: 35254 - DNA, 20 bp, Artificial Sequence
  Description of Artificial Sequence: Synthetic oligonucleotide
  Target: ATXN1; (+) strand; PAM type: NNNNGHTT; PAM sequence: ATCGGCTT
attttaaatgaacatccttt

SEQ ID NO: 35255 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
tgaccaattttattcagtaa

SEQ ID NO: 35256 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
aaaaaaaaaaaagagagaga

SEQ ID NO: 35257 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
cctagggctcagaggaattt

SEQ ID NO: 35258 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
tgttttcaagcattactact

SEQ ID NO: 35259 - DNA, 20 bp, Artificial Sequence
  Description of Artificial Sequence: Synthetic oligonucleotide
  Target: ATXN1; (+) strand; PAM type: NNNNGHTT; PAM sequence: TAGAGCTT
gcattactacttgatgcttt

SEQ ID NO: 35260 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
tacttgatgcttttagagct

SEQ ID NO: 35261 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
ttaaaaattaactctaacct

SEQ ID NO: 35262 - DNA, 20 bp, Artificial Sequence
  Description of Artificial Sequence: Synthetic oligonucleotide
  Target: ATXN1; (+) strand; PAM type: NNNNGHTT; PAM sequence: GCTAGATT
actaaagatgctatttgttg

SEQ ID NO: 35263 - DNA, 20 bp, Artificial Sequence
  Description of Artificial Sequence: Synthetic oligonucleotide
  Target: ATXN1; (+) strand; PAM type: NNNNGHTT; PAM sequence: ACTCGATT
ttgtcacttcgaacctaaag

SEQ ID NO: 35264 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
gtcatagctctcctctgcac

SEQ ID NO: 35265 - DNA, 20 bp, Artificial Sequence
  Description of Artificial Sequence: Synthetic oligonucleotide
  Target: ATXN1; (+) strand; PAM type: NNNNGHTT; PAM sequence: CTCCGATT
gtccctcgcatgctccaggt

SEQ ID NO: 35266 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
ggatcacacacaagttgggg

SEQ ID NO: 35267 - DNA, 20 bp, Artificial Sequence
  Description of Artificial Sequence: Synthetic oligonucleotide
  Target: ATXN1; (+) strand; PAM type: NNNNGHTT; PAM sequence: GGGGGCTT
atccttcctaaataactttt

SEQ ID NO: 35268 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
aactccccctaatgacagct

SEQ ID NO: 35269 - DNA, 20 bp, Artificial Sequence
  Description of Artificial Sequence: Synthetic oligonucleotide
  Target: ATXN1; (+) strand; PAM type: NNNNGHTT; PAM sequence: GGGTGCTT
cctacatctgggatgctgtg

SEQ ID NO: 35270 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
gcttgcaacctatagacagc

SEQ ID NO: 35271 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcgttggcgtgttatggca

SEQ ID NO: 35272 - DNA, 20 bp, Artificial Sequence
  Description of Artificial Sequence: Synthetic oligonucleotide
  Target: ATXN1; (+) strand; PAM type: NNNNGHTT; PAM sequence: CCACGATT
aagatgagagctggagtgag

SEQ ID NO: 35273 - DNA, 20 bp, Artificial Sequence
  Description of Artificial Sequence: Synthetic oligonucleotide
  Target: ATXN1; (+) strand; PAM type: NNNNGHTT; PAM sequence: GCAGGCTT
atgtgagcagcagcgaccat

SEQ ID NO: 35274 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
tgcaggctttcctccttgcc

SEQ ID NO: 35275 - DNA, 20 bp, Artificial Sequence
  Description of Artificial Sequence: Synthetic oligonucleotide
  Target: ATXN1; (+) strand; PAM type: NNNNGHTT; PAM sequence: TTTAGCTT
tggaaagtattaccattatt

SEQ ID NO: 35276 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
ttagcttttctaagggaggg

SEQ ID NO: 35277 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
taagactttcaggacagata

SEQ ID NO: 35278 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
tccttaatagatgatcacag

SEQ ID NO: 35279 - DNA, 20 bp, Artificial Sequence
  Description of Artificial Sequence: Synthetic oligonucleotide
  Target: ATXN1; (+) strand; PAM type: NNNNGHTT; PAM sequence: GTGGGATT
gcaaatacgcattccatgtt

SEQ ID NO: 35280 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
tagctgatgaggccactaat

SEQ ID NO: 35281 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
ctaatagaagcttcttggaa

SEQ ID NO: 35282 - DNA, 20 bp, Artificial Sequence
  Description of Artificial Sequence: Synthetic oligonucleotide
  Target: ATXN1; (+) strand; PAM type: NNNNGHTT; PAM sequence: TCACGTTT
ttggaaaagagtttcataat

SEQ ID NO: 35283 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
aaaagagtttcataattcac

SEQ ID NO: 35284 - DNA, 20 bp, Artificial Sequence
  Description of Artificial Sequence: Synthetic oligonucleotide
  Target: ATXN1; (+) strand; PAM type: NNNNGHTT; PAM sequence: GGCAGCTT
taattcacgtttgatttgaa

SEQ ID NO: 35285 - DNA, 20 bp, Artificial Sequence
  Description of Artificial Sequence: Synthetic oligonucleotide
  Target: ATXN1; (+) strand; PAM type: NNNNGHTT; PAM sequence: TCCAGATT
cttacagcgatcatgaatgt

SEQ ID NO: 35286 - DNA, 20 bp, Artificial Sequence
  Description of Artificial Sequence: Synthetic oligonucleotide
  Target: ATXN1; (+) strand; PAM type: NNNNGHTT; PAM sequence: GGAGGTTT
atatgttcaagtagcaaagt

SEQ ID NO: 35287 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
agaacacataacattttgag

SEQ ID NO: 35288 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
ttttttggcaatagaaagta

SEQ ID NO: 35289 - DNA, 20 bp, Artificial Sequence
  Description of Artificial Sequence: Synthetic oligonucleotide
  Target: ATXN1; (+) strand; PAM type: NNNNGHTT; PAM sequence: ATTAGCTT
gctaacaagagaacactgga

SEQ ID NO: 35290 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
gagaacactggaattagctt

SEQ ID NO: 35291 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
agtttcaaaataggacctaa

SEQ ID NO: 35292 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ataggagaagagttgctgca

SEQ ID NO: 35293 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
gcagttgtatgtataattag

SEQ ID NO: 35294 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
caaactggtgagaaatagag

SEQ ID NO: 35295 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
attaggaacagaccaaagca

SEQ ID NO: 35296 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
aggtgtgcattttagaagca

SEQ ID NO: 35297 - DNA, 20 bp, Artificial Sequence
  Description of Artificial Sequence: Synthetic oligonucleotide
  Target: ATXN1; (+) strand; PAM type: NNNNGHTT; PAM sequence: GGCTGATT
catcaacagtgacaaaccat

SEQ ID NO: 35298 - DNA, 20 bp, Artificial Sequence
  Description of Artificial Sequence: Synthetic oligonucleotide
  Target: ATXN1; (+) strand; PAM type: NNNNGHTT; PAM sequence: AGACGTTT
ttgtacttaccactcccttc

SEQ ID NO: 35299 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
agaaaatcctgaattttaat

SEQ ID NO: 35300 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
tgactttcaacttgtaacag

SEQ ID NO: 35301 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
ttatgtttaaggtattttca

SEQ ID NO: 35302 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
gtaaaagctgttagaagcca

SEQ ID NO: 35303 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
accctgagagtattgccacg

SEQ ID NO: 35304 - DNA, 20 bp, Artificial Sequence
  Description of Artificial Sequence: Synthetic oligonucleotide
  Target: ATXN1; (+) strand; PAM type: NNNNGHTT; PAM sequence: GGAAGTTT
ctatttcaacatgctgaaat

SEQ ID NO: 35305 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tggaagtttctatgaaaaac

SEQ ID NO: 35306 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
ggaaaaataagaagcaaata

SEQ ID NO: 35307 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
tgatggcaatgagacaatta

SEQ ID NO: 35308 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
ttctaaaccaaccccaaacc

SEQ ID NO: 35309 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
accaaccccaaaccctgaga

SEQ ID NO: 35310 - DNA, 20 bp, Artificial Sequence
  Description of Artificial Sequence: Synthetic oligonucleotide
  Target: ATXN1; (+) strand; PAM type: NNNNGHTT; PAM sequence: ACCTGCTT
tgagatttggctttcaatgc

SEQ ID NO: 35311 - DNA, 20 bp, Artificial Sequence
  Description of Artificial Sequence: Synthetic oligonucleotide
  Target: ATXN1; (+) strand; PAM type: NNNNGHTT; PAM sequence: GTTAGTTT
tggatggtctacctgcctgt

SEQ ID NO: 35312 - DNA, 20 bp, Artificial Sequence
  Description of Artificial Sequence: Synthetic oligonucleotide
  Target: ATXN1; (+) strand; PAM type: NNNNGHTT; PAM sequence: GGGGGCTT
taacacagtaccacagactg

SEQ ID NO: 35313 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
aatctgttccatgcccctct

SEQ ID NO: 35314 - DNA, 20 bp, Artificial Sequence
  Description of Artificial Sequence: Synthetic oligonucleotide
  Target: ATXN1; (+) strand; PAM type: NNNNGHTT; PAM sequence: GGTGGCTT
atgcccctctcccagcttct

SEQ ID NO: 35315 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
ggtggctttccggatatctt

SEQ ID NO: 35316 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
tccggatatctttggtgttt

SEQ ID NO: 35317 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
gagggaggctatctctgagc

SEQ ID NO: 35318 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
tttacaaggagatgagtcat

SEQ ID NO: 35319 - DNA, 20 bp, Artificial Sequence
  Description of Artificial Sequence: Synthetic oligonucleotide
  Target: ATXN1; (+) strand; PAM type: NNNNGHTT; PAM sequence: GGAGGTTT
gccattgttcatggacactg

SEQ ID NO: 35320 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
gtcaacattttggtggggga

SEQ ID NO: 35321 - DNA, 20 bp, Artificial Sequence
  Description of Artificial Sequence: Synthetic oligonucleotide
  Target: ATXN1; (+) strand; PAM type: NNNNGHTT; PAM sequence: ACGTGATT
gctctgagaaatgcatcttc

SEQ ID NO: 35322 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
ctaggctacatggtacaatg

SEQ ID NO: 35323 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
tatagggcacttcccatgaa

SEQ ID NO: 35324 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
acttcccatgaatggagctt

SEQ ID NO: 35325 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
ttcttcaataataaattaaa

SEQ ID NO: 35326 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
tttcgactcttgtaataata

SEQ ID NO: 35327 - DNA, 20 bp, Artificial Sequence
  Description of Artificial Sequence: Synthetic oligonucleotide
  Target: ATXN1; (+) strand; PAM type: NNNNGHTT; PAM sequence: GGTGGATT
cactttgggaggccgaggcg

SEQ ID NO: 35328 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttgggaggccgaggcgggtg

SEQ ID NO: 35329 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
cgggtggattgcttgaggcc

SEQ ID NO: 35330 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
tcaggaggctgaggcaggag

SEQ ID NO: 35331 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
gaggcagaggttgcagtgag

SEQ ID NO: 35332 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
tatggaaggacctgcctgaa

SEQ ID NO: 35333 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
taagtgcataaaccaataac

SEQ ID NO: 35334 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
ttactaggcgataaaaattc

SEQ ID NO: 35335 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
cgatgccccaggttgtccac

SEQ ID NO: 35336 - DNA, 20 bp, Artificial Sequence
  Description of Artificial Sequence: Synthetic oligonucleotide
  Target: ATXN1; (+) strand; PAM type: NNNNGHTT; PAM sequence: AGCGGCTT
taggcatgctggccaggtgc

SEQ ID NO: 35337 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
gaataacttgaactcaggag

SEQ ID NO: 35338 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
aaaaaaaaagaataggcatg

SEQ ID NO: 35339 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
acacaccctagcaagtggtc

SEQ ID NO: 35340 - DNA, 20 bp, Artificial Sequence
  Description of Artificial Sequence: Synthetic oligonucleotide
  Target: ATXN1; (+) strand; PAM type: NNNNGHTT; PAM sequence: CAAGGCTT
cactggttttacatggatac

SEQ ID NO: 35341 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
tactgttgactatgctcttc

SEQ ID NO: 35342 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
tatagtatgacacagtctgt

SEQ ID NO: 35343 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
agtctgtattagattatcaa

SEQ ID NO: 35344 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
tattagattatcaaaaagga

SEQ ID NO: 35345 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
atggtagcaataatatcacc

SEQ ID NO: 35346 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
atatttgaaaacattttcca

SEQ ID NO: 35347 - DNA, 20 bp, Artificial Sequence
  Description of Artificial Sequence: Synthetic oligonucleotide
  Target: ATXN1; (+) strand; PAM type: NNNNGHTT; PAM sequence: TATGGCTT
catcctaattcaaaaactag

SEQ ID NO: 35348 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
aagccacatgtatttctgtg

SEQ ID NO: 35349 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
ctaggcaagtcatacaagac

SEQ ID NO: 35350 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
cacgatctgaattcatgaaa

SEQ ID NO: 35351 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
agctaatgctaaagaaataa

SEQ ID NO: 35352 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
aggtcttgctgagtaatttg

SEQ ID NO: 35353 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
tgtaaaatctgagggacttc

SEQ ID NO: 35354 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
ctgaagatttccgagcaggg

SEQ ID NO: 35355 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
cattagatgtgtactatgtc

SEQ ID NO: 35356 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
cctctctttccaagatgcag

SEQ ID NO: 35357 - DNA, 20 bp, Artificial Sequence
  Description of Artificial Sequence: Synthetic oligonucleotide
  Target: ATXN1; (+) strand; PAM type: NNNNGHTT; PAM sequence: TGGCGCTT
tctacacagctatcctgctg

SEQ ID NO: 35358 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
tctctacagtccctaatggt

SEQ ID NO: 35359 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
tgctctcaatgacaacccag

SEQ ID NO: 35360 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
tttctattaaaatgtccttc

SEQ ID NO: 35361 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
gcagcaccttcattcacaca

SEQ ID NO: 35362 - DNA, 20 bp, Artificial Sequence
  Description of Artificial Sequence: Synthetic oligonucleotide
  Target: ATXN1; (+) strand; PAM type: NNNNGHTT; PAM sequence: CATAGCTT
tttctcttctcttttctgga

SEQ ID NO: 35363 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
cgggggtgtatcaccttgaa

SEQ ID NO: 35364 - DNA, 20 bp, Artificial Sequence
  Description of Artificial Sequence: Synthetic oligonucleotide
  Target: ATXN1; (+) strand; PAM type: NNNNGHTT; PAM sequence: CTGCGCTT
caatgatgttcagctgcact

SEQ ID NO: 35365 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
gctgcactctgcgcttccac

SEQ ID NO: 35366 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
attaaaacgccagagaacca

SEQ ID NO: 35367 - DNA, 20 bp, Artificial Sequence
  Description of Artificial Sequence: Synthetic oligonucleotide
  Target: ATXN1; (+) strand; PAM type: NNNNGHTT; PAM sequence: TTCCGCTT
tttcggaggtgttgttcaaa

SEQ ID NO: 35368 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
ggacacagcataaagaaaac

SEQ ID NO: 35369 - DNA, 20 bp, Artificial Sequence
  Description of Artificial Sequence: Synthetic oligonucleotide
  Target: ATXN1; (+) strand; PAM type: NNNNGHTT; PAM sequence: TCTAGATT
tgtaatactccatttttcct

SEQ ID NO: 35370 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
gagggtcagttgtcactcca

SEQ ID NO: 35371 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
agtatcttcagaacttagca

SEQ ID NO: 35372 - DNA, 20 bp, Artificial Sequence
  Description of Artificial Sequence: Synthetic oligonucleotide
  Target: ATXN1; (+) strand; PAM type: NNNNGHTT; PAM sequence: GACTGATT
ctcaaaaatatcagttgaca

SEQ ID NO: 35373 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
tcacgcccctaaatgagact

SEQ ID NO: 35374 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
taaatgagactgtgagtttt

SEQ ID NO: 35375 - DNA, 20 bp, Artificial Sequence
  Description of Artificial Sequence: Synthetic oligonucleotide
  Target: ATXN1; (+) strand; PAM type: NNNNGHTT; PAM sequence: TATAGCTT
aatcagaaaccaaaagctat

SEQ ID NO: 35376 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
tcaaaaaatcttaaaatagg

SEQ ID NO: 35377 - DNA, 20 bp, Artificial Sequence
  Description of Artificial Sequence: Synthetic oligonucleotide
  Target: ATXN1; (+) strand; PAM type: NNNNGHTT; PAM sequence: AGTAGATT
tacttgcaccataaattgta

SEQ ID NO: 35378 - DNA, 20 bp, Artificial Sequence
  Description of Artificial Sequence: Synthetic oligonucleotide
  Target: ATXN1; (+) strand; PAM type: NNNNGHTT; PAM sequence: AATCGTTT
atgtctatgccacaacacac

SEQ ID NO: 35379 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
taatctactaatggtataac

SEQ ID NO: 35380 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
acttttgttcaaggccatca

SEQ ID NO: 35381 - DNA, 20 bp, Artificial Sequence
  Description of Artificial Sequence: Synthetic oligonucleotide
  Target: ATXN1; (+) strand; PAM type: NNNNGHTT; PAM sequence: ATGCGTTT
gttttccctaaaaatctact

SEQ ID NO: 35382 - DNA, 20 bp, Artificial Sequence
  Description of Artificial Sequence: Synthetic oligonucleotide
  Target: ATXN1; (+) strand; PAM type: NNNNGHTT; PAM sequence: CTAAGATT
actatgcgtttagccctgtg

SEQ ID NO: 35383 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
gaaatgctgtccctcatgtc

SEQ ID NO: 35384 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
agcttttttattttttgaga

SEQ ID NO: 35385 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
gctcactgcaacctccagct

SEQ ID NO: 35386 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
tgcctcagcctcctgagtag

SEQ ID NO: 35387 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 35388 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcagcgtcccaaagtg

SEQ ID NO: 35389 - DNA, 20 bp, Artificial Sequence
  Description of Artificial Sequence: Synthetic oligonucleotide
  Target: ATXN1; (+) strand; PAM type: NNNNGHTT; PAM sequence: TAGGGTTT
ttttgtatttttagtagaga

SEQ ID NO: 35390 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
cgcctcagcctcccaaagtg

SEQ ID NO: 35391 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
ccatgctctactacagttcc

SEQ ID NO: 35392 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
tactacagttccctgggttt

SEQ ID NO: 35393 - DNA, 20 bp, Artificial Sequence
  Description of Artificial Sequence: Synthetic oligonucleotide
  Target: ATXN1; (+) strand; PAM type: NNNNGHTT; PAM sequence: CTATGCTT
cctttgaaaatgctgccctt

SEQ ID NO: 35394 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
cttagaagcacttcccaaga

SEQ ID NO: 35395 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
gcacttcccaagaacatgct

SEQ ID NO: 35396 - DNA, 20 bp, Artificial Sequence
  Description of Artificial Sequence: Synthetic oligonucleotide
  Target: ATXN1; (+) strand; PAM type: NNNNGHTT; PAM sequence: CCTTGCTT
gatgtgatactctttccatc

SEQ ID NO: 35397 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
aactaggctcagaaaagttc

SEQ ID NO: 35398 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
gttcacacagccagtgagct

SEQ ID NO: 35399 - DNA, 20 bp, Artificial Sequence
  Description of Artificial Sequence: Synthetic oligonucleotide
  Target: ATXN1; (+) strand; PAM type: NNNNGHTT; PAM sequence: GTTGGCTT
cttttggctctgaggccctg

SEQ ID NO: 35400 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
aatcggaaaatcacataaaa

SEQ ID NO: 35401 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
ggtggccacattgttctgca

SEQ ID NO: 35402 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
tctgcagtctgtttgccttc

SEQ ID NO: 35403 - DNA, 20 bp, Artificial Sequence
  Description of Artificial Sequence: Synthetic oligonucleotide
  Target: ATXN1; (+) strand; PAM type: NNNNGHTT; PAM sequence: ATCAGTTT
tgtcccaagcaacaggacgc

SEQ ID NO: 35404 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
atggagtcagcctaaactcc

SEQ ID NO: 35405 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
acacactaactctgtatgtt

SEQ ID NO: 35406 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
aagcctcaattgttactgtc

SEQ ID NO: 35407 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tcaattgttactgtcttttg

SEQ ID NO: 35408 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
tatttattactagagtaatg

SEQ ID NO: 35409 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
gttagctcataaaatacctc

SEQ ID NO: 35410 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
ctcataaaatacctctctag

SEQ ID NO: 35411 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
caaaaagaatcaacatataa

SEQ ID NO: 35412 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
ataggcattctttttcctct

SEQ ID NO: 35413 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
tggaactctgtattattatc

SEQ ID NO: 35414 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
ttatcattttggttgacaat

SEQ ID NO: 35415 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
aaaaaactaccctagtaata

SEQ ID NO: 35416 - DNA, 20 bp, Artificial Sequence
  Description of Artificial Sequence: Synthetic oligonucleotide
  Target: ATXN1; (+) strand; PAM type: NNNNGHTT; PAM sequence: TCTCGTTT
gaaaatgaggtatactttta

SEQ ID NO: 35417 - DNA, 20 bp, Artificial Sequence
  Description of Artificial Sequence: Synthetic oligonucleotide
  Target: ATXN1; (+) strand; PAM type: NNNNGHTT; PAM sequence: TATAGCTT
aagcctttactacatattcc

SEQ ID NO: 35418 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
gttggcaaaagaaaaatagc

SEQ ID NO: 35419 - DNA, 20 bp, Artificial Sequence
  Description of Artificial Sequence: Synthetic oligonucleotide
  Target: ATXN1; (+) strand; PAM type: NNNNGHTT; PAM sequence: GTCAGATT
acctttctgcaaataattcc

SEQ ID NO: 35420 - DNA, 20 bp, Artificial Sequence
  Description of Artificial Sequence: Synthetic oligonucleotide
  Target: ATXN1; (+) strand; PAM type: NNNNGHTT; PAM sequence: AAACGTTT
cgtcagattcagcatttcca

SEQ ID NO: 35421 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tggggaggctaaggcacaag

SEQ ID NO: 35422 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
atcgcttgaacctgggagcc

SEQ ID NO: 35423 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gagccagaggtttcagtgag

SEQ ID NO: 35424 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
aaaataaatcccaaggtgac

SEQ ID NO: 35425 - DNA, 20 bp, Artificial Sequence
  Description of Artificial Sequence: Synthetic oligonucleotide
  Target: ATXN1; (+) strand; PAM type: NNNNGHTT; PAM sequence: CATAGATT
gcaaatccatagagataaaa

SEQ ID NO: 35426 - DNA, 20 bp, Artificial Sequence
  Description of Artificial Sequence: Synthetic oligonucleotide
  Target: ATXN1; (+) strand; PAM type: NNNNGHTT; PAM sequence: GGGTGCTT
ggtagaggaaatgggggagt

SEQ ID NO: 35427 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
ggagtgggtgcttaatgggt

SEQ ID NO: 35428 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
ggagtaatgaaaatgtaaaa

SEQ ID NO: 35429 - DNA, 20 bp, Artificial Sequence
  Description of Artificial Sequence: Synthetic oligonucleotide
  Target: ATXN1; (+) strand; PAM type: NNNNGHTT; PAM sequence: TGATGATT
aatgtaaaattaggttttga

SEQ ID NO: 35430 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
gatgattgtataattctatg

SEQ ID NO: 35431 - DNA, 20 bp, Artificial Sequence
  Description of Artificial Sequence: Synthetic oligonucleotide
  Target: ATXN1; (+) strand; PAM type: NNNNGHTT; PAM sequence: GGCTGCTT
tttagaaggctaaggcagga

SEQ ID NO: 35432 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
aaaaaaaagaaaaaaaaaag

SEQ ID NO: 35433 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
gtacaaacaggcgtgcgcca

SEQ ID NO: 35434 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgccttggcctcccaaagtg

SEQ ID NO: 35435 - DNA, 20 bp, Artificial Sequence
  Description of Artificial Sequence: Synthetic oligonucleotide
  Target: ATXN1; (+) strand; PAM type: NNNNGHTT; PAM sequence: AACGGCTT
ttcccagaaaagaaaatagg

SEQ ID NO: 35436 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
tattaaagctactagaatat

SEQ ID NO: 35437 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
gaatatagtagttttcacct

SEQ ID NO: 35438 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
tctcagattggcaaagatcg

SEQ ID NO: 35439 - DNA, 20 bp, Artificial Sequence
  Description of Artificial Sequence: Synthetic oligonucleotide
  Target: ATXN1; (+) strand; PAM type: NNNNGHTT; PAM sequence: CAAGGTTT
caaattggagggcaatttgg

SEQ ID NO: 35440 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
ctgttctatgttccgataag

SEQ ID NO: 35441 - DNA, 20 bp, Artificial Sequence
  Description of Artificial Sequence: Synthetic oligonucleotide
  Target: ATXN1; (+) strand; PAM type: NNNNGHTT; PAM sequence: CATTGTTT
aatagtgtatggggtgtaaa

SEQ ID NO: 35442 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
ttgttttaaaaaacctatat

SEQ ID NO: 35443 - DNA, 20 bp, Artificial Sequence
  Description of Artificial Sequence: Synthetic oligonucleotide
  Target: ATXN1; (+) strand; PAM type: NNNNGHTT; PAM sequence: ACTTGCTT
cacaagaaaatgataatggt

SEQ ID NO: 35444 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
cttagacacagaaataagag

SEQ ID NO: 35445 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
ctagcaattcaaaacaatat

SEQ ID NO: 35446 - DNA, 20 bp, Artificial Sequence
  Description of Artificial Sequence: Synthetic oligonucleotide
  Target: ATXN1; (+) strand; PAM type: NNNNGHTT; PAM sequence: GATAGCTT
aagtacgtggtctaattttg

SEQ ID NO: 35447 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
ggatagctttgttattttta

SEQ ID NO: 35448 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
tatgtttaataaaaaaaaaa

SEQ ID NO: 35449 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
tcaaaattgactgcccagga

SEQ ID NO: 35450 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
tcccaaatagaggcatttgg

SEQ ID NO: 35451 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
gctggagatatgccaacgag

SEQ ID NO: 35452 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
gagatatgccaacgagaggg

SEQ ID NO: 35453 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
atgccaacgagaggggtttg

SEQ ID NO: 35454 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
aatttgctgggcatggtggc

SEQ ID NO: 35455 - DNA, 20 bp, Artificial Sequence
  Description of Artificial Sequence: Synthetic oligonucleotide
  Target: ATXN1; (+) strand; PAM type: NNNNGHTT; PAM sequence: AATCGTTT
tcgggaggctgaggcaggag

SEQ ID NO: 35456 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
ccgagatcacaccattgcac

SEQ ID NO: 35457 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
gctcatcagacattccttta

SEQ ID NO: 35458 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
taaaatgtcccagactccaa

SEQ ID NO: 35459 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
ttctcattctaccactcctg

SEQ ID NO: 35460 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
gagattcttgtagcaaatcc

SEQ ID NO: 35461 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
ttgcctgtcaagcacaactt

SEQ ID NO: 35462 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
cagcatcacaaaagaggtgg

SEQ ID NO: 35463 - DNA, 20 bp, Artificial Sequence
  Description of Artificial Sequence: Synthetic oligonucleotide
  Target: ATXN1; (+) strand; PAM type: NNNNGHTT; PAM sequence: GTGTGCTT
acaatgggagtgagtaatta

SEQ ID NO: 35464 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
tatgaaatattctataaaag

SEQ ID NO: 35465 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
gtatgcagtatatctgatac

SEQ ID NO: 35466 - DNA, 20 bp, Artificial Sequence
  Description of Artificial Sequence: Synthetic oligonucleotide
  Target: ATXN1; (+) strand; PAM type: NNNNGHTT; PAM sequence: CCAAGCTT
ataacactcattgctatttt

SEQ ID NO: 35467 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
tttaatatttccctaaaact

SEQ ID NO: 35468 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
ctctccacagatacattttg

SEQ ID NO: 35469 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
cacagatacattttgctaag

SEQ ID NO: 35470 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
aaacattgacacaatattta

SEQ ID NO: 35471 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
aatatactgtctcatgagta

SEQ ID NO: 35472 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
gagtacatagtttaaaagaa

SEQ ID NO: 35473 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
agataacttcctggggtcat

SEQ ID NO: 35474 - DNA, 20 bp, Artificial Sequence
  Description of Artificial Sequence: Synthetic oligonucleotide
  Target: ATXN1; (+) strand; PAM type: NNNNGHTT; PAM sequence: GGGAGCTT
caacagaagcagaaaaccaa

SEQ ID NO: 35475 - DNA, 20 bp, Artificial Sequence
  Description of Artificial Sequence: Synthetic oligonucleotide
  Target: ATXN1; (+) strand; PAM type: NNNNGHTT; PAM sequence: GAGTGTTT
agaaaataaaggcagataaa

SEQ ID NO: 35476 - DNA, 20 bp, Artificial Sequence
  Description of Artificial Sequence: Synthetic oligonucleotide
  Target: ATXN1; (+) strand; PAM type: NNNNGHTT; PAM sequence: GGCGGATT
cactttgggaggccgaggca

SEQ ID NO: 35477 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttgggaggccgaggcaggcg

SEQ ID NO: 35478 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
tctaggagtaaccactgaat

SEQ ID NO: 35479 - DNA, 20 bp, Artificial Sequence
  Description of Artificial Sequence: Synthetic oligonucleotide
  Target: ATXN1; (+) strand; PAM type: NNNNGHTT; PAM sequence: ACTAGTTT
taaccactgaataaaagctt

SEQ ID NO: 35480 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
ccagtgaagacattgggccg

SEQ ID NO: 35481 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
acattgggccgagaagtttc

SEQ ID NO: 35482 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
ctggatgaatagaacacaga

SEQ ID NO: 35483 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
aaggtcaaaataagggctcc

SEQ ID NO: 35484 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
gcacattcatagactgaaga

SEQ ID NO: 35485 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
ttaaagggaaaaagagagta

SEQ ID NO: 35486 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
agagagtagaaggattcatg

SEQ ID NO: 35487 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
aggattcatgcctggattct

SEQ ID NO: 35488 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
ctaccaaagtgagggtgagg

SEQ ID NO: 35489 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
gtaagttttgaagagactgg

SEQ ID NO: 35490 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
gaaaagcaatgatgactctc

SEQ ID NO: 35491 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
tttacatcaggacccatcag

SEQ ID NO: 35492 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
gtgcaggtgatggggatcat

SEQ ID NO: 35493 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
cccagagagaactacagagt

SEQ ID NO: 35494 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
gaactacagagtctgagatt

SEQ ID NO: 35495 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
caaatgcccgctccaggtcc

SEQ ID NO: 35496 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
ccaagggcttaggacggagc

SEQ ID NO: 35497 - DNA, 20 bp, Artificial Sequence
  Description of Artificial Sequence: Synthetic oligonucleotide
  Target: ATXN1; (+) strand; PAM type: NNNNGHTT; PAM sequence: CTAAGATT
acgaatagaaagagaattct

SEQ ID NO: 35498 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
ccttttcagctgaatgacct

SEQ ID NO: 35499 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
gaaacattgtaacacataca

SEQ ID NO: 35500 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
gtcacagaagtccgcatatt

SEQ ID NO: 35501 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
agcaaatctatatatagaga

SEQ ID NO: 35502 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
ggttgccaggagctgagggt

SEQ ID NO: 35503 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
gaggattgggggaaaatggg

SEQ ID NO: 35504 - DNA, 20 bp, Artificial Sequence
  Description of Artificial Sequence: Synthetic oligonucleotide
  Target: ATXN1; (+) strand; PAM type: NNNNGHTT; PAM sequence: ATGGGATT
ggaagtgattgctgatgggt

SEQ ID NO: 35505 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
aggttatttctcttcttccc

SEQ ID NO: 35506 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
tttaaatcttagctcctgca

SEQ ID NO: 35507 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
catagtggttaaaaatcaat

SEQ ID NO: 35508 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
tctgctttatcttcacaggc

SEQ ID NO: 35509 - DNA, 20 bp, Artificial Sequence
  Description of Artificial Sequence: Synthetic oligonucleotide
  Target: ATXN1; (+) strand; PAM type: NNNNGHTT; PAM sequence: CCTAGTTT
aagtggacaggtctttcata

SEQ ID NO: 35510 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
caggtctttcatacctagtt

SEQ ID NO: 35511 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
gggggctactctggagtact

SEQ ID NO: 35512 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
tctggagtactgtgagtttt

SEQ ID NO: 35513 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ccacctaataggccacatca

SEQ ID NO: 35514 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
tttagggaagaaactgcaaa

SEQ ID NO: 35515 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
ttccccataatctatttatt

SEQ ID NO: 35516 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
ccataatctatttatttgat

SEQ ID NO: 35517 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
accttctccataaaaatcaa

SEQ ID NO: 35518 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
ccagaaggtctctgggtaat

SEQ ID NO: 35519 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
acagaacaaatgataaaaca

SEQ ID NO: 35520 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
gggtctcaaaaaagagagaa

SEQ ID NO: 35521 - DNA, 20 bp, Artificial Sequence
  Description of Artificial Sequence: Synthetic oligonucleotide
  Target: ATXN1; (+) strand; PAM type: NNNNGHTT; PAM sequence: AGCAGATT
tcaggatactggaaattgag

SEQ ID NO: 35522 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
ggaaattgagagcagattat

SEQ ID NO: 35523 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
tttacgttgaataacaagaa

SEQ ID NO: 35524 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
tataatctacaattaacatt

SEQ ID NO: 35525 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
ataagaaatacaatgcccta

SEQ ID NO: 35526 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
aatacaatgccctattctgt

SEQ ID NO: 35527 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
ggctaaaaaactcagtacca

SEQ ID NO: 35528 - DNA, 20 bp, Artificial Sequence
  Description of Artificial Sequence: Synthetic oligonucleotide
  Target: ATXN1; (+) strand; PAM type: NNNNGHTT; PAM sequence: TCTGGATT
ttttgttggcattttacaac

SEQ ID NO: 35529 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tcgggaggctgaggcaggag

SEQ ID NO: 35530 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
ggcatcgtaagttgtctttc

SEQ ID NO: 35531 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
atagtactctacagttcata

SEQ ID NO: 35532 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
tagccttccttgtattaaat

SEQ ID NO: 35533 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
caaaggtacttgtcaattaa

SEQ ID NO: 35534 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
catgccattgaaattattct

SEQ ID NO: 35535 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
aaatgcataaaattaaaggg

SEQ ID NO: 35536 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
gtttcttgcatgggctgcag

SEQ ID NO: 35537 - DNA, 20 bp, Artificial Sequence
  Description of Artificial Sequence: Synthetic oligonucleotide
  Target: ATXN1; (+) strand; PAM type: NNNNGHTT; PAM sequence: TTGCGCTT
tgagtgcaagtcagaataac

SEQ ID NO: 35538 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
acttgcgcttattctgaaat

SEQ ID NO: 35539 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
accctgacaatctaactctg

SEQ ID NO: 35540 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
gtgcacacattacccatgca

SEQ ID NO: 35541 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
attggttccacagagcaaat

SEQ ID NO: 35542 - DNA, 20 bp, Artificial Sequence
  Description of Artificial Sequence: Synthetic oligonucleotide
  Target: ATXN1; (+) strand; PAM type: NNNNGHTT; PAM sequence: GTTAGATT
aaagtattttccttccatgt

SEQ ID NO: 35543 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
caacccagagtaatactaga

SEQ ID NO: 35544 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
aatttataggcggactgtgc

SEQ ID NO: 35545 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
atttgaaacgctgccaaagg

SEQ ID NO: 35546 - DNA, 20 bp, Artificial Sequence
  Description of Artificial Sequence: Synthetic oligonucleotide
  Target: ATXN1; (+) strand; PAM type: NNNNGHTT; PAM sequence: TAGTGCTT
cagagaaacagtgttataaa

SEQ ID NO: 35547 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
aaacagtgttataaatagtg

SEQ ID NO: 35548 - DNA, 20 bp, Artificial Sequence
  Description of Artificial Sequence: Synthetic oligonucleotide
  Target: ATXN1; (+) strand; PAM type: NNNNGHTT; PAM sequence: TAGAGCTT
caggaaggcaaaaagagcta

SEQ ID NO: 35549 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
tttcggtacctggaaacaac

SEQ ID NO: 35550 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
ctatacttctcccactgtct

SEQ ID NO: 35551 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
aagagttcagttcagtaaag

SEQ ID NO: 35552 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
agttcagtaaagacttgttt

SEQ ID NO: 35553 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
caacaggtatagatcaaagg

SEQ ID NO: 35554 - DNA, 20 bp, Artificial Sequence
  Description of Artificial Sequence: Synthetic oligonucleotide
  Target: ATXN1; (+) strand; PAM type: NNNNGHTT; PAM sequence: CCTGGTTT
ggcagggcttctatcccaca

SEQ ID NO: 35555 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
ggactgtcagttcagacccg

SEQ ID NO: 35556 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tggggaggctaagacaggag

SEQ ID NO: 35557 - DNA, 20 bp, Artificial Sequence
  Description of Artificial Sequence: Synthetic oligonucleotide
  Target: ATXN1; (+) strand; PAM type: NNNNGHTT; PAM sequence: TTCCGATT
aaaaaaaaaaaaaaaaacag

SEQ ID NO: 35558 - DNA, 20 bp, Artificial Sequence
  Description of Artificial Sequence: Synthetic oligonucleotide
  Target: ATXN1; (+) strand; PAM type: NNNNGHTT; PAM sequence: AACAGTTT
aactggttagttgttgaaaa

SEQ ID NO: 35559 - DNA, 20 bp, Artificial Sequence
  Description of Artificial Sequence: Synthetic oligonucleotide
  Target: ATXN1; (+) strand; PAM type: NNNNGHTT; PAM sequence: TCTCGCTT
tcccaggagactgctcactc

SEQ ID NO: 35560 - DNA, 20 bp, Artificial Sequence
  Description of Artificial Sequence: Synthetic oligonucleotide
  Target: ATXN1; (+) strand; PAM type: NNNNGHTT; PAM sequence: GGTTGCTT
gttccaccctgaagagttgg

SEQ ID NO: 35561 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
cacctgccctggacaatcca

SEQ ID NO: 35562 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
tgccctggacaatccactag

SEQ ID NO: 35563 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
aacgaaatggcctcacaccg

SEQ ID NO: 35564 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
cgctgagattttataatact

SEQ ID NO: 35565 - DNA, 20 bp, Artificial Sequence
  Description of Artificial Sequence: Synthetic oligonucleotide
  Target: ATXN1; (+) strand; PAM type: NNNNGHTT; PAM sequence: ATAGGTTT
ttataatacttcaagttttt

SEQ ID NO: 35566 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
tccttccttcactgtggtta

SEQ ID NO: 35567 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
caacagggctctgggttcac

SEQ ID NO: 35568 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
gtcatttttctccttcccaa

SEQ ID NO: 35569 - DNA, 20 bp, Artificial Sequence
  Description of Artificial Sequence: Synthetic oligonucleotide
  Target: ATXN1; (+) strand; PAM type: NNNNGHTT; PAM sequence: CCAGGTTT
gaaggtttttcctatcattt

SEQ ID NO: 35570 - DNA, 20 bp, Artificial Sequence
  Description of Artificial Sequence: Synthetic oligonucleotide
  Target: ATXN1; (+) strand; PAM type: NNNNGHTT; PAM sequence: CGTAGATT
caggtttcaagtaggaccca

SEQ ID NO: 35571 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
accaagtgaactttgttgaa

SEQ ID NO: 35572 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
attcattcactattcattta

SEQ ID NO: 35573 - DNA, 20 bp, Artificial Sequence
  Description of Artificial Sequence: Synthetic oligonucleotide
  Target: ATXN1; (+) strand; PAM type: NNNNGHTT; PAM sequence: CCTAGCTT
gagtctgtctaatccaaaac

SEQ ID NO: 35574 - DNA, 20 bp, Artificial Sequence
  Description of Artificial Sequence: Synthetic oligonucleotide
  Target: ATXN1; (+) strand; PAM type: NNNNGHTT; PAM sequence: CAGCGATT
ttctacccttgctccttgca

SEQ ID NO: 35575 - DNA, 20 bp, Artificial Sequence
  Description of Artificial Sequence: Synthetic oligonucleotide
  Target: ATXN1; (+) strand; PAM type: NNNNGHTT; PAM sequence: CAGGGATT
gttgcatctctagaaagatc

SEQ ID NO: 35576 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
gatccagggattaaataatt

SEQ ID NO: 35577 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
cctaagaattaagagaagtg

SEQ ID NO: 35578 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
cctctctttgacaaagcatg

SEQ ID NO: 35579 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
ctctgttgagggttacacag

SEQ ID NO: 35580 - DNA, 20 bp, Artificial Sequence
  Description of Artificial Sequence: Synthetic oligonucleotide
  Target: ATXN1; (+) strand; PAM type: NNNNGHTT; PAM sequence: ATTAGTTT
aaaaatactgaagtcaatac

SEQ ID NO: 35581 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
tattctgccaatgtgaacat

SEQ ID NO: 35582 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
gctcatgccaccatgctcag

SEQ ID NO: 35583 - DNA, 20 bp, Artificial Sequence
  Description of Artificial Sequence: Synthetic oligonucleotide
  Target: ATXN1; (+) strand; PAM type: NNNNGHTT; PAM sequence: CGTGGCTT
gtccaggctggtctcaaact

SEQ ID NO: 35584 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcagccccccaaagtg

SEQ ID NO: 35585 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
atcgtgcaatgctatgtaag

SEQ ID NO: 35586 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
ctcagcatcataaaggtatt

SEQ ID NO: 35587 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tcagttgcctattgtcaata

SEQ ID NO: 35588 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
cgaagaccttcaaaacataa

SEQ ID NO: 35589 - DNA, 20 bp, Artificial Sequence
  Description of Artificial Sequence: Synthetic oligonucleotide
  Target: ATXN1; (+) strand; PAM type: NNNNGHTT; PAM sequence: GGAGGTTT
caggctataattgctgacag

SEQ ID NO: 35590 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
taattgctgacagggaggtt

SEQ ID NO: 35591 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
agacatggtacctgaagatc

SEQ ID NO: 35592 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
gtacctgaagatcaagagtt

SEQ ID NO: 35593 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
tttaagcatgcatacacttt

SEQ ID NO: 35594 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
acttttatggcattttaact

SEQ ID NO: 35595 - DNA, 20 bp, Artificial Sequence
  Description of Artificial Sequence: Synthetic oligonucleotide
  Target: ATXN1; (+) strand; PAM type: NNNNGHTT; PAM sequence: TGGTGATT
tggccttttcctaagtagaa

SEQ ID NO: 35596 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
taagtagaatggtgatttaa

SEQ ID NO: 35597 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
tttatcaagaggacagaagt

SEQ ID NO: 35598 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
cattcagtctagcctaagcc

SEQ ID NO: 35599 - DNA, 20 bp, Artificial Sequence
  Description of Artificial Sequence: Synthetic oligonucleotide
  Target: ATXN1; (+) strand; PAM type: NNNNGHTT; PAM sequence: AATGGATT
aggcatgcaaatatctgctg

SEQ ID NO: 35600 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
taattcctgactcgcctgtc

SEQ ID NO: 35601 - DNA, 20 bp, Artificial Sequence
  Description of Artificial Sequence: Synthetic oligonucleotide
  Target: ATXN1; (+) strand; PAM type: NNNNGHTT; PAM sequence: ACCGGTTT
gccaccctacatacattgtc

SEQ ID NO: 35602 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
aggccatctgtgtcccttcc

SEQ ID NO: 35603 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
cactgtgcctacaatgaccc

SEQ ID NO: 35604 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
acatcctgttaaggtccctg

SEQ ID NO: 35605 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
ctgttaaggtccctgtcagg

SEQ ID NO: 35606 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
aattctcagttgtctgttgt

SEQ ID NO: 35607 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
gttgtcatggattgctctat

SEQ ID NO: 35608 - DNA, 20 bp, Artificial Sequence
  Description of Artificial Sequence: Synthetic oligonucleotide
  Target: ATXN1; (+) strand; PAM type: NNNNGHTT; PAM sequence: TGTGGATT
attgctctataattgcttcc

SEQ ID NO: 35609 - DNA, 20 bp, Artificial Sequence
  Description of Artificial Sequence: Synthetic oligonucleotide
  Target: ATXN1; (+) strand; PAM type: NNNNGHTT; PAM sequence: ACTAGATT
ggattggtattgtgccctga

SEQ ID NO: 35610 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
attgtgccctgaactagatt

SEQ ID NO: 35611 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gccctgaactagattttttg

SEQ ID NO: 35612 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gaactagattttttgttttg

SEQ ID NO: 35613 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagtag

SEQ ID NO: 35614 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
aacctctgcctccggggttc

SEQ ID NO: 35615 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcttgagtag

SEQ ID NO: 35616 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
atttgtatttttagtagaaa

SEQ ID NO: 35617 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
cgcctcggcctcccaaagtg

SEQ ID NO: 35618 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtattttcagtagaga

SEQ ID NO: 35619 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
tcggcctacctaagtgtcaa

SEQ ID NO: 35620 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
taggtttttttgaagataat

SEQ ID NO: 35621 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
gagctcccttgtaccttcca

SEQ ID NO: 35622 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
acccagtttccccctatatt

SEQ ID NO: 35623 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
tcaacaaaccgtagggtgta

SEQ ID NO: 35624 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
gtagggtgtattaggatttc

SEQ ID NO: 35625 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
ttcaccagtttttgcaccaa

SEQ ID NO: 35626 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
acaggctttttttttttttt

SEQ ID NO: 35627 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
aattttatgtggtcatattt

SEQ ID NO: 35628 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
tttttcgaatgtccttccat

SEQ ID NO: 35629 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
atttgagtttgctatttttt

SEQ ID NO: 35630 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
ctatttttttcttgattaga

SEQ ID NO: 35631 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
ctcagttaaggtgatgtctg

SEQ ID NO: 35632 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tttttctccttgtaattact

SEQ ID NO: 35633 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
attttaaaattctacgaatt

SEQ ID NO: 35634 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
attcttactatgagttctaa

SEQ ID NO: 35635 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
gagttctaatgatgttttca

SEQ ID NO: 35636 - DNA, 20 bp, Artificial Sequence
  Description of Artificial Sequence: Synthetic oligonucleotide
  Target: ATXN1; (+) strand; PAM type: NNNNGHTT; PAM sequence: CCTCGTTT
tgttttcatactgcttcctt

SEQ ID NO: 35637 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
ttcatactgcttccttcctc

SEQ ID NO: 35638 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
taaaacaattcctctgtccg

SEQ ID NO: 35639 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
ttccttaagaccaagcagca

SEQ ID NO: 35640 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
atcctgcttcccttctattg

SEQ ID NO: 35641 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
cctcaagggcacactattta

SEQ ID NO: 35642 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
agactctttatatagtgact

SEQ ID NO: 35643 - DNA, 20 bp, Artificial Sequence
  Description of Artificial Sequence: Synthetic oligonucleotide
  Target: ATXN1; (+) strand; PAM type: NNNNGHTT; PAM sequence: CATCGTTT
ccagtcttcaaatccaattt

SEQ ID NO: 35644 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
gccgaaaggaattttacttt

SEQ ID NO: 35645 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
ataaaggccagttgacttcc

SEQ ID NO: 35646 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
tgacttccttttgcttttat

SEQ ID NO: 35647 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
aagtagacacttcatggagc

SEQ ID NO: 35648 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
gcacaccagcccacactcag

SEQ ID NO: 35649 - DNA, 20 bp, Artificial Sequence
  Description of Artificial Sequence: Synthetic oligonucleotide
  Target: ATXN1; (+) strand; PAM type: NNNNGHTT; PAM sequence: CCGTGCTT
ccacactcagtaaagattta

SEQ ID NO: 35650 - DNA, 20 bp, Artificial Sequence
  Description of Artificial Sequence: Synthetic oligonucleotide
  Target: ATXN1; (+) strand; PAM type: NNNNGHTT; PAM sequence: CTCCGTTT
gatttaccgtgcttcactgt

SEQ ID NO: 35651 - DNA, 20 bp, Artificial Sequence
  Description of Artificial Sequence: Synthetic oligonucleotide
  Target: ATXN1; (+) strand; PAM type: NNNNGHTT; PAM sequence: CCCCGCTT
gtccccagaccacagacaca

SEQ ID NO: 35652 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
tctgcccagacctccctaaa

SEQ ID NO: 35653 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
aatgacacaagatagcagtc

SEQ ID NO: 35654 - DNA, 20 bp, Artificial Sequence
  Description of Artificial Sequence: Synthetic oligonucleotide
  Target: ATXN1; (+) strand; PAM type: NNNNGHTT; PAM sequence: CAAGGTTT
tctgctttaatgttgttatt

SEQ ID NO: 35655 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
caatatttactataaaatct

SEQ ID NO: 35656 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
ctacttgggaagctgaggca

SEQ ID NO: 35657 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttgggaagctgaggcaaaag

SEQ ID NO: 35658 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
ccgagatcgtgccattgcac

SEQ ID NO: 35659 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
aaaaaaaggaaaaaaaatca

SEQ ID NO: 35660 - DNA, 20 bp, Artificial Sequence
  Description of Artificial Sequence: Synthetic oligonucleotide
  Target: ATXN1; (+) strand; PAM type: NNNNGHTT; PAM sequence: TACCGCTT
ggaaaaaaaatcatgtggtt

SEQ ID NO: 35661 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
gagagtggacaattctgtta

SEQ ID NO: 35662 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
gaatttttaaatttttatac

SEQ ID NO: 35663 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
atagattttgcctctgatat

SEQ ID NO: 35664 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
cttctctaagctatttccac

SEQ ID NO: 35665 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
atagagatgcggaaaaaacc

SEQ ID NO: 35666 - DNA, 20 bp, Artificial Sequence
  Description of Artificial Sequence: Synthetic oligonucleotide
  Target: ATXN1; (+) strand; PAM type: NNNNGHTT; PAM sequence: GAGTGATT
ggaaaaaaccctcagatttt

SEQ ID NO: 35667 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
aaagctgataagttgcagaa

SEQ ID NO: 35668 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
gctcattacataaacatttt

SEQ ID NO: 35669 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
aatgcccaggttcccttatc

SEQ ID NO: 35670 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
tgttccattatctgaggatc

SEQ ID NO: 35671 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
actatgttgacaaatcttcc

SEQ ID NO: 35672 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
tgttgctgcacatattgctg

SEQ ID NO: 35673 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
aagatcctggaattaaacag

SEQ ID NO: 35674 - DNA, 20 bp, Artificial Sequence
  Description of Artificial Sequence: Synthetic oligonucleotide
  Target: ATXN1; (+) strand; PAM type: NNNNGHTT; PAM sequence: GGGTGCTT
ccttccagagccagcccaaa

SEQ ID NO: 35675 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
gagtactttctgatgttata

SEQ ID NO: 35676 - DNA, 20 bp, Artificial Sequence
  Description of Artificial Sequence: Synthetic oligonucleotide
  Target: ATXN1; (+) strand; PAM type: NNNNGHTT; PAM sequence: GGTAGCTT
tgcagggggcaaaaggaaga

SEQ ID NO: 35677 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
cccctttttggggtgtgtgt

SEQ ID NO: 35678 - DNA, 20 bp, Artificial Sequence
  Description of Artificial Sequence: Synthetic oligonucleotide
  Target: ATXN1; (+) strand; PAM type: NNNNGHTT; PAM sequence: TAGAGCTT
attccagcagtgacacaagt

SEQ ID NO: 35679 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
ttgcccaattccactttccc

SEQ ID NO: 35680 - DNA, 20 bp, Artificial Sequence
  Description of Artificial Sequence: Synthetic oligonucleotide
  Target: ATXN1; (+) strand; PAM type: NNNNGHTT; PAM sequence: ATGGGATT
ccactttccctgctgtttta

SEQ ID NO: 35681 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
ccaaactgtcatataagtac

SEQ ID NO: 35682 - DNA, 20 bp, Artificial Sequence
  Description of Artificial Sequence: Synthetic oligonucleotide
  Target: ATXN1; (+) strand; PAM type: NNNNGHTT; PAM sequence: GAGTGTTT
gttgcctttgtgcatgaaca

SEQ ID NO: 35683 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tttgtgcatgaacagagtgt

SEQ ID NO: 35684 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
catgaacagagtgtttttgt

SEQ ID NO: 35685 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
aacagagtgtttttgttttg

SEQ ID NO: 35686 - DNA, 20 bp, Artificial Sequence
  Description of Artificial Sequence: Synthetic oligonucleotide
  Target: ATXN1; (+) strand; PAM type: NNNNGHTT; PAM sequence: GACCGCTT
acggggaaaacagaaacagt

SEQ ID NO: 35687 - DNA, 20 bp, Artificial Sequence
  Description of Artificial Sequence: Synthetic oligonucleotide
  Target: ATXN1; (+) strand; PAM type: NNNNGHTT; PAM sequence: CGCCGATT
caaagccccccccccccacc

SEQ ID NO: 35688 - DNA, 20 bp, Artificial Sequence
  Description of Artificial Sequence: Synthetic oligonucleotide
  Target: ATXN1; (+) strand; PAM type: NNNNGHTT; PAM sequence: GGGCGTTT
cgattcattcccaagtccaa

SEQ ID NO: 35689 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
cgtttcacttgaattttgaa

SEQ ID NO: 35690 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
tcagtcaagtcaagcacaga

SEQ ID NO: 35691 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
acacggcatcagcactgaat

SEQ ID NO: 35692 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gcatcagcactgaattcttg

SEQ ID NO: 35693 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
tgaattcttgttttgtttgg

SEQ ID NO: 35694 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
tgttttgtttggctatgttt

SEQ ID NO: 35695 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
acagtagatacagtagcaag

SEQ ID NO: 35696 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
tgccaggccaggcaatgttc

SEQ ID NO: 35697 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
agagagagagagagagagaa

SEQ ID NO: 35698 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
tcttaatacttttggcatat

SEQ ID NO: 35699 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
ttatttccaaatcttataac

SEQ ID NO: 35700 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
tgtttcaacaatcagtgaat

SEQ ID NO: 35701 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
tgaatttagaaaacatattt

SEQ ID NO: 35702 - DNA, 20 bp, Artificial Sequence
  Description of Artificial Sequence: Synthetic oligonucleotide
  Target: ATXN1; (+) strand; PAM type: NNNNGHTT; PAM sequence: TAGTGATT
taacctctaagagaaaaaaa

SEQ ID NO: 35703 - DNA, 20 bp, Artificial Sequence
  Description of Artificial Sequence: Synthetic oligonucleotide
  Target: ATXN1; (+) strand; PAM type: NNNNGHTT; PAM sequence: GTTGGATT
tttgataaagctgtatgaaa

SEQ ID NO: 35704 - DNA, 20 bp, Artificial Sequence
  Description of Artificial Sequence: Synthetic oligonucleotide
  Target: ATXN1; (+) strand; PAM type: NNNNGHTT; PAM sequence: TCGAGTTT
atgaaagttggatttctacc

SEQ ID NO: 35705 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
tttgcccgcactttgagtag

SEQ ID NO: 35706 - DNA, 20 bp, Artificial Sequence
  Description of Artificial Sequence: Synthetic oligonucleotide
  Target: ATXN1; (+) strand; PAM type: NNNNGHTT; PAM sequence: GTCTGCTT
aggggaaggtctgtgcagca

SEQ ID NO: 35707 - DNA, 20 bp, Artificial Sequence
  Description of Artificial Sequence: Synthetic oligonucleotide
  Target: ATXN1; (+) strand; PAM type: NNNNGHTT; PAM sequence: GTAAGCTT
gcaataagaaagacaaaatt

SEQ ID NO: 35708 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
ttgatatcaaccattttcta

SEQ ID NO: 35709 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
gagagttattacaactatgt

SEQ ID NO: 35710 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
tataaaactttcaaagaata

SEQ ID NO: 35711 - DNA, 20 bp, Artificial Sequence
  Description of Artificial Sequence: Synthetic oligonucleotide
  Target: ATXN1; (+) strand; PAM type: NNNNGHTT; PAM sequence: AATAGTTT
taaaactttaaagtatccaa

SEQ ID NO: 35712 - DNA, 20 bp, Artificial Sequence
  Description of Artificial Sequence: Synthetic oligonucleotide
  Target: ATXN1; (+) strand; PAM type: NNNNGHTT; PAM sequence: TTTCGCTT
gaatctttgaccctacattt

SEQ ID NO: 35713 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
tatgaattatggaggctatc

SEQ ID NO: 35714 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
aagataaattttggggaagt

SEQ ID NO: 35715 - DNA, 20 bp, Artificial Sequence
  Description of Artificial Sequence: Synthetic oligonucleotide
  Target: ATXN1; (+) strand; PAM type: NNNNGHTT; PAM sequence: GTAGGATT
gttttaaatacttaatatca

SEQ ID NO: 35716 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
ttgagagggactcacaaccc

SEQ ID NO: 35717 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
caaccctacagtttttcttt

SEQ ID NO: 35718 - DNA, 20 bp, Artificial Sequence
  Description of Artificial Sequence: Synthetic oligonucleotide
  Target: ATXN1; (+) strand; PAM type: NNNNGHTT; PAM sequence: GGATGTTT
atctgggtagagtacgtggt

SEQ ID NO: 35719 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
atttagatctggaacctaaa

SEQ ID NO: 35720 - DNA, 20 bp, Artificial Sequence
  Description of Artificial Sequence: Synthetic oligonucleotide
  Target: ATXN1; (+) strand; PAM type: NNNNGHTT; PAM sequence: GTAGGATT
attatgcatgtgcacaaaag

SEQ ID NO: 35721 - DNA, 20 bp, Artificial Sequence
  Description of Artificial Sequence: Synthetic oligonucleotide
  Target: ATXN1; (+) strand; PAM type: NNNNGHTT; PAM sequence: CCTCGATT
ggtacacgtgttctggtgca

SEQ ID NO: 35722 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
cggtgacatccatctttcta

SEQ ID NO: 35723 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
atttcacaatttcttaagga

SEQ ID NO: 35724 - DNA, 20 bp, Artificial Sequence
  Description of Artificial Sequence: Synthetic oligonucleotide
  Target: ATXN1; (+) strand; PAM type: NNNNGHTT; PAM sequence: GTACGCTT
cattcgaggggtgttagaca

SEQ ID NO: 35725 - DNA, 20 bp, Artificial Sequence
  Description of Artificial Sequence: Synthetic oligonucleotide
  Target: ATXN1; (+) strand; PAM type: NNNNGHTT; PAM sequence: CCTGGTTT
agatcaacaggtctgtctcc

SEQ ID NO: 35726 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
ggtctgtctcccctggtttc

SEQ ID NO: 35727 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
tagggccagtcttttgtcaa

SEQ ID NO: 35728 - DNA, 20 bp, Artificial Sequence
  Description of Artificial Sequence: Synthetic oligonucleotide
  Target: ATXN1; (+) strand; PAM type: NNNNGHTT; PAM sequence: ATGGGATT
aatgagtgaggaatgactga

SEQ ID NO: 35729 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
attaaaattaaagaccttgt

SEQ ID NO: 35730 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
agtttctcacaattcaaaag

SEQ ID NO: 35731 - DNA, 20 bp, Artificial Sequence
  Description of Artificial Sequence: Synthetic oligonucleotide
  Target: ATXN1; (+) strand; PAM type: NNNNGHTT; PAM sequence: CTAAGATT
tccccatgggactttgcgaa

SEQ ID NO: 35732 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
tttgcgaactaagatttcaa

SEQ ID NO: 35733 - DNA, 20 bp, Artificial Sequence
  Description of Artificial Sequence: Synthetic oligonucleotide
  Target: ATXN1; (+) strand; PAM type: NNNNGHTT; PAM sequence: TATTGATT
tttcttcctctctgagtctt

SEQ ID NO: 35734 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
ctctgagtctttattgattt

SEQ ID NO: 35735 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
atatacatgtgtgtataaat

SEQ ID NO: 35736 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
catgtgtgtataaatccaag

SEQ ID NO: 35737 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
tcatcctcatagtcacaggg

SEQ ID NO: 35738 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
ctgaagccgtacacgtcgtt

SEQ ID NO: 35739 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
gtgtttgtctccttcatgcc

SEQ ID NO: 35740 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
tacgatggagccaaagggtc

SEQ ID NO: 35741 - DNA, 20 bp, Artificial Sequence
  Description of Artificial Sequence: Synthetic oligonucleotide
  Target: ATXN1; (+) strand; PAM type: NNNNGHTT; PAM sequence: ATGCGTTT
atgcatctgtaggataaagc

SEQ ID NO: 35742 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
ctttcatttatttagtgaaa

SEQ ID NO: 35743 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
agccaggtgatccagacagc

SEQ ID NO: 35744 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
atcaggaagtctctccagga

SEQ ID NO: 35745 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
aagagaggcaaagtaatttt

SEQ ID NO: 35746 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
ggcaaagtaattttggaaga

SEQ ID NO: 35747 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
ggttcatgccaataccctac

SEQ ID NO: 35748 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
tctatattgatcattttctc

SEQ ID NO: 35749 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
tgattaaatactcctgaaat

SEQ ID NO: 35750 - DNA, 20 bp, Artificial Sequence
  Description of Artificial Sequence: Synthetic oligonucleotide
  Target: ATXN1; (+) strand; PAM type: NNNNGHTT; PAM sequence: TAACGATT
tactcctgaaataggagttt

SEQ ID NO: 35751 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
gaatttgagcccaggcagcc

SEQ ID NO: 35752 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
ctgaagcttgcaatcttatc

SEQ ID NO: 35753 - DNA, 20 bp, Artificial Sequence
  Description of Artificial Sequence: Synthetic oligonucleotide
  Target: ATXN1; (+) strand; PAM type: NNNNGHTT; PAM sequence: TTATGCTT
tctttttaagaaatgaaaaa

SEQ ID NO: 35754 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
aaattatgctttccactgaa

SEQ ID NO: 35755 - DNA, 20 bp, Artificial Sequence
  Description of Artificial Sequence: Synthetic oligonucleotide
  Target: ATXN1; (+) strand; PAM type: NNNNGHTT; PAM sequence: TAGTGATT
cactgaaaaatgattgtatc

SEQ ID NO: 35756 - DNA, 20 bp, Artificial Sequence
  Description of Artificial Sequence: Synthetic oligonucleotide
  Target: ATXN1; (+) strand; PAM type: NNNNGHTT; PAM sequence: TCTGGATT
cctaggacccttctactcct

SEQ ID NO: 35757 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
ttctgaaatgtcgaaatctg

SEQ ID NO: 35758 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
atcagtcagcaaaaaactct

SEQ ID NO: 35759 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
ttgggaggctgaggtgggaa

SEQ ID NO: 35760 - DNA, 20 bp, Artificial Sequence
  Description of Artificial Sequence: Synthetic oligonucleotide
  Target: ATXN1; (+) strand; PAM type: NNNNGHTT; PAM sequence: ACGAGTTT
tgggaagactgcttgaggtc

SEQ ID NO: 35761 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
tataaattaaataaatttta

SEQ ID NO: 35762 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
ctacaatctctactaccatt

SEQ ID NO: 35763 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
gacatgtgtatgttgtgtgt

SEQ ID NO: 35764 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
caatgataattattttcctt

SEQ ID NO: 35765 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
ttttcctttaaagcttttgg

SEQ ID NO: 35766 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
tggagatgtttacctgtacc

SEQ ID NO: 35767 - DNA, 20 bp, Artificial Sequence
  Description of Artificial Sequence: Synthetic oligonucleotide
  Target: ATXN1; (+) strand; PAM type: NNNNGHTT; PAM sequence: CGAAGATT
ccttgcagcagatcttttca

SEQ ID NO: 35768 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
agcagatcttttcacgaaga

SEQ ID NO: 35769 - DNA, 20 bp, Artificial Sequence
  Description of Artificial Sequence: Synthetic oligonucleotide
  Target: ATXN1; (+) strand; PAM type: NNNNGHTT; PAM sequence: GGCTGCTT
acaatattctcactgagtta

SEQ ID NO: 35770 - DNA, 20 bp, Artificial Sequence
  Description of Artificial Sequence: Synthetic oligonucleotide
  Target: ATXN1; (+) strand; PAM type: NNNNGHTT; PAM sequence: CAAGGTTT
cacacacacacacacacaca

SEQ ID NO: 35771 - DNA, 20 bp, Artificial Sequence
  Description of Artificial Sequence: Synthetic oligonucleotide
  Target: ATXN1; (+) strand; PAM type: NNNNGHTT; PAM sequence: GGTTGCTT
atgagtgggttctggccagg

SEQ ID NO: 35772 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
cctgcccctccttccctgct

SEQ ID NO: 35773 - DNA, 20 bp, Artificial Sequence
  Description of Artificial Sequence: Synthetic oligonucleotide
  Target: ATXN1; (+) strand; PAM type: NNNNGHTT; PAM sequence: CTAAGATT
tccttccctgctcaatgatt

SEQ ID NO: 35774 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
atggccaaggtcatcacgaa

SEQ ID NO: 35775 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
tatgttctgggccatgtgct

SEQ ID NO: 35776 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
gtctgtgaggtggccaggaa

SEQ ID NO: 35777 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
aagccaacagttcacagagg

SEQ ID NO: 35778 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
acagttcacagaggtcatgc

SEQ ID NO: 35779 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
gaatcacttgaaccggaagg

SEQ ID NO: 35780 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
ctagtcttaaaattactatt

SEQ ID NO: 35781 - DNA, 20 bp, Artificial Sequence
  Description of Artificial Sequence: Synthetic oligonucleotide
  Target: ATXN1; (+) strand; PAM type: NNNNGHTT; PAM sequence: TTTGGATT
ttaaaattactattatttgt

SEQ ID NO: 35782 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
ttgttttggatttgactgta

SEQ ID NO: 35783 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
atgtcttaaaaaattcttaa

SEQ ID NO: 35784 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
gcctttgcatatgacactcc

SEQ ID NO: 35785 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
tatgacactccctttgatta

SEQ ID NO: 35786 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
ccgggaggctgaggcaggag

SEQ ID NO: 35787 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
ctcatttttcaaggccaacc

SEQ ID NO: 35788 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
caaggccaaccttgagctta

SEQ ID NO: 35789 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
tgtcatcctcatctatcccc

SEQ ID NO: 35790 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
ttttctggaaatctaagcag

SEQ ID NO: 35791 - DNA, 20 bp, Artificial Sequence
  Description of Artificial Sequence: Synthetic oligonucleotide
  Target: ATXN1; (+) strand; PAM type: NNNNGHTT; PAM sequence: CTACGTTT
cagaatagattctgcctcac

SEQ ID NO: 35792 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
gctcctgcctaaggcattgc

SEQ ID NO: 35793 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
ccaacttgcactacagcatg

SEQ ID NO: 35794 - DNA, 20 bp, Artificial Sequence
  Description of Artificial Sequence: Synthetic oligonucleotide
  Target: ATXN1; (+) strand; PAM type: NNNNGHTT; PAM sequence: CCTTGCTT
ctttcaattccttaaaagga

SEQ ID NO: 35795 - DNA, 20 bp, Artificial Sequence
  Description of Artificial Sequence: Synthetic oligonucleotide
  Target: ATXN1; (+) strand; PAM type: NNNNGHTT; PAM sequence: GGTTGATT
ttgtaacttttacatttttt

SEQ ID NO: 35796 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
tttacattttttggttgatt

SEQ ID NO: 35797 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
tttttggttgattcattgat

SEQ ID NO: 35798 - DNA, 20 bp, Artificial Sequence
  Description of Artificial Sequence: Synthetic oligonucleotide
  Target: ATXN1; (+) strand; PAM type: NNNNGHTT; PAM sequence: GCTTGTTT
tggttgattcattgattaat

SEQ ID NO: 35799 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
tctcacccctcctttcatct

SEQ ID NO: 35800 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
ttcatctttgggattcaatg

SEQ ID NO: 35801 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
ggaaggtcatcccttaatca

SEQ ID NO: 35802 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
aatcatactgatttaattag

SEQ ID NO: 35803 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
tactgatttaattagtgttg

SEQ ID NO: 35804 - DNA, 20 bp, Artificial Sequence
  Description of Artificial Sequence: Synthetic oligonucleotide
  Target: ATXN1; (+) strand; PAM type: NNNNGHTT; PAM sequence: AATCGTTT
gttgattggattcatctgta

SEQ ID NO: 35805 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
cctgtagctccctgacccca

SEQ ID NO: 35806 - DNA, 20 bp, Artificial Sequence
  Description of Artificial Sequence: Synthetic oligonucleotide
  Target: ATXN1; (+) strand; PAM type: NNNNGHTT; PAM sequence: GGACGCTT
tcttcaagtctcagggctgg

SEQ ID NO: 35807 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
atcccctcatcatagtaccc

SEQ ID NO: 35808 - DNA, 20 bp, Artificial Sequence
  Description of Artificial Sequence: Synthetic oligonucleotide
  Target: ATXN1; (+) strand; PAM type: NNNNGHTT; PAM sequence: ACACGTTT
tatacatcacacacatacac

SEQ ID NO: 35809 - DNA, 20 bp, Artificial Sequence
  Description of Artificial Sequence: Synthetic oligonucleotide
  Target: ATXN1; (+) strand; PAM type: NNNNGHTT; PAM sequence: ATACGATT
cagagctgggcatctgaaat

SEQ ID NO: 35810 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
ttattaaatgtggtaaggca

SEQ ID NO: 35811 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
ttaactaagctacataagta

SEQ ID NO: 35812 - DNA, 20 bp, Artificial Sequence
  Description of Artificial Sequence: Synthetic oligonucleotide
  Target: ATXN1; (+) strand; PAM type: NNNNGHTT; PAM sequence: AACAGTTT
acaacttatgggtaaaatgt

SEQ ID NO: 35813 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
atccgttgcaactgaaggac

SEQ ID NO: 35814 - DNA, 20 bp, Artificial Sequence
  Description of Artificial Sequence: Synthetic oligonucleotide
  Target: ATXN1; (+) strand; PAM type: NNNNGHTT; PAM sequence: GATTGTTT
gttgcaactgaaggactaat

SEQ ID NO: 35815 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
gtgacttcataaataaatac

SEQ ID NO: 35816 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
ttggaaaaaaaataagaatg

SEQ ID NO: 35817 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
aaactcataattctgcccta

SEQ ID NO: 35818 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
caaatttaaataatgcatat

SEQ ID NO: 35819 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
agtactatcattattgcatt

SEQ ID NO: 35820 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
aaccccaaagcaaatcattt

SEQ ID NO: 35821 - DNA, 20 bp, Artificial Sequence
  Description of Artificial Sequence: Synthetic oligonucleotide
  Target: ATXN1; (+) strand; PAM type: NNNNGHTT; PAM sequence: TGAGGCTT
aagcaaatcatttttctgat

SEQ ID NO: 35822 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
ttctttgagacaagttctca

SEQ ID NO: 35823 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
atttttttttttttttgaaa

SEQ ID NO: 35824 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcctgagtag

SEQ ID NO: 35825 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 35826 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
gcatgtggtctcccaaagtg

SEQ ID NO: 35827 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
ttccatggccacagctattg

SEQ ID NO: 35828 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
tactattaatttcattacca

SEQ ID NO: 35829 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
taatttcattaccatgatgc

SEQ ID NO: 35830 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
attcaagcattgctcttcct

SEQ ID NO: 35831 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
agaatatactctcagtaaac

SEQ ID NO: 35832 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
tatggtgaaaaggccactaa

SEQ ID NO: 35833 - DNA, 20 bp, Artificial Sequence
  Description of Artificial Sequence: Synthetic oligonucleotide
  Target: ATXN1; (+) strand; PAM type: NNNNGHTT; PAM sequence: TAGCGTTT
ttttagtgaaatgaaactct

SEQ ID NO: 35834 - DNA, 20 bp, Artificial Sequence
  Description of Artificial Sequence: Synthetic oligonucleotide
  Target: ATXN1; (+) strand; PAM type: NNNNGHTT; PAM sequence: TATTGATT
aagacaaatgttcagttagc

SEQ ID NO: 35835 - DNA, 20 bp, Artificial Sequence
  Description of Artificial Sequence: Synthetic oligonucleotide
  Target: ATXN1; (+) strand; PAM type: NNNNGHTT; PAM sequence: AGCTGTTT
tgtcactcattattctgctc

SEQ ID NO: 35836 - DNA, 20 bp, Artificial Sequence
  Description of Artificial Sequence: Synthetic oligonucleotide
  Target: ATXN1; (+) strand; PAM type: NNNNGHTT; PAM sequence: ATGGGCTT
attgtcattcttattcctat

SEQ ID NO: 35837 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
cttatttctcacatatccac

SEQ ID NO: 35838 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
gaaaggtgggcaccaaaaga

SEQ ID NO: 35839 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
tcactgttgggacaatgaat

SEQ ID NO: 35840 - DNA, 20 bp, Artificial Sequence
  Description of Artificial Sequence: Synthetic oligonucleotide
  Target: ATXN1; (+) strand; PAM type: NNNNGHTT; PAM sequence: GATGGATT
aggtgatcaagcctttactt

SEQ ID NO: 35841 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gattttcttttctccacgcc

SEQ ID NO: 35842 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
tctccacgccccaagatttt

SEQ ID NO: 35843 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
agaaagcacccacgtctcct

SEQ ID NO: 35844 - DNA, 20 bp, Artificial Sequence
  Description of Artificial Sequence: Synthetic oligonucleotide
  Target: ATXN1; (+) strand; PAM type: NNNNGHTT; PAM sequence: GCAAGATT
acccaaaagactgaacagca

SEQ ID NO: 35845 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
tatcataaagagtgaaagaa

SEQ ID NO: 35846 - DNA, 20 bp, Artificial Sequence
  Description of Artificial Sequence: Synthetic oligonucleotide
  Target: ATXN1; (+) strand; PAM type: NNNNGHTT; PAM sequence: GGCAGCTT
gggggtggggggttgggggg

SEQ ID NO: 35847 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
cattatttttcccgtccatg

SEQ ID NO: 35848 - DNA, 20 bp, Artificial Sequence
  Description of Artificial Sequence: Synthetic oligonucleotide
  Target: ATXN1; (+) strand; PAM type: NNNNGHTT; PAM sequence: CCATGATT
cgcccttttctcaatcctcc

SEQ ID NO: 35849 - DNA, 20 bp, Artificial Sequence
  Description of Artificial Sequence: Synthetic oligonucleotide
  Target: ATXN1; (+) strand; PAM type: NNNNGHTT; PAM sequence: TGCTGATT
attggttacttttagaaccc

SEQ ID NO: 35850 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
gattggtccattttacaaag

SEQ ID NO: 35851 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
actggtgcatttttacagag

SEQ ID NO: 35852 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
cactcgacccaggaagtcca

SEQ ID NO: 35853 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
ttaaaaatatttctatcatg

SEQ ID NO: 35854 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
atctatcactctctaaaata

SEQ ID NO: 35855 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
ctctaaaatacatagtttaa

SEQ ID NO: 35856 - DNA, 20 bp, Artificial Sequence
  Description of Artificial Sequence: Synthetic oligonucleotide
  Target: ATXN1; (+) strand; PAM type: NNNNGHTT; PAM sequence: GCTTGATT
aaaatacatagtttaattgt

SEQ ID NO: 35857 - DNA, 20 bp, Artificial Sequence
  Description of Artificial Sequence: Synthetic oligonucleotide
  Target: ATXN1; (+) strand; PAM type: NNNNGHTT; PAM sequence: ACTAGTTT
actgtatatagtcttttgtg

SEQ ID NO: 35858 - DNA, 20 bp, Artificial Sequence
  Description of Artificial Sequence: Synthetic oligonucleotide
  Target: ATXN1; (+) strand; PAM type: NNNNGHTT; PAM sequence: TATTGTTT
gactagtttttttcacacaa

SEQ ID NO: 35859 - DNA, 20 bp, Artificial Sequence
  Description of Artificial Sequence: Synthetic oligonucleotide
  Target: ATXN1; (+) strand; PAM type: NNNNGHTT; PAM sequence: CTAAGATT
tttttcacacaatattgttt

SEQ ID NO: 35860 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
ttgacgacctttaaaatttt

SEQ ID NO: 35861 - DNA, 20 bp, Artificial Sequence
  Description of Artificial Sequence: Synthetic oligonucleotide
  Target: ATXN1; (+) strand; PAM type: NNNNGHTT; PAM sequence: CTTCGTTT
gacctttaaaattttttcag

SEQ ID NO: 35862 - DNA, 20 bp, Artificial Sequence
  Description of Artificial Sequence: Synthetic oligonucleotide
  Target: ATXN1; (+) strand; PAM type: NNNNGHTT; PAM sequence: ATAAGTTT
taggaacaatacccatcagc

SEQ ID NO: 35863 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
actgttaaacaatagtgcca

SEQ ID NO: 35864 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
agcctccacctcctgggttc

SEQ ID NO: 35865 - DNA, 20 bp, Artificial Sequence
  Description of Artificial Sequence: Synthetic oligonucleotide
  Target: ATXN1; (+) strand; PAM type: NNNNGHTT; PAM sequence: CGAGGTTT
ttttgtatttttagaagaga

SEQ ID NO: 35866 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcggcctcccaaagtg

SEQ ID NO: 35867 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
tgtccctgtctctcacattg

SEQ ID NO: 35868 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
aacatggcattaactaatga

SEQ ID NO: 35869 - DNA, 20 bp, Artificial Sequence
  Description of Artificial Sequence: Synthetic oligonucleotide
  Target: ATXN1; (+) strand; PAM type: NNNNGHTT; PAM sequence: TCAAGCTT
catgtacaaatataagtacc

SEQ ID NO: 35870 - DNA, 20 bp, Artificial Sequence
  Description of Artificial Sequence: Synthetic oligonucleotide
  Target: ATXN1; (+) strand; PAM type: NNNNGHTT; PAM sequence: GGCTGATT
ttagaagcagaggaagagag

SEQ ID NO: 35871 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
gagggctgattagatggggg

SEQ ID NO: 35872 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
ctgattagatggggggaagg

SEQ ID NO: 35873 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
caaaatcgaaaaactttgta

SEQ ID NO: 35874 - DNA, 20 bp, Artificial Sequence
  Description of Artificial Sequence: Synthetic oligonucleotide
  Target: ATXN1; (+) strand; PAM type: NNNNGHTT; PAM sequence: TTAGGCTT
gtaattagattttgccagac

SEQ ID NO: 35875 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
ccagacttaggcttaaagga

SEQ ID NO: 35876 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
atgcctgttaagtcaccttt

SEQ ID NO: 35877 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
tgcctcttattaaattctca

SEQ ID NO: 35878 - DNA, 20 bp, Artificial Sequence
  Description of Artificial Sequence: Synthetic oligonucleotide
  Target: ATXN1; (+) strand; PAM type: NNNNGHTT; PAM sequence: TCTCGTTT
taatcacagtggtggtgcct

SEQ ID NO: 35879 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
agactttccttcttcgtcaa

SEQ ID NO: 35880 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
aagcttttgcagccccgtta

SEQ ID NO: 35881 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
gggactacagatgcacgcct

SEQ ID NO: 35882 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
aaagcctggtaaacaaagtg

SEQ ID NO: 35883 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
ttctccacaactacaaaaat

SEQ ID NO: 35884 - DNA, 20 bp, Artificial Sequence
  Description of Artificial Sequence: Synthetic oligonucleotide
  Target: ATXN1; (+) strand; PAM type: NNNNGHTT; PAM sequence: TTTGGATT
atctttgatttaaaaatgac

SEQ ID NO: 35885 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
ttgggcattttatccagtga

SEQ ID NO: 35886 - DNA, 20 bp, Artificial Sequence
  Description of Artificial Sequence: Synthetic oligonucleotide
  Target: ATXN1; (+) strand; PAM type: NNNNGHTT; PAM sequence: CCCTGATT
acagggacagccttcctgct

SEQ ID NO: 35887 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
tggctctgccgcagcctccc

SEQ ID NO: 35888 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
gtggaaggaggagaattcct

SEQ ID NO: 35889 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
gaaatgcccatccaggaaaa

SEQ ID NO: 35890 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
gctcactgcagcctctacct

SEQ ID NO: 35891 - DNA, 20 bp, Artificial Sequence
  Description of Artificial Sequence: Synthetic oligonucleotide
  Target: ATXN1; (+) strand; PAM type: NNNNGHTT; PAM sequence: TAGCGATT
agcctctacctctcagattc

SEQ ID NO: 35892 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
tgcctctgcctccccagtag

SEQ ID NO: 35893 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtattttcagtcgaga

SEQ ID NO: 35894 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcctcggcctcccaaggtg

SEQ ID NO: 35895 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
ccatggctcccagcataggc

SEQ ID NO: 35896 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
tggaaggagaagccaacagt

SEQ ID NO: 35897 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
agaatgaagtaaattgctaa

SEQ ID NO: 35898 - DNA, 20 bp, Artificial Sequence
  Description of Artificial Sequence: Synthetic oligonucleotide
  Target: ATXN1; (+) strand; PAM type: NNNNGHTT; PAM sequence: ACTAGCTT
gtgaggtgatgaatatatta

SEQ ID NO: 35899 - DNA, 20 bp, Artificial Sequence
  Description of Artificial Sequence: Synthetic oligonucleotide
  Target: ATXN1; (+) strand; PAM type: NNNNGHTT; PAM sequence: GCTTGATT
ggtgatgaatatattaacta

SEQ ID NO: 35900 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
gacattttttaaaaaatgaa

SEQ ID NO: 35901 - DNA, 20 bp, Artificial Sequence
  Description of Artificial Sequence: Synthetic oligonucleotide
  Target: ATXN1; (+) strand; PAM type: NNNNGHTT; PAM sequence: CATAGCTT
tgatgctttcatgcatgcta

SEQ ID NO: 35902 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
cggaacgggttgccaatgtg

SEQ ID NO: 35903 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
cataattaagagttatttcc

SEQ ID NO: 35904 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
agttatttccttttgtttaa

SEQ ID NO: 35905 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
tcactttgaggaaattattt

SEQ ID NO: 35906 - DNA, 20 bp, Artificial Sequence
  Description of Artificial Sequence: Synthetic oligonucleotide
  Target: ATXN1; (+) strand; PAM type: NNNNGHTT; PAM sequence: TAACGCTT
tccgctgtaaaaggagtcac

SEQ ID NO: 35907 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
cccacagcagccactcggac

SEQ ID NO: 35908 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
agtaaggacaactcaaggat

SEQ ID NO: 35909 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
cacctgggccccatgacaga

SEQ ID NO: 35910 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
aaagtcacacctctcctttt

SEQ ID NO: 35911 - DNA, 20 bp, Artificial Sequence
  Description of Artificial Sequence: Synthetic oligonucleotide
  Target: ATXN1; (+) strand; PAM type: NNNNGHTT; PAM sequence: GACAGCTT
gaggggttcatgtgcatctg

SEQ ID NO: 35912 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
atgccagcagaaggaactaa

SEQ ID NO: 35913 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
gctggtgcccagccagaccc

SEQ ID NO: 35914 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
acacccaatggtgtcaccaa

SEQ ID NO: 35915 - DNA, 20 bp, Artificial Sequence
  Description of Artificial Sequence: Synthetic oligonucleotide
  Target: ATXN1; (+) strand; PAM type: NNNNGHTT; PAM sequence: AACAGATT
ctatagcagcctcatgcaaa

SEQ ID NO: 35916 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
tactaagaagataaaccctc

SEQ ID NO: 35917 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
tgttattcattaaaaaaaaa

SEQ ID NO: 35918 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
tcaggagggtgagacaggag

SEQ ID NO: 35919 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
ctccgtctcaaaaaaaaaaa

SEQ ID NO: 35920 - DNA, 20 bp, Artificial Sequence
  Description of Artificial Sequence: Synthetic oligonucleotide
  Target: ATXN1; (+) strand; PAM type: NNNNGHTT; PAM sequence: GAGTGTTT
tcactgctgtagtgttatga

SEQ ID NO: 35921 - DNA, 20 bp, Artificial Sequence
  Description of Artificial Sequence: Synthetic oligonucleotide
  Target: ATXN1; (+) strand; PAM type: NNNNGHTT; PAM sequence: CATTGTTT
gccattatataattcttggc

SEQ ID NO: 35922 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
ccattgtatatgtatctgtg

SEQ ID NO: 35923 - DNA, 20 bp, Artificial Sequence
  Description of Artificial Sequence: Synthetic oligonucleotide
  Target: ATXN1; (+) strand; PAM type: NNNNGHTT; PAM sequence: CGGTGCTT
aaaccaataaaagcatcatc

SEQ ID NO: 35924 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
gtgcttctcaaagccaaagg

SEQ ID NO: 35925 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
atgattttggagcaacacat

SEQ ID NO: 35926 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
ataaatgggtagcctaaaag

SEQ ID NO: 35927 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
taaaaggaatgctttgaaca

SEQ ID NO: 35928 - DNA, 20 bp, Artificial Sequence
  Description of Artificial Sequence: Synthetic oligonucleotide
  Target: ATXN1; (+) strand; PAM type: NNNNGHTT; PAM sequence: GTCTGATT
gaacagaatgcttcactatt

SEQ ID NO: 35929 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
atttaaaactccaacaaagg

SEQ ID NO: 35930 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
aaggattattcttctaaggt

SEQ ID NO: 35931 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
cttctaaggttcaagattcg

SEQ ID NO: 35932 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
gccactattttatgtctgta

SEQ ID NO: 35933 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
gtcactacccattcaacaac

SEQ ID NO: 35934 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
ctacccattcaacaacaaat

SEQ ID NO: 35935 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
aaacagcctcaaaatacttt

SEQ ID NO: 35936 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
cagcaacttcaatcattccc

SEQ ID NO: 35937 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
actagaaactcaagtaattc

SEQ ID NO: 35938 - DNA, 20 bp, Artificial Sequence
  Description of Artificial Sequence: Synthetic oligonucleotide
  Target: ATXN1; (+) strand; PAM type: NNNNGHTT; PAM sequence: TTAGGCTT
taacaaaggaggcataacaa

SEQ ID NO: 35939 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
atgggtacctagctggtaaa

SEQ ID NO: 35940 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
tggtaagaggtgggtggggt

SEQ ID NO: 35941 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
tccaggatttccaggggact

SEQ ID NO: 35942 - DNA, 20 bp, Artificial Sequence
  Description of Artificial Sequence: Synthetic oligonucleotide
  Target: ATXN1; (+) strand; PAM type: NNNNGHTT; PAM sequence: CGGAGCTT
aatggcgtgaacccaggagg

SEQ ID NO: 35943 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gaggcggagcttgcagtgag

SEQ ID NO: 35944 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
tctcaaaaaagaaaaaatca

SEQ ID NO: 35945 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
tccagagtagaaatacaagt

SEQ ID NO: 35946 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
ggttctcaaatcataaatct

SEQ ID NO: 35947 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
gtgcctccccattgggcccc

SEQ ID NO: 35948 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
tgaacaccagtgaaacacca

SEQ ID NO: 35949 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
caatatgaatacacttcagt

SEQ ID NO: 35950 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
accaaaaaaaatccatactt

SEQ ID NO: 35951 - DNA, 20 bp, Artificial Sequence
  Description of Artificial Sequence: Synthetic oligonucleotide
  Target: ATXN1; (+) strand; PAM type: NNNNGHTT; PAM sequence: TTAAGCTT
ctttaaagcttttaattttt

SEQ ID NO: 35952 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtacaga

SEQ ID NO: 35953 - DNA, 20 bp, Artificial Sequence
  Description of Artificial Sequence: Synthetic oligonucleotide
  Target: ATXN1; (+) strand; PAM type: NNNNGHTT; PAM sequence: ACCCGCTT
atctcttgacctcatgaacc

SEQ ID NO: 35954 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
cgcttcggcctcccaaagtg

SEQ ID NO: 35955 - DNA, 20 bp, Artificial Sequence
  Description of Artificial Sequence: Synthetic oligonucleotide
  Target: ATXN1; (+) strand; PAM type: NNNNGHTT; PAM sequence: GCAAGCTT
aggtaacgtctcctactttt

SEQ ID NO: 35956 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
ctcctacttttgcaagcttc

SEQ ID NO: 35957 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
aagcttcttttgcttcctat

SEQ ID NO: 35958 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
aaggcttgccataaagatag

SEQ ID NO: 35959 - DNA, 20 bp, Artificial Sequence
  Description of Artificial Sequence: Synthetic oligonucleotide
  Target: ATXN1; (+) strand; PAM type: NNNNGHTT; PAM sequence: CTGAGCTT
accatggacaggctatgtaa

SEQ ID NO: 35960 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aattatgagataatgatata

SEQ ID NO: 35961 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
taaaagataaaagcagccga

SEQ ID NO: 35962 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
cctcactgggacctgggaca

SEQ ID NO: 35963 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
cctgggacagcatgattctt

SEQ ID NO: 35964 - DNA, 20 bp, Artificial Sequence
  Description of Artificial Sequence: Synthetic oligonucleotide
  Target: ATXN1; (+) strand; PAM type: NNNNGHTT; PAM sequence: GAGAGCTT
catgattcttaccagtttct

SEQ ID NO: 35965 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
cagttaccattctcctttcc

SEQ ID NO: 35966 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
ccctggcttttctccttcca

SEQ ID NO: 35967 - DNA, 20 bp, Artificial Sequence
  Description of Artificial Sequence: Synthetic oligonucleotide
  Target: ATXN1; (+) strand; PAM type: NNNNGHTT; PAM sequence: GAGTGCTT
agttgagtgtacacagcctt

SEQ ID NO: 35968 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
acacagttccataaggaaag

SEQ ID NO: 35969 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
tggggtgagctcgccaaaag

SEQ ID NO: 35970 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
tcaaatacaaaaacactggc

SEQ ID NO: 35971 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
ttaccacaagaaaagacgcg

SEQ ID NO: 35972 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
gtggggatgaggacagtggc

SEQ ID NO: 35973 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
tatgagttcctgggtctcta

SEQ ID NO: 35974 - DNA, 20 bp, Artificial Sequence
  Description of Artificial Sequence: Synthetic oligonucleotide
  Target: ATXN1; (+) strand; PAM type: NNNNGHTT; PAM sequence: TAAGGCTT
ttatcttgtcctctcatgga

SEQ ID NO: 35975 - DNA, 20 bp, Artificial Sequence
  Description of Artificial Sequence: Synthetic oligonucleotide
  Target: ATXN1; (+) strand; PAM type: NNNNGHTT; PAM sequence: GGGGGATT
atggataaggcttcgtaaag

SEQ ID NO: 35976 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
aaacgatggaaagcagatgg

SEQ ID NO: 35977 - DNA, 20 bp, Artificial Sequence
  Description of Artificial Sequence: Synthetic oligonucleotide
  Target: ATXN1; (+) strand; PAM type: NNNNGHTT; PAM sequence: CATTGCTT
actgactgaggtggtaggac

SEQ ID NO: 35978 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
aagttgttcctcttcagaca

SEQ ID NO: 35979 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ttcctcttcagacaactgga

SEQ ID NO: 35980 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
ttttttttttttttttttag

SEQ ID NO: 35981 - DNA, 20 bp, Artificial Sequence
  Description of Artificial Sequence: Synthetic oligonucleotide
  Target: ATXN1; (+) strand; PAM type: NNNNGHTT; PAM sequence: GCTTGCTT
ttttttttttttttagacag

SEQ ID NO: 35982 - DNA, 20 bp, Artificial Sequence
  Description of Artificial Sequence: Synthetic oligonucleotide
  Target: ATXN1; (+) strand; PAM type: NNNNGHTT; PAM sequence: GGCTGATT
aggcacacatcaccatgcct

SEQ ID NO: 35983 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
gccctaagcaatcctcccac

SEQ ID NO: 35984 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
ccactgcacccagctgacca

SEQ ID NO: 35985 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
gactgttagatgtgggaatc

SEQ ID NO: 35986 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
aaattatagtcttttacgtg

SEQ ID NO: 35987 - DNA, 20 bp, Artificial Sequence
  Description of Artificial Sequence: Synthetic oligonucleotide
  Target: ATXN1; (+) strand; PAM type: NNNNGHTT; PAM sequence: ATCCGATT
tagtggatcatgaactacgt

SEQ ID NO: 35988 - DNA, 20 bp, Artificial Sequence
  Description of Artificial Sequence: Synthetic oligonucleotide
  Target: ATXN1; (+) strand; PAM type: NNNNGHTT; PAM sequence: CAACGCTT
cttgaggagatcccttacgc

SEQ ID NO: 35989 - DNA, 20 bp, Artificial Sequence
  Description of Artificial Sequence: Synthetic oligonucleotide
  Target: ATXN1; (+) strand; PAM type: NNNNGHTT; PAM sequence: CGAGGCTT
cacttcacagatgtagacac

SEQ ID NO: 35990 - DNA, 20 bp, Artificial Sequence
  Description of Artificial Sequence: Synthetic oligonucleotide
  Target: ATXN1; (+) strand; PAM type: NNNNGHTT; PAM sequence: ACTAGTTT
tttcccaaggccacaagagg

SEQ ID NO: 35991 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
aggactagtttacagcagag

SEQ ID NO: 35992 - DNA, 20 bp, Artificial Sequence
  Description of Artificial Sequence: Synthetic oligonucleotide
  Target: ATXN1; (+) strand; PAM type: NNNNGHTT; PAM sequence: CAGGGATT
catgggggaagaggtatgct

SEQ ID NO: 35993 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
aactaccatctctctcagta

SEQ ID NO: 35994 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
agtgaccctaggatgagcct

SEQ ID NO: 35995 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
tgagaccctaactttacaaa

SEQ ID NO: 35996 - DNA, 20 bp, Artificial Sequence
  Description of Artificial Sequence: Synthetic oligonucleotide
  Target: ATXN1; (+) strand; PAM type: NNNNGHTT; PAM sequence: GATCGCTT
tcaggaggatgaggtggggg

SEQ ID NO: 35997 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
atgcaggggataatgggcag

SEQ ID NO: 35998 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ggggataatgggcagccctg

SEQ ID NO: 35999 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
ataatgggcagccctgtttt

SEQ ID NO: 36000 - DNA, 20 bp, Artificial Sequence
  Description of Artificial Sequence: Synthetic oligonucleotide
  Target: ATXN1; (+) strand; PAM type: NNNNGHTT; PAM sequence: GTTCGTTT
cagccctgttttgtttgttt

SEQ ID NO: 36001 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
cctgttttgtttgtttgttc

SEQ ID NO: 36002 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
tgtttgtttgttcgtttgtt

SEQ ID NO: 36003 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tgttcgtttgtttgtggttt

SEQ ID NO: 36004 - DNA, 20 bp, Artificial Sequence
  Description of Artificial Sequence: Synthetic oligonucleotide
  Target: ATXN1; (+) strand; PAM type: NNNNGHTT; PAM sequence: GTGGGTTT
tgtttgtggtttttttgttt

SEQ ID NO: 36005 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
gacctccgactcctgggttc

SEQ ID NO: 36006 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 36007 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcctcagcctcccgaagtg

SEQ ID NO: 36008 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
gttgtgtgtgtgtgtgtgtg

SEQ ID NO: 36009 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
tgtgtgtgtgtgtgtgtgtt

SEQ ID NO: 36010 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
tgtgtgtgtgtgtgttgttt

SEQ ID NO: 36011 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctctgcctcccgggttc

SEQ ID NO: 36012 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagtag

SEQ ID NO: 36013 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
catgcgccaacatgcccagc

SEQ ID NO: 36014 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 36015 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
tttagtagagatggggtttc

SEQ ID NO: 36016 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
cgccttggcctcccaaagtg

SEQ ID NO: 36017 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
aagttataccctctctaagc

SEQ ID NO: 36018 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
tgcaagtgagacaatcagac

SEQ ID NO: 36019 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
gatattgcgctgcatggtaa

SEQ ID NO: 36020 - DNA, 20 bp, Artificial Sequence
  Description of Artificial Sequence: Synthetic oligonucleotide
  Target: ATXN1; (+) strand; PAM type: NNNNGHTT; PAM sequence: GCCTGTTT
agggaagttctaagagtgaa

SEQ ID NO: 36021 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
gtcaactgttgaaaaccact

SEQ ID NO: 36022 - DNA, 20 bp, Artificial Sequence
  Description of Artificial Sequence: Synthetic oligonucleotide
  Target: ATXN1; (+) strand; PAM type: NNNNGHTT; PAM sequence: ACGTGCTT
caaggcatccgaggaaaaag

SEQ ID NO: 36023 - DNA, 20 bp, Artificial Sequence
  Description of Artificial Sequence: Synthetic oligonucleotide
  Target: ATXN1; (+) strand; PAM type: NNNNGHTT; PAM sequence: ATAGGATT
cctcaatcggtggtgagaca

SEQ ID NO: 36024 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
tggagaaaaaagtctgcagt

SEQ ID NO: 36025 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
atgacattggagtgggagcc

SEQ ID NO: 36026 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
cactggctttacctgcaagc

SEQ ID NO: 36027 - DNA, 20 bp, Artificial Sequence
  Description of Artificial Sequence: Synthetic oligonucleotide
  Target: ATXN1; (+) strand; PAM type: NNNNGHTT; PAM sequence: ACTTGATT
cctaccctctgcccatgcac

SEQ ID NO: 36028 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
tcttcttaattttgactaca

SEQ ID NO: 36029 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
agacgtgtgacactattatt

SEQ ID NO: 36030 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
agagcgcctgcaaggatcac

SEQ ID NO: 36031 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
gaccattacagggatacagg

SEQ ID NO: 36032 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
aaattcacattcctctccat

SEQ ID NO: 36033 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
ggctgaatcagaaatgtgtg

SEQ ID NO: 36034 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
gcactgtgagaagaaacaag

SEQ ID NO: 36035 - DNA, 20 bp, Artificial Sequence
  Description of Artificial Sequence: Synthetic oligonucleotide
  Target: ATXN1; (+) strand; PAM type: NNNNGHTT; PAM sequence: GGGGGCTT
aatgcatcctctgctacaaa

SEQ ID NO: 36036 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
agaaccactgtctcttgcac

SEQ ID NO: 36037 - DNA, 20 bp, Artificial Sequence
  Description of Artificial Sequence: Synthetic oligonucleotide
  Target: ATXN1; (+) strand; PAM type: NNNNGHTT; PAM sequence: TAGAGATT
catgcaaggaagaaccccaa

SEQ ID NO: 36038 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
acatttttaagaacaaagcc

SEQ ID NO: 36039 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
ccaacctttccctaatggta

SEQ ID NO: 36040 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
cagacccaaaactggcaaca

SEQ ID NO: 36041 - DNA, 20 bp, Artificial Sequence
  Description of Artificial Sequence: Synthetic oligonucleotide
  Target: ATXN1; (+) strand; PAM type: NNNNGHTT; PAM sequence: AGACGATT
atccaagaaataaaggaaga

SEQ ID NO: 36042 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
atttactactggaaatagaa

SEQ ID NO: 36043 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
agaaacaagtttcagacaag

SEQ ID NO: 36044 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
caccaacttacaaaaaaaaa

SEQ ID NO: 36045 - DNA, 20 bp, Artificial Sequence
  Description of Artificial Sequence: Synthetic oligonucleotide
  Target: ATXN1; (+) strand; PAM type: NNNNGHTT; PAM sequence: GACTGATT
aattaggattttttttcaat

SEQ ID NO: 36046 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
aggaagccaacatagagata

SEQ ID NO: 36047 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
gtcaccaaggtggaaaaaaa

SEQ ID NO: 36048 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
acaataaagaaaaggggtag

SEQ ID NO: 36049 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
tgctttaaaacagttcacaa

SEQ ID NO: 36050 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
aactttgggaggccgaggtg

SEQ ID NO: 36051 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttgggaggccgaggtgggag

SEQ ID NO: 36052 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
tgggaggattgcttgaggcc

SEQ ID NO: 36053 - DNA, 20 bp, Artificial Sequence
  Description of Artificial Sequence: Synthetic oligonucleotide
  Target: ATXN1; (+) strand; PAM type: NNNNGHTT; PAM sequence: GCCAGCTT
acagggaggaggtatggtca

SEQ ID NO: 36054 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
tcaaatttaagaagacaact

SEQ ID NO: 36055 - DNA, 20 bp, Artificial Sequence
  Description of Artificial Sequence: Synthetic oligonucleotide
  Target: ATXN1; (+) strand; PAM type: NNNNGHTT; PAM sequence: ATTCGTTT
aacattgaagacaggtatta

SEQ ID NO: 36056 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
agaaacccataaaagttaca

SEQ ID NO: 36057 - DNA, 20 bp, Artificial Sequence
  Description of Artificial Sequence: Synthetic oligonucleotide
  Target: ATXN1; (+) strand; PAM type: NNNNGHTT; PAM sequence: GACAGTTT
gaaactgcacatttagaagt

SEQ ID NO: 36058 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
aatatataaagaaaataaaa

SEQ ID NO: 36059 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtatttttagtagaga

SEQ ID NO: 36060 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaaagtg

SEQ ID NO: 36061 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
cagatctgatgacaagataa

SEQ ID NO: 36062 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
ctgatgacaagataagcctg

SEQ ID NO: 36063 - DNA, 20 bp, Artificial Sequence
  Description of Artificial Sequence: Synthetic oligonucleotide
  Target: ATXN1; (+) strand; PAM type: NNNNGHTT; PAM sequence: GGCAGCTT
aaattatgtatcaaagtgta

SEQ ID NO: 36064 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
ggcaggcagatcacgaggtc

SEQ ID NO: 36065 - DNA, 20 bp, Artificial Sequence
  Description of Artificial Sequence: Synthetic oligonucleotide
  Target: ATXN1; (+) strand; PAM type: NNNNGHTT; PAM sequence: CGGAGCTT
aatggcgtgaacccgggaag

SEQ ID NO: 36066 - DNA, 20 bp, Artificial Sequence
  Description of Artificial Sequence: Synthetic oligonucleotide
  Target: ATXN1; (+) strand; PAM type: NNNNGHTT; PAM sequence: CCGAGATT
gaagcggagcttgcagtgag

SEQ ID NO: 36067 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tatattttaaaatatataca

SEQ ID NO: 36068 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
gttttaaaatatatacaaaa

SEQ ID NO: 36069 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
tgacttactgctagctaatc

SEQ ID NO: 36070 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
aataaattcacaaatattga

SEQ ID NO: 36071 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
gtggctcacacctgtaatcc

SEQ ID NO: 36072 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
ccatgctttgggaggctgag

SEQ ID NO: 36073 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
gaggcaggattgctcaaggc

SEQ ID NO: 36074 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
ctacttgggaggctgaggcg

SEQ ID NO: 36075 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttgggaggctgaggcgggag

SEQ ID NO: 36076 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
caaattttctagaaacatta

SEQ ID NO: 36077 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
agacaaacttttaggggtgg

SEQ ID NO: 36078 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
actttggggacaggtaattt

SEQ ID NO: 36079 - DNA, 20 bp, Artificial Sequence
  Description of Artificial Sequence: Synthetic oligonucleotide
  Target: ATXN1; (+) strand; PAM type: NNNNGHTT; PAM sequence: GAGCGATT
ctccttgaggcaactcagag

SEQ ID NO: 36080 - DNA, 20 bp, Artificial Sequence
  Description of Artificial Sequence: Synthetic oligonucleotide
  Target: ATXN1; (+) strand; PAM type: NNNNGHTT; PAM sequence: GTCAGCTT
aatttccgaagctgctatat

SEQ ID NO: 36081 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
tgcccatttgtatggaattt

SEQ ID NO: 36082 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
aagggagaactgttactatc

SEQ ID NO: 36083 - DNA, 20 bp, Artificial Sequence
  Description of Artificial Sequence: Synthetic oligonucleotide
  Target: ATXN1; (+) strand; PAM type: NNNNGHTT; PAM sequence: CCCCGCTT
tatcagaggcttctggaaat

SEQ ID NO: 36084 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
tctcagttctttctttctct

SEQ ID NO: 36085 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
atcattatcaaagcggccaa

SEQ ID NO: 36086 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
taaaagttaaaaacaagagt

SEQ ID NO: 36087 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
cgggtggatcacttgaggtc

SEQ ID NO: 36088 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
caaattttctagaaacatta

SEQ ID NO: 36089 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
agacaaacttttaggggtgg

SEQ ID NO: 36090 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
actttggggacaggtaattt

SEQ ID NO: 36091 - DNA, 20 bp, Artificial Sequence
  Description of Artificial Sequence: Synthetic oligonucleotide
  Target: ATXN1; (+) strand; PAM type: NNNNGHTT; PAM sequence: GAGCGATT
ctccttgaggcaactcagag

SEQ ID NO: 36092 - DNA, 20 bp, Artificial Sequence
  Description of Artificial Sequence: Synthetic oligonucleotide
  Target: ATXN1; (+) strand; PAM type: NNNNGHTT; PAM sequence: GTCAGCTT
aatttccgaagctgctatat

SEQ ID NO: 36093 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
tgcccatttgtatggaattt

SEQ ID NO: 36094 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
aagggagaactgttactatc

SEQ ID NO: 36095 - DNA, 20 bp, Artificial Sequence
  Description of Artificial Sequence: Synthetic oligonucleotide
  Target: ATXN1; (+) strand; PAM type: NNNNGHTT; PAM sequence: CCCCGCTT
tatcagaggcttctggaaat

SEQ ID NO: 36096 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
tctcagttctttctttctct

SEQ ID NO: 36097 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
atcattatcaaagcggccaa

SEQ ID NO: 36098 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
taaaagttaaaaacaagagt

SEQ ID NO: 36099 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
cgggtggatcacttgaggtc

SEQ ID NO: 36100 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
tgggtggctcacctgaggtc

SEQ ID NO: 36101 - DNA, 20 bp, Artificial Sequence
  Description of Artificial Sequence: Synthetic oligonucleotide
  Target: ATXN1; (+) strand; PAM type: NNNNGHTT; PAM sequence: AATAGTTT
cacacttacatagacatact

SEQ ID NO: 36102 - DNA, 20 bp, Artificial Sequence
  Description of Artificial Sequence: Synthetic oligonucleotide
  Target: ATXN1; (+) strand; PAM type: NNNNGHTT; PAM sequence: CACGGTTT
tacagtagtctccccatagc

SEQ ID NO: 36103 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
tagtctccccatagccacgg

SEQ ID NO: 36104 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
atagccacggttttgctttc

SEQ ID NO: 36105 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
tatttttatataagtatttt

SEQ ID NO: 36106 - DNA, 20 bp, Artificial Sequence
  Description of Artificial Sequence: Synthetic oligonucleotide
  Target: ATXN1; (+) strand; PAM type: NNNNGHTT; PAM sequence: TAGGGTTT
aggaaaaaacacaatctata

SEQ ID NO: 36107 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
tatagggtttggtactaact

SEQ ID NO: 36108 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
ggactactgtataaggaaaa

SEQ ID NO: 36109 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
tctaaagaaaacaagaactg

SEQ ID NO: 36110 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
aattaaattttattttgaaa

SEQ ID NO: 36111 - DNA, 20 bp, Artificial Sequence
  Description of Artificial Sequence: Synthetic oligonucleotide
  Target: ATXN1; (+) strand; PAM type: NNNNGHTT; PAM sequence: TAAGGCTT
aatatcaagataacagaata

SEQ ID NO: 36112 - DNA, 20 bp, Artificial Sequence
  Description of Artificial Sequence: Synthetic oligonucleotide
  Target: ATXN1; (+) strand; PAM type: NNNNGHTT; PAM sequence: CGGAGCTT
aatggcctgaacccgtgagg

SEQ ID NO: 36113 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
aaaaaaaaaaagaaatatac

SEQ ID NO: 36114 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
tactcatgtttctaaaaaca

SEQ ID NO: 36115 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
ttatctgaccctagtgaatg

SEQ ID NO: 36116 - DNA, 20 bp, Artificial Sequence
  Description of Artificial Sequence: Synthetic oligonucleotide
  Target: ATXN1; (+) strand; PAM type: NNNNGHTT; PAM sequence: GGGAGTTT
gcatgttctcactcataagt

SEQ ID NO: 36117 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
agacaaataccgaatgcatg

SEQ ID NO: 36118 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tctggaggctgaagcaggag

SEQ ID NO: 36119 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
cgtctcaaaaaaaaaaaaaa

SEQ ID NO: 36120 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
acactttttgaaaattatta

SEQ ID NO: 36121 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
tatgcttgactacacagata

SEQ ID NO: 36122 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
tttttaacttatcaaattgg

SEQ ID NO: 36123 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
acttatcaaattggcagagt

SEQ ID NO: 36124 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
atcaaattggcagagttttt

SEQ ID NO: 36125 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
ggaaaattaaatgctagata

SEQ ID NO: 36126 - DNA, 20 bp, Artificial Sequence
  Description of Artificial Sequence: Synthetic oligonucleotide
  Target: ATXN1; (+) strand; PAM type: NNNNGHTT; PAM sequence: GTGGGCTT
aggccctaagatcacactgt

SEQ ID NO: 36127 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
ggcttgaaaatcacacagca

SEQ ID NO: 36128 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
tctgcattcttttctgtatt

SEQ ID NO: 36129 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
tggggcatgccctggagtca

SEQ ID NO: 36130 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
catgccctggagtcagactg

SEQ ID NO: 36131 - DNA, 20 bp, Artificial Sequence
  Description of Artificial Sequence: Synthetic oligonucleotide
  Target: ATXN1; (+) strand; PAM type: NNNNGHTT; PAM sequence: GATCGCTT
acaggaggctgaggggcaag

SEQ ID NO: 36132 - DNA, 20 bp, Artificial Sequence
  Description of Artificial Sequence: Synthetic oligonucleotide
  Target: ATXN1; (+) strand; PAM type: NNNNGHTT; PAM sequence: AGTTGCTT
aagatctgccaccttgggca

SEQ ID NO: 36133 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
ctcattatatattagtatta

SEQ ID NO: 36134 - DNA, 20 bp, Artificial Sequence
  Description of Artificial Sequence: Synthetic oligonucleotide
  Target: ATXN1; (+) strand; PAM type: NNNNGHTT; PAM sequence: TATCGTTT
caattctccagatattgtgc

SEQ ID NO: 36135 - DNA, 20 bp, Artificial Sequence
  Description of Artificial Sequence: Synthetic oligonucleotide
  Target: ATXN1; (+) strand; PAM type: NNNNGHTT; PAM sequence: GGTTGTTT
tatcttttttcaacatctct

SEQ ID NO: 36136 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
cacagacagagagagagaga

SEQ ID NO: 36137 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
tgcatctttaaggagatcat

SEQ ID NO: 36138 - DNA, 20 bp, Artificial Sequence
  Description of Artificial Sequence: Synthetic oligonucleotide
  Target: ATXN1; (+) strand; PAM type: NNNNGHTT; PAM sequence: AAAGGCTT
ggcccatatatgccccccca

SEQ ID NO: 36139 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
aagtgccaaggaggatgcca

SEQ ID NO: 36140 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
caacctcagctctgaacatt

SEQ ID NO: 36141 - DNA, 20 bp, Artificial Sequence
  Description of Artificial Sequence: Synthetic oligonucleotide
  Target: ATXN1; (+) strand; PAM type: NNNNGHTT; PAM sequence: GTGGGCTT
tgttttatttcaactccaaa

SEQ ID NO: 36142 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
ttcctggcatccatgaaagc

SEQ ID NO: 36143 - DNA, 20 bp, Artificial Sequence
  Description of Artificial Sequence: Synthetic oligonucleotide
  Target: ATXN1; (+) strand; PAM type: NNNNGHTT; PAM sequence: CGCAGATT
tgtagaaagagacaaatgag

SEQ ID NO: 36144 - DNA, 20 bp, Artificial Sequence
  Description of Artificial Sequence: Synthetic oligonucleotide
  Target: ATXN1; (+) strand; PAM type: NNNNGHTT; PAM sequence: ACCTGCTT
cttgtcggctgctctcacag

SEQ ID NO: 36145 - DNA, 20 bp, Artificial Sequence
  Description of Artificial Sequence: Synthetic oligonucleotide
  Target: ATXN1; (+) strand; PAM type: NNNNGHTT; PAM sequence: TGAGGCTT
atcccagctactagggaggc

SEQ ID NO: 36146 - DNA, 20 bp, Artificial Sequence
  Description of Artificial Sequence: Synthetic oligonucleotide
  Target: ATXN1; (+) strand; PAM type: NNNNGHTT; PAM sequence: GCGAGATT
actccagcctgggagacaga

SEQ ID NO: 36147 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
aaagtggagtagttaagaca

SEQ ID NO: 36148 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
caggctttggtgtcaggcac

SEQ ID NO: 36149 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
aagctgggtaaatgtgggcg

SEQ ID NO: 36150 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
gcattcattcacttgatgat

SEQ ID NO: 36151 - DNA, 20 bp, Artificial Sequence
  Description of Artificial Sequence: Synthetic oligonucleotide
  Target: ATXN1; (+) strand; PAM type: NNNNGHTT; PAM sequence: GTGAGCTT
atgatcactgattatgatca

SEQ ID NO: 36152 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
gagcttctaggtgtgacagg

SEQ ID NO: 36153 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
gtgacagatgtaagcatggg

SEQ ID NO: 36154 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
gcaaagaccctgagggagga

SEQ ID NO: 36155 - DNA, 20 bp, Artificial Sequence
  Description of Artificial Sequence: Synthetic oligonucleotide
  Target: ATXN1; (+) strand; PAM type: NNNNGHTT; PAM sequence: AGGAGCTT
catgtttgcattaaacggta

SEQ ID NO: 36156 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
tcaatctaacatcattcaag

SEQ ID NO: 36157 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
aaagtaagagtgttctgcat

SEQ ID NO: 36158 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
ttttacccagccatctttct

SEQ ID NO: 36159 - DNA, 20 bp, Artificial Sequence
  Description of Artificial Sequence: Synthetic oligonucleotide
  Target: ATXN1; (+) strand; PAM type: NNNNGHTT; PAM sequence: GGTAGCTT
ttaaaatggcagaaatagct

SEQ ID NO: 36160 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
gagttctaatccatgtcttt

SEQ ID NO: 36161 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
tcagggtgaaattccacttt

SEQ ID NO: 36162 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
tttttctgcaacgtaacttt

SEQ ID NO: 36163 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
atgtatctatattgctccta

SEQ ID NO: 36164 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
tgtcatttgatcatatcata

SEQ ID NO: 36165 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
ttcactttaataaacattca

SEQ ID NO: 36166 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
ttaataaacattcaagtagt

SEQ ID NO: 36167 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
ctgagtcacagggtatacac

SEQ ID NO: 36168 - DNA, 20 bp, Artificial Sequence
  Description of Artificial Sequence: Synthetic oligonucleotide
  Target: ATXN1; (+) strand; PAM type: NNNNGHTT; PAM sequence: TATCGCTT
agtcaagtgtcagttccatc

SEQ ID NO: 36169 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
agacatttaaattaaagcaa

SEQ ID NO: 36170 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
gtgtctgagaactaaggaaa

SEQ ID NO: 36171 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
tgagaactaaggaaaaaagg

SEQ ID NO: 36172 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
gactaaaaaccattcaattc

SEQ ID NO: 36173 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
gtcataaaaggacaaatact

SEQ ID NO: 36174 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
gaaatggaaaagcagttgcc

SEQ ID NO: 36175 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
tgggcagatcacctgaggtc

SEQ ID NO: 36176 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
gtatgccttttgccacaatg

SEQ ID NO: 36177 - DNA, 20 bp, Artificial Sequence
  Description of Artificial Sequence: Synthetic oligonucleotide
  Target: ATXN1; (+) strand; PAM type: NNNNGHTT; PAM sequence: CGGTGTTT
ttacttaaaagcaaaagtgg

SEQ ID NO: 36178 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
taaaagcaaaagtggcggtg

SEQ ID NO: 36179 - DNA, 20 bp, Artificial Sequence
  Description of Artificial Sequence: Synthetic oligonucleotide
  Target: ATXN1; (+) strand; PAM type: NNNNGHTT; PAM sequence: CATAGATT
taatcatatacattctgcac

SEQ ID NO: 36180 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
cacaacgactctgcaaaaac

SEQ ID NO: 36181 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
cgaggggactgagtcacact

SEQ ID NO: 36182 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
tcctgaattttttgacttct

SEQ ID NO: 36183 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
tgtttaaattctcatcaaac

SEQ ID NO: 36184 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
catcaaactgcagcttcaac

SEQ ID NO: 36185 - DNA, 20 bp, Artificial Sequence
  Description of Artificial Sequence: Synthetic oligonucleotide
  Target: ATXN1; (+) strand; PAM type: NNNNGHTT; PAM sequence: CATCGCTT
ctgccactgatcgcagaatg

SEQ ID NO: 36186 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
cgtaatctctaccatgaaat

SEQ ID NO: 36187 - DNA, 20 bp, Artificial Sequence
  Description of Artificial Sequence: Synthetic oligonucleotide
  Target: ATXN1; (+) strand; PAM type: NNNNGHTT; PAM sequence: CAACGATT
aatgttaaataaaaaactgt

SEQ ID NO: 36188 - DNA, 20 bp, Artificial Sequence
  Description of Artificial Sequence: Synthetic oligonucleotide
  Target: ATXN1; (+) strand; PAM type: NNNNGHTT; PAM sequence: CTATGATT
gttcaccttaattcacttct

SEQ ID NO: 36189 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
tgattctataatgaaggcag

SEQ ID NO: 36190 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
atgtctatgcaataacctgt

SEQ ID NO: 36191 - DNA, 20 bp, Artificial Sequence
  Description of Artificial Sequence: Synthetic oligonucleotide
  Target: ATXN1; (+) strand; PAM type: NNNNGHTT; PAM sequence: TAGGGATT
caggccatcctggagggggc

SEQ ID NO: 36192 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
tgaccatggtgttcctgctc

SEQ ID NO: 36193 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
gttcctgctcagaagcttac

SEQ ID NO: 36194 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
tgctactagatgataaaaat

SEQ ID NO: 36195 - DNA, 20 bp, Artificial Sequence
  Description of Artificial Sequence: Synthetic oligonucleotide
  Target: ATXN1; (+) strand; PAM type: NNNNGHTT; PAM sequence: GAGTGATT
tggaagatgtgaattaaaac

SEQ ID NO: 36196 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
atagaaatggcactcgtact

SEQ ID NO: 36197 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
ggaactgggtctcttttatt

SEQ ID NO: 36198 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
agacttggtaaccaatataa

SEQ ID NO: 36199 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
atttatttatttactttatt

SEQ ID NO: 36200 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
cctctctgcctcccaggttc

SEQ ID NO: 36201 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagcag

SEQ ID NO: 36202 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
caccaccatgcccagctaat

SEQ ID NO: 36203 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtttttttagtagaga

SEQ ID NO: 36204 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
cacctcggcctcccaaagta

SEQ ID NO: 36205 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
ggcatgagccactgcgccca

SEQ ID NO: 36206 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
catgtgttgaagccctaact

SEQ ID NO: 36207 - DNA, 20 bp, Artificial Sequence
  Description of Artificial Sequence: Synthetic oligonucleotide
  Target: ATXN1; (+) strand; PAM type: NNNNGHTT; PAM sequence: ATAAGTTT
gtctctagaatcataagaaa

SEQ ID NO: 36208 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
atcataagaaaataagtttg

SEQ ID NO: 36209 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
caaactgacagatactaagc

SEQ ID NO: 36210 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
ctctttcctcctttaaatat

SEQ ID NO: 36211 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
aagtttagatcacatgagct

SEQ ID NO: 36212 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
gagagatggcacagaggtgt

SEQ ID NO: 36213 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
aggcctcccaaacacttccc

SEQ ID NO: 36214 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
ggtgggcgggtcacgaggtc

SEQ ID NO: 36215 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tcgggaggctgaggcaggag

SEQ ID NO: 36216 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
ttctcctgcaatattagcac

SEQ ID NO: 36217 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
ctccaaattcaatgtgaatt

SEQ ID NO: 36218 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
aattcaatgtgaatttttgg

SEQ ID NO: 36219 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
gtgaatttttggttttgatt

SEQ ID NO: 36220 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
ttggttttgatttttggttt

SEQ ID NO: 36221 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
ttttgatttttggtttattt

SEQ ID NO: 36222 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
atttttggtttatttgtttg

SEQ ID NO: 36223 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tggtttatttgtttgttttg

SEQ ID NO: 36224 - DNA, 20 bp, Artificial Sequence
  Description of Artificial Sequence: Synthetic oligonucleotide
  Target: ATXN1; (+) strand; PAM type: NNNNGHTT; PAM sequence: CCCCGTTT
ccacgtgccctcatcaaaat

SEQ ID NO: 36225 - DNA, 20 bp, Artificial Sequence
  Description of Artificial Sequence: Synthetic oligonucleotide
  Target: ATXN1; (+) strand; PAM type: NNNNGHTT; PAM sequence: TTAAGCTT
tctttaaaataacctatttc

SEQ ID NO: 36226 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
ttaggttcaggggtacatgt

SEQ ID NO: 36227 - DNA, 20 bp, Artificial Sequence
  Description of Artificial Sequence: Synthetic oligonucleotide
  Target: ATXN1; (+) strand; PAM type: NNNNGHTT; PAM sequence: GGGGGTTT
aatagataaactcatgccat

SEQ ID NO: 36228 - DNA, 20 bp, Artificial Sequence
  Description of Artificial Sequence: Synthetic oligonucleotide
  Target: ATXN1; (+) strand; PAM type: NNNNGHTT; PAM sequence: GATGGTTT
ccatgggggtttgttgtaca

SEQ ID NO: 36229 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
tactaagcctagtacccaat

SEQ ID NO: 36230 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
gtaagtgagaacatgcagta

SEQ ID NO: 36231 - DNA, 20 bp, Artificial Sequence
  Description of Artificial Sequence: Synthetic oligonucleotide
  Target: ATXN1; (+) strand; PAM type: NNNNGHTT; PAM sequence: GATAGTTT
atttagttttttgttcctgt

SEQ ID NO: 36232 - DNA, 20 bp, Artificial Sequence
  Description of Artificial Sequence: Synthetic oligonucleotide
  Target: ATXN1; (+) strand; PAM type: NNNNGHTT; PAM sequence: GGTTGATT
ctgtcattgatgggcattta

SEQ ID NO: 36233 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
atgtgtctaaatttatggta

SEQ ID NO: 36234 - DNA, 20 bp, Artificial Sequence
  Description of Artificial Sequence: Synthetic oligonucleotide
  Target: ATXN1; (+) strand; PAM type: NNNNGHTT; PAM sequence: ATGGGATT
ctctgggtagatacccagta

SEQ ID NO: 36235 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
attgctgggtcgaatggtag

SEQ ID NO: 36236 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
tggtatgagatagtatctca

SEQ ID NO: 36237 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
gagatagtatctcattgtgc

SEQ ID NO: 36238 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
tctaatgaccagcgatattg

SEQ ID NO: 36239 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccgcgtag

SEQ ID NO: 36240 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
cactcgccaccagcccagct

SEQ ID NO: 36241 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
tttgtattttttagtagaga

SEQ ID NO: 36242 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
ttagtagagatggggtttca

SEQ ID NO: 36243 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
ttgggaggctgaggcaggag

SEQ ID NO: 36244 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
tattataaaggttaagatga

SEQ ID NO: 36245 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
aaatgcttcccaagggcctg

SEQ ID NO: 36246 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
cttgggtgccctcttacact

SEQ ID NO: 36247 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
cacttagtgggctgatcaac

SEQ ID NO: 36248 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
aaggaatctgttcacagaga

SEQ ID NO: 36249 - DNA, 20 bp, Artificial Sequence
  Description of Artificial Sequence: Synthetic oligonucleotide
  Target: ATXN1; (+) strand; PAM type: NNNNGHTT; PAM sequence: GTCAGATT
atgattctaaatacaaaatg

SEQ ID NO: 36250 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
attaatagaaataatattag

SEQ ID NO: 36251 - DNA, 20 bp, Artificial Sequence
  Description of Artificial Sequence: Synthetic oligonucleotide
  Target: ATXN1; (+) strand; PAM type: NNNNGHTT; PAM sequence: GTTGGCTT
aatttcagggatgtctcttt

SEQ ID NO: 36252 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
ggaccctttcattggtaagc

SEQ ID NO: 36253 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
atgtgcagcagtcctgtgag

SEQ ID NO: 36254 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
ctgtgaggcaggattattat

SEQ ID NO: 36255 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
tgttttaaagctgagaaaac

SEQ ID NO: 36256 - DNA, 20 bp, Artificial Sequence
  Description of Artificial Sequence: Synthetic oligonucleotide
  Target: ATXN1; (+) strand; PAM type: NNNNGHTT; PAM sequence: GCTGGATT
aaagacgataaattatggag

SEQ ID NO: 36257 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
aaacacagtggctcaaactc

SEQ ID NO: 36258 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
actctgtggcttcatgaata

SEQ ID NO: 36259 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
actgcattgcaaatctcgct

SEQ ID NO: 36260 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
tgccactcctcattcacatc

SEQ ID NO: 36261 - DNA, 20 bp, Artificial Sequence
  Description of Artificial Sequence: Synthetic oligonucleotide
  Target: ATXN1; (+) strand; PAM type: NNNNGHTT; PAM sequence: AGGTGATT
agcagggttctgaaatccca

SEQ ID NO: 36262 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
cattagaatggctaatcaat

SEQ ID NO: 36263 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gaatggctaatcaataagag

SEQ ID NO: 36264 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
cccaccactttatttcctct

SEQ ID NO: 36265 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
atagggcatgtgatgttaga

SEQ ID NO: 36266 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
gcatcgtagctatggtgggg

SEQ ID NO: 36267 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
cacctgtaaaacaaaagcaa

SEQ ID NO: 36268 - DNA, 20 bp, Artificial Sequence
  Description of Artificial Sequence: Synthetic oligonucleotide
  Target: ATXN1; (+) strand; PAM type: NNNNGHTT; PAM sequence: GGAGGTTT
cttacttcatggggtagtga

SEQ ID NO: 36269 - DNA, 20 bp, Artificial Sequence
  Description of Artificial Sequence: Synthetic oligonucleotide
  Target: ATXN1; (+) strand; PAM type: NNNNGHTT; PAM sequence: CAACGTTT
tcaccctaaaggggaccttg

SEQ ID NO: 36270 - DNA, 20 bp, Artificial Sequence
  Description of Artificial Sequence: Synthetic oligonucleotide
  Target: ATXN1; (+) strand; PAM type: NNNNGHTT; PAM sequence: CTGTGCTT
gagctaaatgctaggtacca

SEQ ID NO: 36271 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
taggtaccactgtgctttcc

SEQ ID NO: 36272 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
aacactgaatctttgctctc

SEQ ID NO: 36273 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
tgaatctttgctctccaaag

SEQ ID NO: 36274 - DNA, 20 bp, Artificial Sequence
  Description of Artificial Sequence: Synthetic oligonucleotide
  Target: ATXN1; (+) strand; PAM type: NNNNGHTT; PAM sequence: GCAAGATT
tttgatttgaattcacacag

SEQ ID NO: 36275 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
aagatgtggccccaccagtg

SEQ ID NO: 36276 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
ttgggaggctgagacaggag

SEQ ID NO: 36277 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
gtgaaattgttaagacaatt

SEQ ID NO: 36278 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
aaagaaacatttaaaaggag

SEQ ID NO: 36279 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
gaggcatgtttcacctgtta

SEQ ID NO: 36280 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
cctgttaacttgtttacttc

SEQ ID NO: 36281 - DNA, 20 bp, Artificial Sequence
  Description of Artificial Sequence: Synthetic oligonucleotide
  Target: ATXN1; (+) strand; PAM type: NNNNGHTT; PAM sequence: GGTAGATT
ttcataagattctcttgttg

SEQ ID NO: 36282 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
attctcttgttgggtagatt

SEQ ID NO: 36283 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
cataaatcttttcaaaacaa

SEQ ID NO: 36284 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
gcctagaaaaaaatgccacc

SEQ ID NO: 36285 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
agaaaaaaatgccacccaat

SEQ ID NO: 36286 - DNA, 20 bp, Artificial Sequence
  Description of Artificial Sequence: Synthetic oligonucleotide
  Target: ATXN1; (+) strand; PAM type: NNNNGHTT; PAM sequence: ATCAGTTT
tgccacccaatgtttgtttt

SEQ ID NO: 36287 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
ttgttttatcagttttcttt

SEQ ID NO: 36288 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
acccatatgagtcctcattg

SEQ ID NO: 36289 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
cacaattccaggtcctccca

SEQ ID NO: 36290 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
aatttgcttccagttcttgc

SEQ ID NO: 36291 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
cacatctcacaggttgtcca

SEQ ID NO: 36292 - DNA, 20 bp, Artificial Sequence
  Description of Artificial Sequence: Synthetic oligonucleotide
  Target: ATXN1; (+) strand; PAM type: NNNNGHTT; PAM sequence: AGCAGTTT
attagagcaaatatgtccag

SEQ ID NO: 36293 - DNA, 20 bp, Artificial Sequence
  Description of Artificial Sequence: Synthetic oligonucleotide
  Target: ATXN1; (+) strand; PAM type: NNNNGHTT; PAM sequence: TTACGCTT
agtccaaggaaaaaggacat

SEQ ID NO: 36294 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
gacatttacgcttgcacctt

SEQ ID NO: 36295 - DNA, 20 bp, Artificial Sequence
  Description of Artificial Sequence: Synthetic oligonucleotide
  Target: ATXN1; (+) strand; PAM type: NNNNGHTT; PAM sequence: ACTTGCTT
aacaatataactctaaattc

SEQ ID NO: 36296 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
ataactctaaattcacttgc

SEQ ID NO: 36297 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
ttgaacaaacctattagatg

SEQ ID NO: 36298 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
ctattagatgtctggtttct

SEQ ID NO: 36299 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
aactctcacaagcaattatc

SEQ ID NO: 36300 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
tactctttcttcttagaaaa

SEQ ID NO: 36301 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
gttctggcatccatgcaatc

SEQ ID NO: 36302 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
atttacttagcaagcactac

SEQ ID NO: 36303 - DNA, 20 bp, Artificial Sequence
  Description of Artificial Sequence: Synthetic oligonucleotide
  Target: ATXN1; (+) strand; PAM type: NNNNGHTT; PAM sequence: CTCGGTTT
ggttctcctcttttctgggc

SEQ ID NO: 36304 - DNA, 20 bp, Artificial Sequence
  Description of Artificial Sequence: Synthetic oligonucleotide
  Target: ATXN1; (+) strand; PAM type: NNNNGHTT; PAM sequence: GGTTGTTT
taatactccctacctcatag

SEQ ID NO: 36305 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
taaacatttatttttaaaaa

SEQ ID NO: 36306 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
tttttaaaaaaacagcttta

SEQ ID NO: 36307 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
ataactcaagtgtataactc

SEQ ID NO: 36308 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
caaatgttttttagtatagt

SEQ ID NO: 36309 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
aaccaacatcacaatctaat

SEQ ID NO: 36310 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
cccaaactaacttctgtctc

SEQ ID NO: 36311 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
atgtggtctctcaattcaca

SEQ ID NO: 36312 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
tgttgtagcatgtattaata

SEQ ID NO: 36313 - DNA, 20 bp, Artificial Sequence
  Description of Artificial Sequence: Synthetic oligonucleotide
  Target: ATXN1; (+) strand; PAM type: NNNNGHTT; PAM sequence: GGTTGTTT
gtattaatactttgcttact

SEQ ID NO: 36314 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
cacagcactctgaaaatgtc

SEQ ID NO: 36315 - DNA, 20 bp, Artificial Sequence
  Description of Artificial Sequence: Synthetic oligonucleotide
  Target: ATXN1; (+) strand; PAM type: NNNNGHTT; PAM sequence: TATCGTTT
attaccattggcattattac

SEQ ID NO: 36316 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tattactatcgttttgtcac

SEQ ID NO: 36317 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
caattgcactggtctccacc

SEQ ID NO: 36318 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
gtgagcagtaggcgaatgag

SEQ ID NO: 36319 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
cctgtcaggtcagcaacggc

SEQ ID NO: 36320 - DNA, 20 bp, Artificial Sequence
  Description of Artificial Sequence: Synthetic oligonucleotide
  Target: ATXN1; (+) strand; PAM type: NNNNGHTT; PAM sequence: GACCGTTT
ctcccatcacccctagatgg

SEQ ID NO: 36321 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
gaaaacaagctcaaggatct

SEQ ID NO: 36322 - DNA, 20 bp, Artificial Sequence
  Description of Artificial Sequence: Synthetic oligonucleotide
  Target: ATXN1; (+) strand; PAM type: NNNNGHTT; PAM sequence: TGCCGCTT
aactaaacctacactgctgc

SEQ ID NO: 36323 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
caggcaaaaacacagtcgtt

SEQ ID NO: 36324 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
ctgcagagaaataatttcaa

SEQ ID NO: 36325 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
gggaaacgcggctccctaca

SEQ ID NO: 36326 - DNA, 20 bp, Artificial Sequence
  Description of Artificial Sequence: Synthetic oligonucleotide
  Target: ATXN1; (+) strand; PAM type: NNNNGHTT; PAM sequence: TCCGGTTT
ctacaaggtgttttcaaggt

SEQ ID NO: 36327 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
acctgcctcccttacatcat

SEQ ID NO: 36328 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
cctccaaggatgatctgggc

SEQ ID NO: 36329 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
cttcttcataggggaggaaa

SEQ ID NO: 36330 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
ctctcctcctcccaaagcaa

SEQ ID NO: 36331 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
caactggacctcatctgcct

SEQ ID NO: 36332 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
gtggctgctgagtcatcagg

SEQ ID NO: 36333 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
aaccttttatacagacaaat

SEQ ID NO: 36334 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
ttcttcccaggtcatagcag

SEQ ID NO: 36335 - DNA, 20 bp, Artificial Sequence
  Description of Artificial Sequence: Synthetic oligonucleotide
  Target: ATXN1; (+) strand; PAM type: NNNNGHTT; PAM sequence: CATAGCTT
gctgtttcaacaggaaatgt

SEQ ID NO: 36336 - DNA, 20 bp, Artificial Sequence
  Description of Artificial Sequence: Synthetic oligonucleotide
  Target: ATXN1; (+) strand; PAM type: NNNNGHTT; PAM sequence: ATTAGCTT
taaaaaataatctaaactaa

SEQ ID NO: 36337 - DNA, 20 bp, Artificial Sequence
  Description of Artificial Sequence: Synthetic oligonucleotide
  Target: ATXN1; (+) strand; PAM type: NNNNGHTT; PAM sequence: TGGCGATT
aaccattgtggaagacagtg

SEQ ID NO: 36338 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
ccattactggggatataccc

SEQ ID NO: 36339 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
ctataaaggcacatgcgcac

SEQ ID NO: 36340 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
caaatgtccatcaatgatag

SEQ ID NO: 36341 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
gagtggggggaggggggagg

SEQ ID NO: 36342 - DNA, 20 bp, Artificial Sequence
  Description of Artificial Sequence: Synthetic oligonucleotide
  Target: ATXN1; (+) strand; PAM type: NNNNGHTT; PAM sequence: AGCTGTTT
tgagcacactagaagtcaac

SEQ ID NO: 36343 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
atccatgtcgagttaggaaa

SEQ ID NO: 36344 - DNA, 20 bp, Artificial Sequence
  Description of Artificial Sequence: Synthetic oligonucleotide
  Target: ATXN1; (+) strand; PAM type: NNNNGHTT; PAM sequence: GGGCGATT
gcaaatcgcaagttgttggg

SEQ ID NO: 36345 - DNA, 20 bp, Artificial Sequence
  Description of Artificial Sequence: Synthetic oligonucleotide
  Target: ATXN1; (+) strand; PAM type: NNNNGHTT; PAM sequence: TCACGATT
gattcccagaaatatgtgaa

SEQ ID NO: 36346 - DNA, 20 bp, Artificial Sequence
  Description of Artificial Sequence: Synthetic oligonucleotide
  Target: ATXN1; (+) strand; PAM type: NNNNGHTT; PAM sequence: ATCAGTTT
gtgaatcacgattgtgactc

SEQ ID NO: 36347 - DNA, 20 bp, Artificial Sequence
  Description of Artificial Sequence: Synthetic oligonucleotide
  Target: ATXN1; (+) strand; PAM type: NNNNGHTT; PAM sequence: AGCAGATT
attttcctaatttgtgggct

SEQ ID NO: 36348 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
ctagtatgaaagagaaataa

SEQ ID NO: 36349 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
ttaattaatgcatacatatg

SEQ ID NO: 36350 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
tggatccagtctgtgaggtc

SEQ ID NO: 36351 - DNA, 20 bp, Artificial Sequence
  Description of Artificial Sequence: Synthetic oligonucleotide
  Target: ATXN1; (+) strand; PAM type: NNNNGHTT; PAM sequence: GATCGCTT
tttgggaggctgaagtggag

SEQ ID NO: 36352 - DNA, 20 bp, Artificial Sequence
  Description of Artificial Sequence: Synthetic oligonucleotide
  Target: ATXN1; (+) strand; PAM type: NNNNGHTT; PAM sequence: ACTAGCTT
cgccttgacgctgaagtgtc

SEQ ID NO: 36353 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
gagtacacgtgactaaatag

SEQ ID NO: 36354 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
ctgttaaatgaattccaata

SEQ ID NO: 36355 - DNA, 20 bp, Artificial Sequence
  Description of Artificial Sequence: Synthetic oligonucleotide
  Target: ATXN1; (+) strand; PAM type: NNNNGHTT; PAM sequence: TCTAGCTT
tcatttatcaggcagcaatg

SEQ ID NO: 36356 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
gcaggttcctaagcaagtag

SEQ ID NO: 36357 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
gagaacttttctgtcttaca

SEQ ID NO: 36358 - DNA, 20 bp, Artificial Sequence
  Description of Artificial Sequence: Synthetic oligonucleotide
  Target: ATXN1; (+) strand; PAM type: NNNNGHTT; PAM sequence: GCTAGCTT
acaccaatcagcgctctgta

SEQ ID NO: 36359 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
tcagcgctctgtagctagct

SEQ ID NO: 36360 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
gggtccccttccacgctgtg

SEQ ID NO: 36361 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctccacctcctaggttc

SEQ ID NO: 36362 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagccgcctaagtag

SEQ ID NO: 36363 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 36364 - DNA, 20 bp, Artificial Sequence
  Description of Artificial Sequence: Synthetic oligonucleotide
  Target: ATXN1; (+) strand; PAM type: NNNNGHTT; PAM sequence: AGGTGATT
gttcttgaactcccaacctc

SEQ ID NO: 36365 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
acctcaggtgattcgcctgc

SEQ ID NO: 36366 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcttcccaaggtg

SEQ ID NO: 36367 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
tgagccattgcgcccggccc

SEQ ID NO: 36368 - DNA, 20 bp, Artificial Sequence
  Description of Artificial Sequence: Synthetic oligonucleotide
  Target: ATXN1; (+) strand; PAM type: NNNNGHTT; PAM sequence: TAAGGCTT
cggcccctgggtttctttct

SEQ ID NO: 36369 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
gctccaaggggccagggaag

SEQ ID NO: 36370 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
tcattgctgcagtaaaatta

SEQ ID NO: 36371 - DNA, 20 bp, Artificial Sequence
  Description of Artificial Sequence: Synthetic oligonucleotide
  Target: ATXN1; (+) strand; PAM type: NNNNGHTT; PAM sequence: CTATGATT
atagcaccagaagtggaggc

SEQ ID NO: 36372 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
ctctttgacgttactattat

SEQ ID NO: 36373 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
ctctccctcctctcgggcct

SEQ ID NO: 36374 - DNA, 20 bp, Artificial Sequence
  Description of Artificial Sequence: Synthetic oligonucleotide
  Target: ATXN1; (+) strand; PAM type: NNNNGHTT; PAM sequence: CGGAGCTT
aatggcgtgaacccgggagg

SEQ ID NO: 36375 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
aatttaaataagaaaactag

SEQ ID NO: 36376 - DNA, 20 bp, Artificial Sequence
  Description of Artificial Sequence: Synthetic oligonucleotide
  Target: ATXN1; (+) strand; PAM type: NNNNGHTT; PAM sequence: TTAAGCTT
aataagaaaactagaaatga

SEQ ID NO: 36377 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
aagctgacatatgtcaaaag

SEQ ID NO: 36378 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
aggtgaggaacttggagaag

SEQ ID NO: 36379 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
aagctagcagaagttggttc

SEQ ID NO: 36380 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
agatcattgatgaaggtgac

SEQ ID NO: 36381 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
catagctagagaggagaagt

SEQ ID NO: 36382 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
gagaagtcaatgcttgacta

SEQ ID NO: 36383 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
ttgagacttaattgctcaga

SEQ ID NO: 36384 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
aaagattcctttcaaaatat

SEQ ID NO: 36385 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
agctctgatggaaatataca

SEQ ID NO: 36386 - DNA, 20 bp, Artificial Sequence
  Description of Artificial Sequence: Synthetic oligonucleotide
  Target: ATXN1; (+) strand; PAM type: NNNNGHTT; PAM sequence: TGTCGTTT
gaaatatacaaggagattca

SEQ ID NO: 36387 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
gtaaattgaaaacctcctgg

SEQ ID NO: 36388 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
ttgtagatgtcattaagaac

SEQ ID NO: 36389 - DNA, 20 bp, Artificial Sequence
  Description of Artificial Sequence: Synthetic oligonucleotide
  Target: ATXN1; (+) strand; PAM type: NNNNGHTT; PAM sequence: ATCAGTTT
gtcaaaatatcaacatgaac

SEQ ID NO: 36390 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
atgaacatcagtttggaaga

SEQ ID NO: 36391 - DNA, 20 bp, Artificial Sequence
  Description of Artificial Sequence: Synthetic oligonucleotide
  Target: ATXN1; (+) strand; PAM type: NNNNGHTT; PAM sequence: GAGGGTTT
ccaacccccatggatgactt

SEQ ID NO: 36392 - DNA, 20 bp, Artificial Sequence
  Description of Artificial Sequence: Synthetic oligonucleotide
  Target: ATXN1; (+) strand; PAM type: NNNNGHTT; PAM sequence: AATTGATT
ggagcctgaaaatgtgactg

SEQ ID NO: 36393 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
ctctatggaggagcaaagaa

SEQ ID NO: 36394 - DNA, 20 bp, Artificial Sequence
  Description of Artificial Sequence: Synthetic oligonucleotide
  Target: ATXN1; (+) strand; PAM type: NNNNGHTT; PAM sequence: TCACGCTT
tcatggccgggcacagtggc

SEQ ID NO: 36395 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
tcaggaggctgaggcaggag

SEQ ID NO: 36396 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
aacaaacaaacaaaaaaacc

SEQ ID NO: 36397 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
aacactgttaaaatgacaac

SEQ ID NO: 36398 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
taaacttaattgatgcagtg

SEQ ID NO: 36399 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
taagaaattgccaccgccac

SEQ ID NO: 36400 - DNA, 20 bp, Artificial Sequence
  Description of Artificial Sequence: Synthetic oligonucleotide
  Target: ATXN1; (+) strand; PAM type: NNNNGHTT; PAM sequence: AAACGATT
gtaaagaccctttaccaaca

SEQ ID NO: 36401 - DNA, 20 bp, Artificial Sequence
  Description of Artificial Sequence: Synthetic oligonucleotide
  Target: ATXN1; (+) strand; PAM type: NNNNGHTT; PAM sequence: AACAGTTT
gttcaatgaagatgatcgtt

SEQ ID NO: 36402 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tttaaaattaaggtatgtac

SEQ ID NO: 36403 - DNA, 20 bp, Artificial Sequence
  Description of Artificial Sequence: Synthetic oligonucleotide
  Target: ATXN1; (+) strand; PAM type: NNNNGHTT; PAM sequence: GTGTGATT
actggaaaaccaaaaaattt

SEQ ID NO: 36404 - DNA, 20 bp, Artificial Sequence
  Description of Artificial Sequence: Synthetic oligonucleotide
  Target: ATXN1; (+) strand; PAM type: NNNNGHTT; PAM sequence: ACTTGCTT
gtgatttgctgtattgcaat

SEQ ID NO: 36405 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
cctatagtcccagctacttg

SEQ ID NO: 36406 - DNA, 20 bp, Artificial Sequence
  Description of Artificial Sequence: Synthetic oligonucleotide
  Target: ATXN1; (+) strand; PAM type: NNNNGHTT; PAM sequence: CGGAGCTT
ggaggcttgaacccaggagg

SEQ ID NO: 36407 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
ttgagaggccaagacgggta

SEQ ID NO: 36408 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
cgggtagactgcttgagccc

SEQ ID NO: 36409 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
gaggtcgaggctgcagtgag

SEQ ID NO: 36410 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
agaagaacgcaggactatga

SEQ ID NO: 36411 - DNA, 20 bp, Artificial Sequence
  Description of Artificial Sequence: Synthetic oligonucleotide
  Target: ATXN1; (+) strand; PAM type: NNNNGHTT; PAM sequence: GATCGTTT
ctatgtctcagaaagagttc

SEQ ID NO: 36412 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
gtctcagaaagagttcgatc

SEQ ID NO: 36413 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
atgcccatattccaatacaa

SEQ ID NO: 36414 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
gacataaaaggacaaatatt

SEQ ID NO: 36415 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
gtgttattgtctaatgaatg

SEQ ID NO: 36416 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
gttctggaaatggatagtgg

SEQ ID NO: 36417 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
tcgggaggccgaggcaggag

SEQ ID NO: 36418 - DNA, 20 bp, Artificial Sequence
  Description of Artificial Sequence: Synthetic oligonucleotide
  Target: ATXN1; (+) strand; PAM type: NNNNGHTT; PAM sequence: CTCCGTTT
agcctggcgacagagcaaga

SEQ ID NO: 36419 - DNA, 20 bp, Artificial Sequence
  Description of Artificial Sequence: Synthetic oligonucleotide
  Target: ATXN1; (+) strand; PAM type: NNNNGHTT; PAM sequence: TTACGCTT
ctagcatggatgccaaatat

SEQ ID NO: 36420 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
ggatgccaaatatttacgct

SEQ ID NO: 36421 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
aaactgttcaagctaataaa

SEQ ID NO: 36422 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
ttgggccaaatttacataat

SEQ ID NO: 36423 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
tccaccagatggaagaagca

SEQ ID NO: 36424 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
caggatgctgggctcctaca

SEQ ID NO: 36425 - DNA, 20 bp, Artificial Sequence
  Description of Artificial Sequence: Synthetic oligonucleotide
  Target: ATXN1; (+) strand; PAM type: NNNNGHTT; PAM sequence: GACAGATT
agaagaattctggtcctgag

SEQ ID NO: 36426 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
caaagtagactgggtccttg

SEQ ID NO: 36427 - DNA, 20 bp, Artificial Sequence
  Description of Artificial Sequence: Synthetic oligonucleotide
  Target: ATXN1; (+) strand; PAM type: NNNNGHTT; PAM sequence: TTTCGTTT
agactgggtccttgtggggc

SEQ ID NO: 36428 - DNA, 20 bp, Artificial Sequence
  Description of Artificial Sequence: Synthetic oligonucleotide
  Target: ATXN1; (+) strand; PAM type: NNNNGHTT; PAM sequence: ACTTGCTT
ttccttaaaagcaactgtgt

SEQ ID NO: 36429 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
cagaccaagggtgagggagc

SEQ ID NO: 36430 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
gagggagccacagattgaat

SEQ ID NO: 36431 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
aaaaattacactctctacct

SEQ ID NO: 36432 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
aggagttgctcagtaactta

SEQ ID NO: 36433 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
taaaaaggaaattgtacaaa

SEQ ID NO: 36434 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
aattgtacaaaacatgtttc

SEQ ID NO: 36435 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
tgtttccagagttttgttaa

SEQ ID NO: 36436 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
accctgggctcaaactggtc

SEQ ID NO: 36437 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
ccattcttccaagtcagctc

SEQ ID NO: 36438 - DNA, 20 bp, Artificial Sequence
  Description of Artificial Sequence: Synthetic oligonucleotide
  Target: ATXN1; (+) strand; PAM type: NNNNGHTT; PAM sequence: CATTGCTT
actcctttgtgttcccacag

SEQ ID NO: 36439 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
ttccctagctgggttcacct

SEQ ID NO: 36440 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
taacagtgtaaattcctaaa

SEQ ID NO: 36441 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
aataacagctaccatttttt

SEQ ID NO: 36442 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
ttacgtgcatcaagactcat

SEQ ID NO: 36443 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
atcaagactcatttaggttt

SEQ ID NO: 36444 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
agactcatttaggttttttt

SEQ ID NO: 36445 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
tcatttaggtttttttgttt

SEQ ID NO: 36446 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
ttaggtttttttgtttgttt

SEQ ID NO: 36447 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
gtttttttgtttgtttgttt

SEQ ID NO: 36448 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tttgtttgtttgtttgtttg

SEQ ID NO: 36449 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttatatttttagtagaga

SEQ ID NO: 36450 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
caccatggcctcccaaagtg

SEQ ID NO: 36451 - DNA, 20 bp, Artificial Sequence
  Description of Artificial Sequence: Synthetic oligonucleotide
  Target: ATXN1; (+) strand; PAM type: NNNNGHTT; PAM sequence: GCCTGTTT
ggcgtgagccaccgtgcctg

SEQ ID NO: 36452 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
ctgttttatttttcttattt

SEQ ID NO: 36453 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
gattgataaactgagaccca

SEQ ID NO: 36454 - DNA, 20 bp, Artificial Sequence
  Description of Artificial Sequence: Synthetic oligonucleotide
  Target: ATXN1; (+) strand; PAM type: NNNNGHTT; PAM sequence: GGAAGTTT
aagttcggtattcaaaccca

SEQ ID NO: 36455 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
ctacacttttcaacacatca

SEQ ID NO: 36456 - DNA, 20 bp, Artificial Sequence
  Description of Artificial Sequence: Synthetic oligonucleotide
  Target: ATXN1; (+) strand; PAM type: NNNNGHTT; PAM sequence: GCTAGATT
ctgtaatcagttgtctcagg

SEQ ID NO: 36457 - DNA, 20 bp, Artificial Sequence
  Description of Artificial Sequence: Synthetic oligonucleotide
  Target: ATXN1; (+) strand; PAM type: NNNNGHTT; PAM sequence: TGGGGATT
gattttaaatctttgagatc

SEQ ID NO: 36458 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
cgggtggatcatctgaggtc

SEQ ID NO: 36459 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
tctggtctgtatgtagatcc

SEQ ID NO: 36460 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
tccttcctcattgaagctac

SEQ ID NO: 36461 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
gtcatagtctaattgccttc

SEQ ID NO: 36462 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
tttttgtcactaggtactta

SEQ ID NO: 36463 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
tgaactgtaacagtcaccaa

SEQ ID NO: 36464 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
tcttgtaaacagctgaaggg

SEQ ID NO: 36465 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
taaaaaatgatgtgggtatt

SEQ ID NO: 36466 - DNA, 20 bp, Artificial Sequence
  Description of Artificial Sequence: Synthetic oligonucleotide
  Target: ATXN1; (+) strand; PAM type: NNNNGHTT; PAM sequence: TGATGATT
ttccttgtcacacgtacaaa

SEQ ID NO: 36467 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
aatgatgattttctttttag

SEQ ID NO: 36468 - DNA, 20 bp, Artificial Sequence
  Description of Artificial Sequence: Synthetic oligonucleotide
  Target: ATXN1; (+) strand; PAM type: NNNNGHTT; PAM sequence: TTTGGATT
agaactggatgtgtcattta

SEQ ID NO: 36469 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
gatgtgtcatttatttggat

SEQ ID NO: 36470 - DNA, 20 bp, Artificial Sequence
  Description of Artificial Sequence: Synthetic oligonucleotide
  Target: ATXN1; (+) strand; PAM type: NNNNGHTT; PAM sequence: AACAGTTT
catggttatgcatgacataa

SEQ ID NO: 36471 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
gacataaaacagtttaaaaa

SEQ ID NO: 36472 - DNA, 20 bp, Artificial Sequence
  Description of Artificial Sequence: Synthetic oligonucleotide
  Target: ATXN1; (+) strand; PAM type: NNNNGHTT; PAM sequence: TATGGCTT
gtttttagtaacttcataaa

SEQ ID NO: 36473 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
taatgccaaagatatacgcc

SEQ ID NO: 36474 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
ccaaagatatacgccagtag

SEQ ID NO: 36475 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
aatccaactattactgtaaa

SEQ ID NO: 36476 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
ttatgaaatagtaattagta

SEQ ID NO: 36477 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
acatttttaatatcttacct

SEQ ID NO: 36478 - DNA, 20 bp, Artificial Sequence
  Description of Artificial Sequence: Synthetic oligonucleotide
  Target: ATXN1; (+) strand; PAM type: NNNNGHTT; PAM sequence: ATGGGCTT
aaactgtattatatgcagga

SEQ ID NO: 36479 - DNA, 20 bp, Artificial Sequence
  Description of Artificial Sequence: Synthetic oligonucleotide
  Target: ATXN1; (+) strand; PAM type: NNNNGHTT; PAM sequence: CAAGGTTT
tgggcttaacacttggaata

SEQ ID NO: 36480 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
taacacagcaagaggataat

SEQ ID NO: 36481 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
cagcaagaggataatttctg

SEQ ID NO: 36482 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
gacattacagatgtgagaca

SEQ ID NO: 36483 - DNA, 20 bp, Artificial Sequence
  Description of Artificial Sequence: Synthetic oligonucleotide
  Target: ATXN1; (+) strand; PAM type: NNNNGHTT; PAM sequence: GGGAGTTT
ttaggcctcaacgaatgagt

SEQ ID NO: 36484 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
gcatggttattatatacata

SEQ ID NO: 36485 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
agggatgggagtcacgggag

SEQ ID NO: 36486 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
aatattaaaaataccttcat

SEQ ID NO: 36487 - DNA, 20 bp, Artificial Sequence
  Description of Artificial Sequence: Synthetic oligonucleotide
  Target: ATXN1; (+) strand; PAM type: NNNNGHTT; PAM sequence: CATAGATT
ttctagcctttgtggatagg

SEQ ID NO: 36488 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
ggataggcatagatttttgt

SEQ ID NO: 36489 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
ttgtcactgctttgtaatca

SEQ ID NO: 36490 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
aattttatacttaacatttg

SEQ ID NO: 36491 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
aagctgccttcttccatatt

SEQ ID NO: 36492 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
ccatattttaagtttggcct

SEQ ID NO: 36493 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
acctattcttgtaccaatct

SEQ ID NO: 36494 - DNA, 20 bp, Artificial Sequence
  Description of Artificial Sequence: Synthetic oligonucleotide
  Target: ATXN1; (+) strand; PAM type: NNNNGHTT; PAM sequence: GGCTGTTT
cgctgagctgaaaccaatct

SEQ ID NO: 36495 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
tggctgtttctgtacctcac

SEQ ID NO: 36496 - DNA, 20 bp, Artificial Sequence
  Description of Artificial Sequence: Synthetic oligonucleotide
  Target: ATXN1; (+) strand; PAM type: NNNNGHTT; PAM sequence: CGTCGTTT
cctcacttctgttttctgtc

SEQ ID NO: 36497 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
gaaaggagtagagaggagct

SEQ ID NO: 36498 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
tctgttaaatttaatttgtc

SEQ ID NO: 36499 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
taaagtttttcttttaacac

SEQ ID NO: 36500 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
tccatatttccacatactac

SEQ ID NO: 36501 - DNA, 20 bp, Artificial Sequence
  Description of Artificial Sequence: Synthetic oligonucleotide
  Target: ATXN1; (+) strand; PAM type: NNNNGHTT; PAM sequence: AGGGGCTT
gaaagaaaagactttaagca

SEQ ID NO: 36502 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
cctgtaatcccaacactttg

SEQ ID NO: 36503 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
ggcaggcggatcatgaggtc

SEQ ID NO: 36504 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
aacgtaggacaatgacaaag

SEQ ID NO: 36505 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
aggacaatgacaaagtcagg

SEQ ID NO: 36506 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
tgggaggaagttggaaatca

SEQ ID NO: 36507 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
tgcggtaacaaactctaggt

SEQ ID NO: 36508 - DNA, 20 bp, Artificial Sequence
  Description of Artificial Sequence: Synthetic oligonucleotide
  Target: ATXN1; (+) strand; PAM type: NNNNGHTT; PAM sequence: GCCAGTTT
ctccaacaatgtgcacgtgt

SEQ ID NO: 36509 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
gtgcacgtgtgccagtttaa

SEQ ID NO: 36510 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
gacctaccatgtaaatcagc

SEQ ID NO: 36511 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
cattgcatttcctgaatggg

SEQ ID NO: 36512 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
ctcacagctatacaaaacca

SEQ ID NO: 36513 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
ttaacaaaaggcattttggg

SEQ ID NO: 36514 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
tgggtgctgctttaccgaac

SEQ ID NO: 36515 - DNA, 20 bp, Artificial Sequence
  Description of Artificial Sequence: Synthetic oligonucleotide
  Target: ATXN1; (+) strand; PAM type: NNNNGHTT; PAM sequence: GAGAGCTT
tctaagctggaaagcactgc

SEQ ID NO: 36516 - DNA, 20 bp, Artificial Sequence
  Description of Artificial Sequence: Synthetic oligonucleotide
  Target: ATXN1; (+) strand; PAM type: NNNNGHTT; PAM sequence: TGGCGCTT
ctttagtgggggtactggac

SEQ ID NO: 36517 - DNA, 20 bp, Artificial Sequence
  Description of Artificial Sequence: Synthetic oligonucleotide
  Target: ATXN1; (+) strand; PAM type: NNNNGHTT; PAM sequence: CTATGATT
atctgttccaaaagcagtac

SEQ ID NO: 36518 - DNA, 20 bp, Artificial Sequence
  Description of Artificial Sequence: Synthetic oligonucleotide
  Target: ATXN1; (+) strand; PAM type: NNNNGHTT; PAM sequence: GGCTGTTT
gcagtacctatgatttaggt

SEQ ID NO: 36519 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
acggtaaacgatacaagtga

SEQ ID NO: 36520 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
gctcttttagaatcattttt

SEQ ID NO: 36521 - DNA, 20 bp, Artificial Sequence
  Description of Artificial Sequence: Synthetic oligonucleotide
  Target: ATXN1; (+) strand; PAM type: NNNNGHTT; PAM sequence: AATAGTTT
tggatggttacttgcaagga

SEQ ID NO: 36522 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
aaagcctaatgtgcccttaa

SEQ ID NO: 36523 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
cttaacatggcttcagcaaa

SEQ ID NO: 36524 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
gagaagatacttctccaaca

SEQ ID NO: 36525 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
ttctccaacactgggcttga

SEQ ID NO: 36526 - DNA, 20 bp, Artificial Sequence
  Description of Artificial Sequence: Synthetic oligonucleotide
  Target: ATXN1; (+) strand; PAM type: NNNNGHTT; PAM sequence: GCTTGCTT
ccaacactgggcttgaaggt

SEQ ID NO: 36527 - DNA, 20 bp, Artificial Sequence
  Description of Artificial Sequence: Synthetic oligonucleotide
  Target: ATXN1; (+) strand; PAM type: NNNNGHTT; PAM sequence: TCAGGATT
ctttttcacacaaactgaat

SEQ ID NO: 36528 - DNA, 20 bp, Artificial Sequence
  Description of Artificial Sequence: Synthetic oligonucleotide
  Target: ATXN1; (+) strand; PAM type: NNNNGHTT; PAM sequence: GTTAGATT
tgttaatgcatttggtagtg

SEQ ID NO: 36529 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
ctggttcctttctaggctag

SEQ ID NO: 36530 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
agctaagcttctgtgagttc

SEQ ID NO: 36531 - DNA, 20 bp, Artificial Sequence
  Description of Artificial Sequence: Synthetic oligonucleotide
  Target: ATXN1; (+) strand; PAM type: NNNNGHTT; PAM sequence: TTTGGATT
agcttctgtgagttcttctg

SEQ ID NO: 36532 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
caccactgcagtctgctaac

SEQ ID NO: 36533 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
aatccaccactgtgcactgt

SEQ ID NO: 36534 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
aaactgccaagggtagcagg

SEQ ID NO: 36535 - DNA, 20 bp, Artificial Sequence
  Description of Artificial Sequence: Synthetic oligonucleotide
  Target: ATXN1; (+) strand; PAM type: NNNNGHTT; PAM sequence: TAAAGCTT
gtggctttgggagccaagga

SEQ ID NO: 36536 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
tgggagccaaggataaagct

SEQ ID NO: 36537 - DNA, 20 bp, Artificial Sequence
  Description of Artificial Sequence: Synthetic oligonucleotide
  Target: ATXN1; (+) strand; PAM type: NNNNGHTT; PAM sequence: TAGTGATT
gtcattaccaccaacagagt

SEQ ID NO: 36538 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
acaaaagataaagagacaaa

SEQ ID NO: 36539 - DNA, 20 bp, Artificial Sequence
  Description of Artificial Sequence: Synthetic oligonucleotide
  Target: ATXN1; (+) strand; PAM type: NNNNGHTT; PAM sequence: GTGGGTTT
ctttacgtatttggaagaaa

SEQ ID NO: 36540 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
atgctgacctcacatcctga

SEQ ID NO: 36541 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
tgaagagggaatgcaaccct

SEQ ID NO: 36542 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
atgcaaccctcatggcttga

SEQ ID NO: 36543 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
gtgtgcaaaagttaactaag

SEQ ID NO: 36544 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
gggttctacatccccagaac

SEQ ID NO: 36545 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
caactttaataaacatatcc

SEQ ID NO: 36546 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
agattcggaagcaggaggta

SEQ ID NO: 36547 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
cacccttgggaaacactggt

SEQ ID NO: 36548 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
ttgggaaacactggtctgtg

SEQ ID NO: 36549 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
gactgctcagggccgggcgc

SEQ ID NO: 36550 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
tcaggaggctgaggcaagag

SEQ ID NO: 36551 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gaggcgaaggttgcagtgag

SEQ ID NO: 36552 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
gagaccagtcagtgaagtcc

SEQ ID NO: 36553 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
gaagactttgtaagtgacag

SEQ ID NO: 36554 - DNA, 20 bp, Artificial Sequence
  Description of Artificial Sequence: Synthetic oligonucleotide
  Target: ATXN1; (+) strand; PAM type: NNNNGHTT; PAM sequence: TCCCGATT
gcaactgtcttaatcaaacc

SEQ ID NO: 36555 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
acaggtaaagagggttccta

SEQ ID NO: 36556 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
actagcacttccagataaca

SEQ ID NO: 36557 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
ccagataacactgtgtttgc

SEQ ID NO: 36558 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
tttgctttctaccacattca

SEQ ID NO: 36559 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
tctgagcatcatttctgaag

SEQ ID NO: 36560 - DNA, 20 bp, Artificial Sequence
  Description of Artificial Sequence: Synthetic oligonucleotide
  Target: ATXN1; (+) strand; PAM type: NNNNGHTT; PAM sequence: GGATGTTT
gaagctctgcttcagaaagg

SEQ ID NO: 36561 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
cactttgagaggccaaggca

SEQ ID NO: 36562 - DNA, 20 bp, Artificial Sequence
  Description of Artificial Sequence: Synthetic oligonucleotide
  Target: ATXN1; (+) strand; PAM type: NNNNGHTT; PAM sequence: TGATGATT
tctcggctactggtctgtga

SEQ ID NO: 36563 - DNA, 20 bp, Artificial Sequence
  Description of Artificial Sequence: Synthetic oligonucleotide
  Target: ATXN1; (+) strand; PAM type: NNNNGHTT; PAM sequence: CTACGATT
tcatatggtcccagcacaag

SEQ ID NO: 36564 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tcgggaggttgaggcaggag

SEQ ID NO: 36565 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
tttactgcagatgctgacag

SEQ ID NO: 36566 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
ccaagataggtggggcagac

SEQ ID NO: 36567 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
cctaggcttcaatttgagga

SEQ ID NO: 36568 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
tatgttggtgtatgctctgg

SEQ ID NO: 36569 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
gaatggttttatcatttatt

SEQ ID NO: 36570 - DNA, 20 bp, Artificial Sequence
  Description of Artificial Sequence: Synthetic oligonucleotide
  Target: ATXN1; (+) strand; PAM type: NNNNGHTT; PAM sequence: GAGTGTTT
tatcatttatttatagttta

SEQ ID NO: 36571 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
atacttaaaagttactcagt

SEQ ID NO: 36572 - DNA, 20 bp, Artificial Sequence
  Description of Artificial Sequence: Synthetic oligonucleotide
  Target: ATXN1; (+) strand; PAM type: NNNNGHTT; PAM sequence: TATAGCTT
tacacgcctgcgctatacgg

SEQ ID NO: 36573 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
ttttgtattcttagtagaga

SEQ ID NO: 36574 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcctcggcctcccaaagtg

SEQ ID NO: 36575 - DNA, 20 bp, Artificial Sequence
  Description of Artificial Sequence: Synthetic oligonucleotide
  Target: ATXN1; (+) strand; PAM type: NNNNGHTT; PAM sequence: GTGCGATT
aattgaatctacttcctctc

SEQ ID NO: 36576 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
cctctcgtgcgattaatccc

SEQ ID NO: 36577 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
aaaatggagtatctggtaga

SEQ ID NO: 36578 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
tctggtagatgtagtttatt

SEQ ID NO: 36579 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
atgtagtttatttgctgttt

SEQ ID NO: 36580 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
tatttgctgtttgtgtgttt

SEQ ID NO: 36581 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
ctgtttgtgtgtttagttgt

SEQ ID NO: 36582 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
ttgtgtgtttagttgtttgg

SEQ ID NO: 36583 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
tgtttagttgtttgggtttg

SEQ ID NO: 36584 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
gttgtttgggtttgctttgt

SEQ ID NO: 36585 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
tattcagatcatactattct

SEQ ID NO: 36586 - DNA, 20 bp, Artificial Sequence
  Description of Artificial Sequence: Synthetic oligonucleotide
  Target: ATXN1; (+) strand; PAM type: NNNNGHTT; PAM sequence: ATACGCTT
taggatgtagagaaatagca

SEQ ID NO: 36587 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
gatgacttaccaaaaaccat

SEQ ID NO: 36588 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
gttcctggtctgcagcagca

SEQ ID NO: 36589 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
gtctgcagcagcactaagtt

SEQ ID NO: 36590 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
ttatcaggatgaagccatct

SEQ ID NO: 36591 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
gggaatgcacttgcaaaatt

SEQ ID NO: 36592 - DNA, 20 bp, Artificial Sequence
  Description of Artificial Sequence: Synthetic oligonucleotide
  Target: ATXN1; (+) strand; PAM type: NNNNGHTT; PAM sequence: TACCGATT
cacttgcaaaatttcaagtt

SEQ ID NO: 36593 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aagaaaaattcagtacgtct

SEQ ID NO: 36594 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
tatcaagggcagaaagtgaa

SEQ ID NO: 36595 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
aagggcagaaagtgaagaaa

SEQ ID NO: 36596 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
gccctataagtaggtaatgc

SEQ ID NO: 36597 - DNA, 20 bp, Artificial Sequence
  Description of Artificial Sequence: Synthetic oligonucleotide
  Target: ATXN1; (+) strand; PAM type: NNNNGHTT; PAM sequence: GTGTGATT
gtaatgcatgggtttccctt

SEQ ID NO: 36598 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
ttacacactgaatatgaaat

SEQ ID NO: 36599 - DNA, 20 bp, Artificial Sequence
  Description of Artificial Sequence: Synthetic oligonucleotide
  Target: ATXN1; (+) strand; PAM type: NNNNGHTT; PAM sequence: GTGAGCTT
gaaaagttcctttctgcctt

SEQ ID NO: 36600 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
gctgttgttaaagcatcttc

SEQ ID NO: 36601 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
atgcttagtcaaatccaccc

SEQ ID NO: 36602 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
ttagtcaaatccaccccact

SEQ ID NO: 36603 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
aaaggtcccacggtgatcat

SEQ ID NO: 36604 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
aggatatgctcgtatgcctc

SEQ ID NO: 36605 - DNA, 20 bp, Artificial Sequence
  Description of Artificial Sequence: Synthetic oligonucleotide
  Target: ATXN1; (+) strand; PAM type: NNNNGHTT; PAM sequence: GGACGTTT
aatagtcaacctttttttcg

SEQ ID NO: 36606 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
aggagaaagtgtctctccgt

SEQ ID NO: 36607 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
acccacagaaaatggggttg

SEQ ID NO: 36608 - DNA, 20 bp, Artificial Sequence
  Description of Artificial Sequence: Synthetic oligonucleotide
  Target: ATXN1; (+) strand; PAM type: NNNNGHTT; PAM sequence: ATTAGTTT
aatggggttgtaaggatttt

SEQ ID NO: 36609 - DNA, 20 bp, Artificial Sequence
  Description of Artificial Sequence: Synthetic oligonucleotide
  Target: ATXN1; (+) strand; PAM type: NNNNGHTT; PAM sequence: ACCGGCTT
tgacaaactgtctttacttt

SEQ ID NO: 36610 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
aacagaatttggagagagga

SEQ ID NO: 36611 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
aaacaagttcactgcaagtt

SEQ ID NO: 36612 - DNA, 20 bp, Artificial Sequence
  Description of Artificial Sequence: Synthetic oligonucleotide
  Target: ATXN1; (+) strand; PAM type: NNNNGHTT; PAM sequence: TGACGTTT
ctataattggaagaggtcct

SEQ ID NO: 36613 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
gaaagttaatatgtactttg

SEQ ID NO: 36614 - DNA, 20 bp, Artificial Sequence
  Description of Artificial Sequence: Synthetic oligonucleotide
  Target: ATXN1; (+) strand; PAM type: NNNNGHTT; PAM sequence: TGACGCTT
gttcaaccactcatgctcat

SEQ ID NO: 36615 - DNA, 20 bp, Artificial Sequence
  Description of Artificial Sequence: Synthetic oligonucleotide
  Target: ATXN1; (+) strand; PAM type: NNNNGHTT; PAM sequence: TGCGGTTT
actcatttaatgaaatgtaa

SEQ ID NO: 36616 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
ttaatgaaatgtaatgcggt

SEQ ID NO: 36617 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
acttcctcatagtactctct

SEQ ID NO: 36618 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ctcatagtactctctttctg

SEQ ID NO: 36619 - DNA, 20 bp, Artificial Sequence
  Description of Artificial Sequence: Synthetic oligonucleotide
  Target: ATXN1; (+) strand; PAM type: NNNNGHTT; PAM sequence: TCTGGATT
cataagaaaataaattcatt

SEQ ID NO: 36620 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
aagctaggtgtccagaaaag

SEQ ID NO: 36621 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
tgtagatgtgaaggagttgg

SEQ ID NO: 36622 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
ggagttggaagtgattcatt

SEQ ID NO: 36623 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
ctttttaagcaataatttca

SEQ ID NO: 36624 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
aataataatcaacaaaacaa

SEQ ID NO: 36625 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
aatcaacaaaacaaactggc

SEQ ID NO: 36626 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
aatctctgtcacctatccct

SEQ ID NO: 36627 - DNA, 20 bp, Artificial Sequence
  Description of Artificial Sequence: Synthetic oligonucleotide
  Target: ATXN1; (+) strand; PAM type: NNNNGHTT; PAM sequence: GAGGGTTT
ttaaaaaggatctcactcca

SEQ ID NO: 36628 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
atcaaataaaggaacttatt

SEQ ID NO: 36629 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
ataattaattctcaattata

SEQ ID NO: 36630 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
atttgtttttacatgtattt

SEQ ID NO: 36631 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
ataacaaacacaactatctt

SEQ ID NO: 36632 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
tcaaaaatgcaacaattaga

SEQ ID NO: 36633 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
aatatcaactcagggaaaaa

SEQ ID NO: 36634 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tcagggaaaaaagaggttta

SEQ ID NO: 36635 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
aaaaaagaggtttattttgt

SEQ ID NO: 36636 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
ttttttttttttttttgaga

SEQ ID NO: 36637 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
gctcactgcaacctctgcct

SEQ ID NO: 36638 - DNA, 20 bp, Artificial Sequence
  Description of Artificial Sequence: Synthetic oligonucleotide
  Target: ATXN1; (+) strand; PAM type: NNNNGHTT; PAM sequence: ACGGGATT
tttttgtatttttagtggag

SEQ ID NO: 36639 - DNA, 20 bp, Artificial Sequence
  Description of Artificial Sequence: Synthetic oligonucleotide
  Target: ATXN1; (+) strand; PAM type: NNNNGHTT; PAM sequence: TCGTGATT
ctggtcttgaactcctgacc

SEQ ID NO: 36640 - DNA, 20 bp, Artificial Sequence
  Description of Artificial Sequence: Synthetic oligonucleotide
  Target: ATXN1; (+) strand; PAM type: NNNNGHTT; PAM sequence: ACCCGCTT
aactcctgacctcgtgattc

SEQ ID NO: 36641 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgctttgacctcccaaagtg

SEQ ID NO: 36642 - DNA, 20 bp, Artificial Sequence
  Description of Artificial Sequence: Synthetic oligonucleotide
  Target: ATXN1; (+) strand; PAM type: NNNNGHTT; PAM sequence: CTTCGTTT
tagtgctgggaaacctggct

SEQ ID NO: 36643 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
aacctggctcttcgtttcga

SEQ ID NO: 36644 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
atataactaaacatataaac

SEQ ID NO: 36645 - DNA, 20 bp, Artificial Sequence
  Description of Artificial Sequence: Synthetic oligonucleotide
  Target: ATXN1; (+) strand; PAM type: NNNNGHTT; PAM sequence: GTCTGATT
acattttaagggctcatttg

SEQ ID NO: 36646 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
ctgttataagcagcctgcag

SEQ ID NO: 36647 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
taaagccttcttgagtgtgg

SEQ ID NO: 36648 - DNA, 20 bp, Artificial Sequence
  Description of Artificial Sequence: Synthetic oligonucleotide
  Target: ATXN1; (+) strand; PAM type: NNNNGHTT; PAM sequence: GGTGGCTT
agactgggttacatgaagat

SEQ ID NO: 36649 - DNA, 20 bp, Artificial Sequence
  Description of Artificial Sequence: Synthetic oligonucleotide
  Target: ATXN1; (+) strand; PAM type: NNNNGHTT; PAM sequence: AGTGGATT
ggcctgctagcatctatgtg

SEQ ID NO: 36650 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
agacacccagctatgatatg

SEQ ID NO: 36651 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
actgagagataataaacact

SEQ ID NO: 36652 - DNA, 20 bp, Artificial Sequence
  Description of Artificial Sequence: Synthetic oligonucleotide
  Target: ATXN1; (+) strand; PAM type: NNNNGHTT; PAM sequence: CTAAGATT
acacttgttgttttaagcca

SEQ ID NO: 36653 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
tcttttttttttttttgaaa

SEQ ID NO: 36654 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagtag

SEQ ID NO: 36655 - DNA, 20 bp, Artificial Sequence
  Description of Artificial Sequence: Synthetic oligonucleotide
  Target: ATXN1; (+) strand; PAM type: NNNNGHTT; PAM sequence: ACAGGATT
tttttgtatttttagtagag

SEQ ID NO: 36656 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
ggtctcggcctcccaaagtg

SEQ ID NO: 36657 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
ccactgcacccggccattca

SEQ ID NO: 36658 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
aaaacagaaaggtagcctct

SEQ ID NO: 36659 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
aatgtctttttgcaattgta

SEQ ID NO: 36660 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
aataagatagccacagtatt

SEQ ID NO: 36661 - DNA, 20 bp, Artificial Sequence
  Description of Artificial Sequence: Synthetic oligonucleotide
  Target: ATXN1; (+) strand; PAM type: NNNNGHTT; PAM sequence: TTTGGATT
gatagccacagtattttctg

SEQ ID NO: 36662 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
ttttttttttttttttgaaa

SEQ ID NO: 36663 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctctgcctcccgggttc

SEQ ID NO: 36664 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagcag

SEQ ID NO: 36665 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
taattaatctttagtagaga

SEQ ID NO: 36666 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
cacctcggcctcccgaagtg

SEQ ID NO: 36667 - DNA, 20 bp, Artificial Sequence
  Description of Artificial Sequence: Synthetic oligonucleotide
  Target: ATXN1; (+) strand; PAM type: NNNNGHTT; PAM sequence: GCTGGATT
ggcaggagccaccgtgcccg

SEQ ID NO: 36668 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
agttggcaatagaaagtcac

SEQ ID NO: 36669 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
ctaaggattcaaactgtacg

SEQ ID NO: 36670 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
ataattattataacaaatta

SEQ ID NO: 36671 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
tcatcacgcagcagccagga

SEQ ID NO: 36672 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cagctcagcctcccaagtag

SEQ ID NO: 36673 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
cccatcatgtccggccagga

SEQ ID NO: 36674 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
tctttattttggtctgactc

SEQ ID NO: 36675 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
ctttctgttacccaaagtga

SEQ ID NO: 36676 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
acacacaaaaatgtctaaaa

SEQ ID NO: 36677 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
catttggaaacagaagtaga

SEQ ID NO: 36678 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
cataatacaatgaatgaaga

SEQ ID NO: 36679 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
atgtttttttaagaaagtca

SEQ ID NO: 36680 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
aggcctctctctaaataaag

SEQ ID NO: 36681 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
tatggatttgaaggaaaatg

SEQ ID NO: 36682 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
gataaaaaaaggttgggata

SEQ ID NO: 36683 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
ctcaataaattttaagagta

SEQ ID NO: 36684 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
agtgacaagagtgagatcca

SEQ ID NO: 36685 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
ttttgcagctctctttaatg

SEQ ID NO: 36686 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
ttctcttctgtgcctctgaa

SEQ ID NO: 36687 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
gaattcagttttctgtgata

SEQ ID NO: 36688 - DNA, 20 bp, Artificial Sequence
  Description of Artificial Sequence: Synthetic oligonucleotide
  Target: ATXN1; (+) strand; PAM type: NNNNGHTT; PAM sequence: AATAGTTT
tatgtggagaagatgtggcc

SEQ ID NO: 36689 - DNA, 20 bp, Artificial Sequence
  Description of Artificial Sequence: Synthetic oligonucleotide
  Target: ATXN1; (+) strand; PAM type: NNNNGHTT; PAM sequence: GGTAGTTT
cataccaaaactcaataagt

SEQ ID NO: 36690 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
ttggatggatctttagctat

SEQ ID NO: 36691 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
ggaagtaaaagcacagaact

SEQ ID NO: 36692 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
tgggcggaaaactgtattta

SEQ ID NO: 36693 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tgagaagtgtgcatttttaa

SEQ ID NO: 36694 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
tgtgcatatttattgggtac

SEQ ID NO: 36695 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
tactctctgtctccatgacg

SEQ ID NO: 36696 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
gtgatatttgtctttctgtg

SEQ ID NO: 36697 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
cattccttcattgatggaga

SEQ ID NO: 36698 - DNA, 20 bp, Artificial Sequence
  Description of Artificial Sequence: Synthetic oligonucleotide
  Target: ATXN1; (+) strand; PAM type: NNNNGHTT; PAM sequence: GATTGATT
ccttcattgatggagactta

SEQ ID NO: 36699 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
gtgcaggtatctcttcaata

SEQ ID NO: 36700 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
aacctctgactccctggttc

SEQ ID NO: 36701 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccgagtag

SEQ ID NO: 36702 - DNA, 20 bp, Artificial Sequence
  Description of Artificial Sequence: Synthetic oligonucleotide
  Target: ATXN1; (+) strand; PAM type: NNNNGHTT; PAM sequence: CGGAGTTT
ttttgcatttatagtagaga

SEQ ID NO: 36703 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
agcaaacactttcttccaat

SEQ ID NO: 36704 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
aaacttttaaagtacatgga

SEQ ID NO: 36705 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
aacattcacatgttaagccc

SEQ ID NO: 36706 - DNA, 20 bp, Artificial Sequence
  Description of Artificial Sequence: Synthetic oligonucleotide
  Target: ATXN1; (+) strand; PAM type: NNNNGHTT; PAM sequence: GACAGATT
tacataatgtacccacaagt

SEQ ID NO: 36707 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
aacctccatccacctgagag

SEQ ID NO: 36708 - DNA, 20 bp, Artificial Sequence
  Description of Artificial Sequence: Synthetic oligonucleotide
  Target: ATXN1; (+) strand; PAM type: NNNNGHTT; PAM sequence: GGTAGATT
ttaatagttgactgaacttc

SEQ ID NO: 36709 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
atgaaacatcctcttcactt

SEQ ID NO: 36710 - DNA, 20 bp, Artificial Sequence
  Description of Artificial Sequence: Synthetic oligonucleotide
  Target: ATXN1; (+) strand; PAM type: NNNNGHTT; PAM sequence: GTTGGCTT
ttcttgtttcaaagtgagga

SEQ ID NO: 36711 - DNA, 20 bp, Artificial Sequence
  Description of Artificial Sequence: Synthetic oligonucleotide
  Target: ATXN1; (+) strand; PAM type: NNNNGHTT; PAM sequence: GTAAGATT
cctaaaatatgtacgtgtcg

SEQ ID NO: 36712 - DNA, 20 bp, Artificial Sequence
  Description of Artificial Sequence: Synthetic oligonucleotide
  Target: ATXN1; (+) strand; PAM type: NNNNGHTT; PAM sequence: GCTGGATT
gtctcactcacaagccacac

SEQ ID NO: 36713 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
ggattctgtgaggttaaaac

SEQ ID NO: 36714 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
tcctcagcccagcccgaatc

SEQ ID NO: 36715 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
tatgtagtgttatccttttg

SEQ ID NO: 36716 - DNA, 20 bp, Artificial Sequence
  Description of Artificial Sequence: Synthetic oligonucleotide
  Target: ATXN1; (+) strand; PAM type: NNNNGHTT; PAM sequence: AAACGCTT
atccttttgaagtgctttct

SEQ ID NO: 36717 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
acgcttaactcccttgggtc

SEQ ID NO: 36718 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
tcaccatccacctctgtccc

SEQ ID NO: 36719 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
ttattatttctctcacctca

SEQ ID NO: 36720 - DNA, 20 bp, Artificial Sequence
  Description of Artificial Sequence: Synthetic oligonucleotide
  Target: ATXN1; (+) strand; PAM type: NNNNGHTT; PAM sequence: TCTAGATT
taaaaacatactgaacactt

SEQ ID NO: 36721 - DNA, 20 bp, Artificial Sequence
  Description of Artificial Sequence: Synthetic oligonucleotide
  Target: ATXN1; (+) strand; PAM type: NNNNGHTT; PAM sequence: GTGGGCTT
gggccaggactcccatcaag

SEQ ID NO: 36722 - DNA, 20 bp, Artificial Sequence
  Description of Artificial Sequence: Synthetic oligonucleotide
  Target: ATXN1; (+) strand; PAM type: NNNNGHTT; PAM sequence: CTCGGCTT
gttgcctcatttgtgtgagt

SEQ ID NO: 36723 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
atagtgccagatacaaaata

SEQ ID NO: 36724 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
gtgaggactaaagaacactg

SEQ ID NO: 36725 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
aaagaacactggcatgtttt

SEQ ID NO: 36726 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
cactggcatgttttttttgt

SEQ ID NO: 36727 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ttgtttttgttttcttattt

SEQ ID NO: 36728 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
tatttttttgtttttattac

SEQ ID NO: 36729 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
agggtacatgtgcacaatgt

SEQ ID NO: 36730 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
cctgtgtccatggaacacag

SEQ ID NO: 36731 - DNA, 20 bp, Artificial Sequence
  Description of Artificial Sequence: Synthetic oligonucleotide
  Target: ATXN1; (+) strand; PAM type: NNNNGHTT; PAM sequence: CGTTGATT
gaacacaggcatgtttttaa

SEQ ID NO: 36732 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
attagccatgtaattgaacc

SEQ ID NO: 36733 - DNA, 20 bp, Artificial Sequence
  Description of Artificial Sequence: Synthetic oligonucleotide
  Target: ATXN1; (+) strand; PAM type: NNNNGHTT; PAM sequence: GCTAGTTT
tgcccactgagaagctccat

SEQ ID NO: 36734 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
tgttcaagcatttcgtatac

SEQ ID NO: 36735 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
aggaatgccacaaactggta

SEQ ID NO: 36736 - DNA, 20 bp, Artificial Sequence
  Description of Artificial Sequence: Synthetic oligonucleotide
  Target: ATXN1; (+) strand; PAM type: NNNNGHTT; PAM sequence: GACTGTTT
aaggaacatggctaagagca

SEQ ID NO: 36737 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
ttaagaaaggagaatcactc

SEQ ID NO: 36738 - DNA, 20 bp, Artificial Sequence
  Description of Artificial Sequence: Synthetic oligonucleotide
  Target: ATXN1; (+) strand; PAM type: NNNNGHTT; PAM sequence: ACAAGTTT
agctccatttatagaatcac

SEQ ID NO: 36739 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
ggcgtacactgactccttag

SEQ ID NO: 36740 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
tggtgtgctctactacaaaa

SEQ ID NO: 36741 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
gggacaaatgtgcagaacgt

SEQ ID NO: 36742 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
cataagtatacatgtatcac

SEQ ID NO: 36743 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
tgtacccttcaacccgtcat

SEQ ID NO: 36744 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
tacatgcagaggaccaagaa

SEQ ID NO: 36745 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
gaccaagaaccaagatttta

SEQ ID NO: 36746 - DNA, 20 bp, Artificial Sequence
  Description of Artificial Sequence: Synthetic oligonucleotide
  Target: ATXN1; (+) strand; PAM type: NNNNGHTT; PAM sequence: TTCCGTTT
aagattttattcagatttcc

SEQ ID NO: 36747 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
ttggctcatctatattttgg

SEQ ID NO: 36748 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
gtcgcattgatgcatttcat

SEQ ID NO: 36749 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
aagtcaggctaaagaaaata

SEQ ID NO: 36750 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
tttaccaagtaatgtataat

SEQ ID NO: 36751 - DNA, 20 bp, Artificial Sequence
  Description of Artificial Sequence: Synthetic oligonucleotide
  Target: ATXN1; (+) strand; PAM type: NNNNGHTT; PAM sequence: TCTAGATT
gttacatgtggaacatataa

SEQ ID NO: 36752 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
gcatgacatcattagcataa

SEQ ID NO: 36753 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
tagtgaataactattctgaa

SEQ ID NO: 36754 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
tgcttttataaaagtccttg

SEQ ID NO: 36755 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
aaatgttgctcagttcacca

SEQ ID NO: 36756 - DNA, 20 bp, Artificial Sequence
  Description of Artificial Sequence: Synthetic oligonucleotide
  Target: ATXN1; (+) strand; PAM type: NNNNGHTT; PAM sequence: GGTAGTTT
tttagaaagaaattctgcca

SEQ ID NO: 36757 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
tgctatggatcatgccttta

SEQ ID NO: 36758 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
tatgcaggagagggtatcag

SEQ ID NO: 36759 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
ttctgaagtgaaactaatca

SEQ ID NO: 36760 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
aaagttcataaatgttatct

SEQ ID NO: 36761 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
tggaatgacagcctggttac

SEQ ID NO: 36762 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
acgaatatggttgaatatga

SEQ ID NO: 36763 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
agaatatcaagaacttaagt

SEQ ID NO: 36764 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
cctctaacatcagtattatg

SEQ ID NO: 36765 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
caatgatttcattttaaact

SEQ ID NO: 36766 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
actaaatgattaaaatgtac

SEQ ID NO: 36767 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
ctttgttttaaaataggtat

SEQ ID NO: 36768 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
aggtatttgagtttctacag

SEQ ID NO: 36769 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
aagtcctagggcctctggtc

SEQ ID NO: 36770 - DNA, 20 bp, Artificial Sequence
  Description of Artificial Sequence: Synthetic oligonucleotide
  Target: ATXN1; (+) strand; PAM type: NNNNGHTT; PAM sequence: ACACGTTT
tccccacacctttcccccca

SEQ ID NO: 36771 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
ttccccccaacacgtttccc

SEQ ID NO: 36772 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
attacttttcaacatcctcc

SEQ ID NO: 36773 - DNA, 20 bp, Artificial Sequence
  Description of Artificial Sequence: Synthetic oligonucleotide
  Target: ATXN1; (+) strand; PAM type: NNNNGHTT; PAM sequence: AAAGGCTT
aattataccacaggaaaaaa

SEQ ID NO: 36774 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
agtctgtgaattcgtggtaa

SEQ ID NO: 36775 - DNA, 20 bp, Artificial Sequence
  Description of Artificial Sequence: Synthetic oligonucleotide
  Target: ATXN1; (+) strand; PAM type: NNNNGHTT; PAM sequence: GGAAGTTT
tgggtccaatgtaatcgcaa

SEQ ID NO: 36776 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
aaggaggaagaagtgtcaga

SEQ ID NO: 36777 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
gcacagagagatgcaacatt

SEQ ID NO: 36778 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ttgggaggctgaggcaggag

SEQ ID NO: 36779 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
gagaatgagcctggctgaca

SEQ ID NO: 36780 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
ttcagcctggtgagacctgt

SEQ ID NO: 36781 - DNA, 20 bp, Artificial Sequence
  Description of Artificial Sequence: Synthetic oligonucleotide
  Target: ATXN1; (+) strand; PAM type: NNNNGHTT; PAM sequence: AGTTGCTT
cagaactgtcagataaaaac

SEQ ID NO: 36782 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
cagcaatgaaaaactaacac

SEQ ID NO: 36783 - DNA, 20 bp, Artificial Sequence
  Description of Artificial Sequence: Synthetic oligonucleotide
  Target: ATXN1; (+) strand; PAM type: NNNNGHTT; PAM sequence: TCCGGCTT
agccagccacccacatactt

SEQ ID NO: 36784 - DNA, 20 bp, Artificial Sequence
  Description of Artificial Sequence: Synthetic oligonucleotide
  Target: ATXN1; (+) strand; PAM type: NNNNGHTT; PAM sequence: GGTAGTTT
cacaaatgggatatggcccg

SEQ ID NO: 36785 - DNA, 20 bp, Artificial Sequence
  Description of Artificial Sequence: Synthetic oligonucleotide
  Target: ATXN1; (+) strand; PAM type: NNNNGHTT; PAM sequence: CTCCGTTT
gcaatgctgctacctctttt

SEQ ID NO: 36786 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
ctgctcttcccactcacgcc

SEQ ID NO: 36787 - DNA, 20 bp, Artificial Sequence
  Description of Artificial Sequence: Synthetic oligonucleotide
  Target: ATXN1; (+) strand; PAM type: NNNNGHTT; PAM sequence: GGCTGATT
tcctcacctttgtcaaggca

SEQ ID NO: 36788 - DNA, 20 bp, Artificial Sequence
  Description of Artificial Sequence: Synthetic oligonucleotide
  Target: ATXN1; (+) strand; PAM type: NNNNGHTT; PAM sequence: ATCAGCTT
ttgtcaaggcaggctgattt

SEQ ID NO: 36789 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
gagaaggaaagggtctaagg

SEQ ID NO: 36790 - DNA, 20 bp, Artificial Sequence
  Description of Artificial Sequence: Synthetic oligonucleotide
  Target: ATXN1; (+) strand; PAM type: NNNNGHTT; PAM sequence: GACTGTTT
gatccttggttgaggcagag

SEQ ID NO: 36791 - DNA, 20 bp, Artificial Sequence
  Description of Artificial Sequence: Synthetic oligonucleotide
  Target: ATXN1; (+) strand; PAM type: NNNNGHTT; PAM sequence: TATTGATT
tggtgcattgtaggatatga

SEQ ID NO: 36792 - DNA, 20 bp, Artificial Sequence
  Description of Artificial Sequence: Synthetic oligonucleotide
  Target: ATXN1; (+) strand; PAM type: NNNNGHTT; PAM sequence: GATTGATT
gcattgtaggatatgatatt

SEQ ID NO: 36793 - DNA, 20 bp, Artificial Sequence
  Description of Artificial Sequence: Synthetic oligonucleotide
  Target: ATXN1; (+) strand; PAM type: NNNNGHTT; PAM sequence: GATTGATT
tgtaggatatgatattgatt

SEQ ID NO: 36794 - DNA, 20 bp, Artificial Sequence
  Description of Artificial Sequence: Synthetic oligonucleotide
  Target: ATXN1; (+) strand; PAM type: NNNNGHTT; PAM sequence: GATTGATT
ggatatgatattgattgatt

SEQ ID NO: 36795 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcgacctcctaaagtg

SEQ ID NO: 36796 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
actagatgccagtattgcta

SEQ ID NO: 36797 - DNA, 20 bp, Artificial Sequence
  Description of Artificial Sequence: Synthetic oligonucleotide
  Target: ATXN1; (+) strand; PAM type: NNNNGHTT; PAM sequence: ACGTGTTT
ccatacatggaaatgctcta

SEQ ID NO: 36798 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
tctcattcaaatgagtctcc

SEQ ID NO: 36799 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
atgagtctcccaaggattca

SEQ ID NO: 36800 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
ccagccacaggcaagggaaa

SEQ ID NO: 36801 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aagctccgcctcatgggttc

SEQ ID NO: 36802 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagtag

SEQ ID NO: 36803 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtatttttagtagaga

SEQ ID NO: 36804 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
caccttggcctccgaaaatg

SEQ ID NO: 36805 - DNA, 20 bp, Artificial Sequence
  Description of Artificial Sequence: Synthetic oligonucleotide
  Target: ATXN1; (+) strand; PAM type: NNNNGHTT; PAM sequence: ATAGGCTT
cctccgaaaatgctgggatt

SEQ ID NO: 36806 - DNA, 20 bp, Artificial Sequence
  Description of Artificial Sequence: Synthetic oligonucleotide
  Target: ATXN1; (+) strand; PAM type: NNNNGHTT; PAM sequence: CCTAGATT
agttcactgcaactttatta

SEQ ID NO: 36807 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
aataaaaatcctttcaatca

SEQ ID NO: 36808 - DNA, 20 bp, Artificial Sequence
  Description of Artificial Sequence: Synthetic oligonucleotide
  Target: ATXN1; (+) strand; PAM type: NNNNGHTT; PAM sequence: GATGGTTT
ctggctctgatggcaaaaca

SEQ ID NO: 36809 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
agaaacagatcatttcctca

SEQ ID NO: 36810 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
taaacaaacatgtgaaaaga

SEQ ID NO: 36811 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
ttctgaaatcttaaacagac

SEQ ID NO: 36812 - DNA, 20 bp, Artificial Sequence
  Description of Artificial Sequence: Synthetic oligonucleotide
  Target: ATXN1; (+) strand; PAM type: NNNNGHTT; PAM sequence: TGTAGATT
ggggaggtgggtgtctgtgt

SEQ ID NO: 36813 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
tagattggtgactttataga

SEQ ID NO: 36814 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
cctggcaactgaaagtaacc

SEQ ID NO: 36815 - DNA, 20 bp, Artificial Sequence
  Description of Artificial Sequence: Synthetic oligonucleotide
  Target: ATXN1; (+) strand; PAM type: NNNNGHTT; PAM sequence: CAACGTTT
ttaacagatccactttattt

SEQ ID NO: 36816 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
atccactttatttcaacgtt

SEQ ID NO: 36817 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
atgaaggcgaaaggagcagg

SEQ ID NO: 36818 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gaggtggaggctgcagtgag

SEQ ID NO: 36819 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
tattacattggtaagtgtga

SEQ ID NO: 36820 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
gaaaaaaatatatatacaac

SEQ ID NO: 36821 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
gctcttacatggactgagac

SEQ ID NO: 36822 - DNA, 20 bp, Artificial Sequence
  Description of Artificial Sequence: Synthetic oligonucleotide
  Target: ATXN1; (+) strand; PAM type: NNNNGHTT; PAM sequence: GCCAGATT
gactcaggttttaagaccct

SEQ ID NO: 36823 - DNA, 20 bp, Artificial Sequence
  Description of Artificial Sequence: Synthetic oligonucleotide
  Target: ATXN1; (+) strand; PAM type: NNNNGHTT; PAM sequence: ACTAGTTT
caactctttctggtattagc

SEQ ID NO: 36824 - DNA, 20 bp, Artificial Sequence
  Description of Artificial Sequence: Synthetic oligonucleotide
  Target: ATXN1; (+) strand; PAM type: NNNNGHTT; PAM sequence: CCACGATT
acaaacaatggcagagtatg

SEQ ID NO: 36825 - DNA, 20 bp, Artificial Sequence
  Description of Artificial Sequence: Synthetic oligonucleotide
  Target: ATXN1; (+) strand; PAM type: NNNNGHTT; PAM sequence: AATGGATT
gaaagcagtctgagtggtgg

SEQ ID NO: 36826 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
cctataaaaagaatataaaa

SEQ ID NO: 36827 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
atataaaattgggtttccta

SEQ ID NO: 36828 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
ctgattcccaactcacaaat

SEQ ID NO: 36829 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
aaattaaagtttcggttatg

SEQ ID NO: 36830 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
gttgtgataaaataatttta

SEQ ID NO: 36831 - DNA, 20 bp, Artificial Sequence
  Description of Artificial Sequence: Synthetic oligonucleotide
  Target: ATXN1; (+) strand; PAM type: NNNNGHTT; PAM sequence: ACCAGATT
ctggttggaaacatcttcct

SEQ ID NO: 36832 - DNA, 20 bp, Artificial Sequence
  Description of Artificial Sequence: Synthetic oligonucleotide
  Target: ATXN1; (+) strand; PAM type: NNNNGHTT; PAM sequence: ACAAGATT
ttttttttttctattccatc

SEQ ID NO: 36833 - DNA, 20 bp, Artificial Sequence
  Description of Artificial Sequence: Synthetic oligonucleotide
  Target: ATXN1; (+) strand; PAM type: NNNNGHTT; PAM sequence: AGGCGTTT
ttttgtagcctttcagatct

SEQ ID NO: 36834 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
tctaggcgtttgtctcattt

SEQ ID NO: 36835 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
caagaggttgtccttgtcct

SEQ ID NO: 36836 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
ggagaggggagtcttctatt

SEQ ID NO: 36837 - DNA, 20 bp, Artificial Sequence
  Description of Artificial Sequence: Synthetic oligonucleotide
  Target: ATXN1; (+) strand; PAM type: NNNNGHTT; PAM sequence: CTGCGTTT
tttacaagtcaaatatgcta

SEQ ID NO: 36838 - DNA, 20 bp, Artificial Sequence
  Description of Artificial Sequence: Synthetic oligonucleotide
  Target: ATXN1; (+) strand; PAM type: NNNNGHTT; PAM sequence: CATTGCTT
ataaaaattatttttcaggc

SEQ ID NO: 36839 - DNA, 20 bp, Artificial Sequence
  Description of Artificial Sequence: Synthetic oligonucleotide
  Target: ATXN1; (+) strand; PAM type: NNNNGHTT; PAM sequence: AGTGGTTT
gtcctcatcattaggtcagg

SEQ ID NO: 36840 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
ttccaagtcctatttatctc

SEQ ID NO: 36841 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
tctcatctgttttgcctgta

SEQ ID NO: 36842 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
aactgatgaaattcagatat

SEQ ID NO: 36843 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
ctattactgctcttaattca

SEQ ID NO: 36844 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
tatatttacagtgcacttga

SEQ ID NO: 36845 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
aaattaaatggtcatctgaa

SEQ ID NO: 36846 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
aaagtgtttggtgcactcga

SEQ ID NO: 36847 - DNA, 20 bp, Artificial Sequence
  Description of Artificial Sequence: Synthetic oligonucleotide
  Target: ATXN1; (+) strand; PAM type: NNNNGHTT; PAM sequence: GGCTGTTT
ttcttgcaacttttatcagg

SEQ ID NO: 36848 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
aaaacttgctgctctagcca

SEQ ID NO: 36849 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
aaatgaaatatgtccaatgc

SEQ ID NO: 36850 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
tgccaatgtttaagttactt

SEQ ID NO: 36851 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
ttggatatctattttaattc

SEQ ID NO: 36852 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
ttttgattttgagaaaatgt

SEQ ID NO: 36853 - DNA, 20 bp, Artificial Sequence
  Description of Artificial Sequence: Synthetic oligonucleotide
  Target: ATXN1; (+) strand; PAM type: NNNNGHTT; PAM sequence: CAGCGATT
agccaactattcaatatttt

SEQ ID NO: 36854 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
tattctatcttatattagaa

SEQ ID NO: 36855 - DNA, 20 bp, Artificial Sequence
  Description of Artificial Sequence: Synthetic oligonucleotide
  Target: ATXN1; (+) strand; PAM type: NNNNGHTT; PAM sequence: GTTAGTTT
caaaatgttattttcttaca

SEQ ID NO: 36856 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
taggaacataggatgtggaa

SEQ ID NO: 36857 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
agaatatttttatcattcct

SEQ ID NO: 36858 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
tattcagcatactaataatt

SEQ ID NO: 36859 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
catattaatttcaccaaaaa

SEQ ID NO: 36860 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
ttgggaggctgaggcagtag

SEQ ID NO: 36861 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
gagaagggaaatatagtgga

SEQ ID NO: 36862 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
aaaattaactttgaaaatcc

SEQ ID NO: 36863 - DNA, 20 bp, Artificial Sequence
  Description of Artificial Sequence: Synthetic oligonucleotide
  Target: ATXN1; (+) strand; PAM type: NNNNGHTT; PAM sequence: ACAGGATT
tttcccacaagacactccac

SEQ ID NO: 36864 - DNA, 20 bp, Artificial Sequence
  Description of Artificial Sequence: Synthetic oligonucleotide
  Target: ATXN1; (+) strand; PAM type: NNNNGHTT; PAM sequence: GGGGGATT
tgtatcactacagttaaacg

SEQ ID NO: 36865 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
gataaagataagtaaaatat

SEQ ID NO: 36866 - DNA, 20 bp, Artificial Sequence
  Description of Artificial Sequence: Synthetic oligonucleotide
  Target: ATXN1; (+) strand; PAM type: NNNNGHTT; PAM sequence: GTAAGCTT
tacttcattctgttgtaata

SEQ ID NO: 36867 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
cttttaaagataaatattta

SEQ ID NO: 36868 - DNA, 20 bp, Artificial Sequence
  Description of Artificial Sequence: Synthetic oligonucleotide
  Target: ATXN1; (+) strand; PAM type: NNNNGHTT; PAM sequence: CCTAGTTT
atacacctttatttttcttt

SEQ ID NO: 36869 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
cctgcctctttgctctgtac

SEQ ID NO: 36870 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
ctgtaactaattatcacaac

SEQ ID NO: 36871 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
aattctcatccattatactt

SEQ ID NO: 36872 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
ttgaaacatacattcctccg

SEQ ID NO: 36873 - DNA, 20 bp, Artificial Sequence
  Description of Artificial Sequence: Synthetic oligonucleotide
  Target: ATXN1; (+) strand; PAM type: NNNNGHTT; PAM sequence: GGGTGTTT
atgaaacaaatacaagtaat

SEQ ID NO: 36874 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
atggaacatgccaaaagatc

SEQ ID NO: 36875 - DNA, 20 bp, Artificial Sequence
  Description of Artificial Sequence: Synthetic oligonucleotide
  Target: ATXN1; (+) strand; PAM type: NNNNGHTT; PAM sequence: TATCGATT
atctacgagaggttagcctc

SEQ ID NO: 36876 - DNA, 20 bp, Artificial Sequence
  Description of Artificial Sequence: Synthetic oligonucleotide
  Target: ATXN1; (+) strand; PAM type: NNNNGHTT; PAM sequence: GAGTGATT
gaggttagcctctatcgatt

SEQ ID NO: 36877 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
tttcattaaaaaaattaaac

SEQ ID NO: 36878 - DNA, 20 bp, Artificial Sequence
  Description of Artificial Sequence: Synthetic oligonucleotide
  Target: ATXN1; (+) strand; PAM type: NNNNGHTT; PAM sequence: TGATGATT
aaggaagggagacatgatga

SEQ ID NO: 36879 - DNA, 20 bp, Artificial Sequence
  Description of Artificial Sequence: Synthetic oligonucleotide
  Target: ATXN1; (+) strand; PAM type: NNNNGHTT; PAM sequence: ATGGGATT
ccatcaatgagcaataatgc

SEQ ID NO: 36880 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
atgaaagagctcagtgaatc

SEQ ID NO: 36881 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
tgaatcaactgcttctgttg

SEQ ID NO: 36882 - DNA, 20 bp, Artificial Sequence
  Description of Artificial Sequence: Synthetic oligonucleotide
  Target: ATXN1; (+) strand; PAM type: NNNNGHTT; PAM sequence: TCATGATT
ctgtttatatatttttcaag

SEQ ID NO: 36883 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
gaacttgagggggaaaagat

SEQ ID NO: 36884 - DNA, 20 bp, Artificial Sequence
  Description of Artificial Sequence: Synthetic oligonucleotide
  Target: ATXN1; (+) strand; PAM type: NNNNGHTT; PAM sequence: GTTAGCTT
gaatcttgaactcagtctca

SEQ ID NO: 36885 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
tttcccttcttctttcttat

SEQ ID NO: 36886 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aacctccacctcccaggttc

SEQ ID NO: 36887 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagtag

SEQ ID NO: 36888 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
ttttgtatttttagtaaaga

SEQ ID NO: 36889 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
atgcagtttcaccatgatgg

SEQ ID NO: 36890 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcctcggcctcccaaagtg

SEQ ID NO: 36891 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
gccaccgcgcctggcctctc

SEQ ID NO: 36892 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
ttctgaagccacatagactt

SEQ ID NO: 36893 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
gccacatagacttacatgtt

SEQ ID NO: 36894 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
aagccagtgacaaatataat

SEQ ID NO: 36895 - DNA, 20 bp, Artificial Sequence
  Description of Artificial Sequence: Synthetic oligonucleotide
  Target: ATXN1; (+) strand; PAM type: NNNNGHTT; PAM sequence: GAGTGTTT
ataagcaagagacttcctaa

SEQ ID NO: 36896 - DNA, 20 bp, Artificial Sequence
  Description of Artificial Sequence: Synthetic oligonucleotide
  Target: ATXN1; (+) strand; PAM type: NNNNGHTT; PAM sequence: TCCCGCTT
cagtctgttaatcctcactt

SEQ ID NO: 36897 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
tcactttcccgcttctattc

SEQ ID NO: 36898 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
aaccagggagttgatgagat

SEQ ID NO: 36899 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
aaacaccacgaaaaggcatc

SEQ ID NO: 36900 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
aaaaaatagttatttaccaa

SEQ ID NO: 36901 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
atacaatcaatcacttcctc

SEQ ID NO: 36902 - DNA, 20 bp, Artificial Sequence
  Description of Artificial Sequence: Synthetic oligonucleotide
  Target: ATXN1; (+) strand; PAM type: NNNNGHTT; PAM sequence: TCTAGCTT
tctagaagtccatatgtcag

SEQ ID NO: 36903 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
cagtctagcttagagcaaaa

SEQ ID NO: 36904 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
tgcccaatgggccagcacac

SEQ ID NO: 36905 - DNA, 20 bp, Artificial Sequence
  Description of Artificial Sequence: Synthetic oligonucleotide
  Target: ATXN1; (+) strand; PAM type: NNNNGHTT; PAM sequence: CTGAGCTT
tgctttctaaattgacagcc

SEQ ID NO: 36906 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
gtggctgttaggataaagag

SEQ ID NO: 36907 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
taggataaagagggcagttt

SEQ ID NO: 36908 - DNA, 20 bp, Artificial Sequence
  Description of Artificial Sequence: Synthetic oligonucleotide
  Target: ATXN1; (+) strand; PAM type: NNNNGHTT; PAM sequence: AAGGGATT
ctattctggagatcacattg

SEQ ID NO: 36909 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
gggatttttgggctacctga

SEQ ID NO: 36910 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
gtgtttatgacagacagact

SEQ ID NO: 36911 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
tgacagacagactcttggat

SEQ ID NO: 36912 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
gtccttaaaaacagacagtg

SEQ ID NO: 36913 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
tgaactccattctagtacaa

SEQ ID NO: 36914 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
tagtgccggagggttaacca

SEQ ID NO: 36915 - DNA, 20 bp, Artificial Sequence
  Description of Artificial Sequence: Synthetic oligonucleotide
  Target: ATXN1; (+) strand; PAM type: NNNNGHTT; PAM sequence: TCACGCTT
ccaacaaatccagcccatga

SEQ ID NO: 36916 - DNA, 20 bp, Artificial Sequence
  Description of Artificial Sequence: Synthetic oligonucleotide
  Target: ATXN1; (+) strand; PAM type: NNNNGHTT; PAM sequence: ACTTGCTT
ctcctttggaaagatcttag

SEQ ID NO: 36917 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
ccataaccctcctctcattt

SEQ ID NO: 36918 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
ctcattttaaagttttcttt

SEQ ID NO: 36919 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
tatgggagaccaagttcctt

SEQ ID NO: 36920 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ggagaccaagttccttattg

SEQ ID NO: 36921 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
tgcttcctgtggaccaagga

SEQ ID NO: 36922 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
ttgagagtcggaagtggtct

SEQ ID NO: 36923 - DNA, 20 bp, Artificial Sequence
  Description of Artificial Sequence: Synthetic oligonucleotide
  Target: ATXN1; (+) strand; PAM type: NNNNGHTT; PAM sequence: GATTGTTT
gagtcggaagtggtctgaag

SEQ ID NO: 36924 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
cggaagtggtctgaaggatt

SEQ ID NO: 36925 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
gcctaatagctgttgtaaca

SEQ ID NO: 36926 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
gctggagtgcagtggctctc

SEQ ID NO: 36927 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
gtctcctttcttaaattagg

SEQ ID NO: 36928 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
gttttttttttttgaagaat

SEQ ID NO: 36929 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
tactatgtgggaaggaattc

SEQ ID NO: 36930 - DNA, 20 bp, Artificial Sequence
  Description of Artificial Sequence: Synthetic oligonucleotide
  Target: ATXN1; (+) strand; PAM type: NNNNGHTT; PAM sequence: ATTAGCTT
atcactaatgccatttgtat

SEQ ID NO: 36931 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
ttttgctaaactttaaaaat

SEQ ID NO: 36932 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
aataagtggagtgtggagca

SEQ ID NO: 36933 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
cgcccacagactatgaggca

SEQ ID NO: 36934 - DNA, 20 bp, Artificial Sequence
  Description of Artificial Sequence: Synthetic oligonucleotide
  Target: ATXN1; (+) strand; PAM type: NNNNGHTT; PAM sequence: TTATGCTT
tggcaaggcctttcaggggg

SEQ ID NO: 36935 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
gcctaattgataaagctaac

SEQ ID NO: 36936 - DNA, 20 bp, Artificial Sequence
  Description of Artificial Sequence: Synthetic oligonucleotide
  Target: ATXN1; (+) strand; PAM type: NNNNGHTT; PAM sequence: TTTAGCTT
taagagcagaaagcactgac

SEQ ID NO: 36937 - DNA, 20 bp, Artificial Sequence
  Description of Artificial Sequence: Synthetic oligonucleotide
  Target: ATXN1; (+) strand; PAM type: NNNNGHTT; PAM sequence: ACGTGATT
ggacaaaaagtataagtaat

SEQ ID NO: 36938 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
tataagtaatacgtgattaa

SEQ ID NO: 36939 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
cgaatattcttaatgaaaag

SEQ ID NO: 36940 - DNA, 20 bp, Artificial Sequence
  Description of Artificial Sequence: Synthetic oligonucleotide
  Target: ATXN1; (+) strand; PAM type: NNNNGHTT; PAM sequence: TTTCGCTT
ttactcaaaatgcattgtct

SEQ ID NO: 36941 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
gtgcatggtggcaaaggcaa

SEQ ID NO: 36942 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
tttttggtaataccttgtta

SEQ ID NO: 36943 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
tccaatattccacgagacag

SEQ ID NO: 36944 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
acatgcggatgtccctaaaa

SEQ ID NO: 36945 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
tctctctaggctagaaacag

SEQ ID NO: 36946 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
ctctctacactttttaaaaa

SEQ ID NO: 36947 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
actgagaacctcctttgtgg

SEQ ID NO: 36948 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
aacctcctttgtggccagga

SEQ ID NO: 36949 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
catggggctgtaattccatc

SEQ ID NO: 36950 - DNA, 20 bp, Artificial Sequence
  Description of Artificial Sequence: Synthetic oligonucleotide
  Target: ATXN1; (+) strand; PAM type: NNNNGHTT; PAM sequence: GTCTGCTT
tacaaccaggaggccaagct

SEQ ID NO: 36951 - DNA, 20 bp, Artificial Sequence
  Description of Artificial Sequence: Synthetic oligonucleotide
  Target: ATXN1; (+) strand; PAM type: NNNNGHTT; PAM sequence: ACAAGATT
gtgatatatatcgggtgatg

SEQ ID NO: 36952 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
agggaaaaaaaaaaacttta

SEQ ID NO: 36953 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
attaaactcagagttgtaga

SEQ ID NO: 36954 - DNA, 20 bp, Artificial Sequence
  Description of Artificial Sequence: Synthetic oligonucleotide
  Target: ATXN1; (+) strand; PAM type: NNNNGHTT; PAM sequence: AACGGATT
agttgtagaaaaagtttaga

SEQ ID NO: 36955 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
atatttatatttagaataca

SEQ ID NO: 36956 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
attggccacttttaacatag

SEQ ID NO: 36957 - DNA, 20 bp, Artificial Sequence
  Description of Artificial Sequence: Synthetic oligonucleotide
  Target: ATXN1; (+) strand; PAM type: NNNNGHTT; PAM sequence: AGGAGCTT
gagaatgagacatatcattt

SEQ ID NO: 36958 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
tatctgtctcttggggtctc

SEQ ID NO: 36959 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
taccagctggatgaacagtt

SEQ ID NO: 36960 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
tgacagacaaaactcctaac

SEQ ID NO: 36961 - DNA, 20 bp, Artificial Sequence
  Description of Artificial Sequence: Synthetic oligonucleotide
  Target: ATXN1; (+) strand; PAM type: NNNNGHTT; PAM sequence: ACCTGCTT
aaattcagtaatgatgaagt

SEQ ID NO: 36962 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
aatattctgggtgacatcca

SEQ ID NO: 36963 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
caataaactattttgtgaaa

SEQ ID NO: 36964 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
gtgaaatcaagtttagtaac

SEQ ID NO: 36965 - DNA, 20 bp, Artificial Sequence
  Description of Artificial Sequence: Synthetic oligonucleotide
  Target: ATXN1; (+) strand; PAM type: NNNNGHTT; PAM sequence: ACCTGATT
tatccctgacaaccaccaaa

SEQ ID NO: 36966 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
gacatctctctcctttgtct

SEQ ID NO: 36967 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
tgtgtccatgtatttaaaca

SEQ ID NO: 36968 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
gatggagctggtgagtcagg

SEQ ID NO: 36969 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
tgggaaggagtgggaaagaa

SEQ ID NO: 36970 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
tttttattttttatattgtt

SEQ ID NO: 36971 - DNA, 20 bp, Artificial Sequence
  Description of Artificial Sequence: Synthetic oligonucleotide
  Target: ATXN1; (+) strand; PAM type: NNNNGHTT; PAM sequence: CCTAGATT
aagggatcctcccaccttgg

SEQ ID NO: 36972 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
tgtagttatgggttataatg

SEQ ID NO: 36973 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
atatagctacatatactata

SEQ ID NO: 36974 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
actataaaatgattatatta

SEQ ID NO: 36975 - DNA, 20 bp, Artificial Sequence
  Description of Artificial Sequence: Synthetic oligonucleotide
  Target: ATXN1; (+) strand; PAM type: NNNNGHTT; PAM sequence: TACCGTTT
ttgtctaactgaaacgtctg

SEQ ID NO: 36976 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
gtaccgtttgatcaaccaaa

SEQ ID NO: 36977 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
tcctcatttttgtcttcatt

SEQ ID NO: 36978 - DNA, 20 bp, Artificial Sequence
  Description of Artificial Sequence: Synthetic oligonucleotide
  Target: ATXN1; (+) strand; PAM type: NNNNGHTT; PAM sequence: TCAGGATT
aggaagatgaaacaaaccac

SEQ ID NO: 36979 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
attctgaagggaacactggg

SEQ ID NO: 36980 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
gttttttttaattttaattt

SEQ ID NO: 36981 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
ctgcatcaggctcatccagt

SEQ ID NO: 36982 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
ccagttgaggttttttaaaa

SEQ ID NO: 36983 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
tttttaaaatactgtttttg

SEQ ID NO: 36984 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
agaggaggaagagagtcatg

SEQ ID NO: 36985 - DNA, 20 bp, Artificial Sequence
  Description of Artificial Sequence: Synthetic oligonucleotide
  Target: ATXN1; (+) strand; PAM type: NNNNGHTT; PAM sequence: GCTTGATT
gaggaagagagtcatgatga

SEQ ID NO: 36986 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
gcaactagatgtgtgagtga

SEQ ID NO: 36987 - DNA, 20 bp, Artificial Sequence
  Description of Artificial Sequence: Synthetic oligonucleotide
  Target: ATXN1; (+) strand; PAM type: NNNNGHTT; PAM sequence: GAGGGATT
gacattgattcctattacca

SEQ ID NO: 36988 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
attaactccaaagttctctt

SEQ ID NO: 36989 - DNA, 20 bp, Artificial Sequence
  Description of Artificial Sequence: Synthetic oligonucleotide
  Target: ATXN1; (+) strand; PAM type: NNNNGHTT; PAM sequence: ATGGGCTT
caaaggtaattaacctcttg

SEQ ID NO: 36990 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
ttattgagaaaaagtaactc

SEQ ID NO: 36991 - DNA, 20 bp, Artificial Sequence
  Description of Artificial Sequence: Synthetic oligonucleotide
  Target: ATXN1; (+) strand; PAM type: NNNNGHTT; PAM sequence: TGTAGATT
gaacatatgaatcacagaat

SEQ ID NO: 36992 - DNA, 20 bp, Artificial Sequence
  Description of Artificial Sequence: Synthetic oligonucleotide
  Target: ATXN1; (+) strand; PAM type: NNNNGHTT; PAM sequence: CCCAGATT
gtgcctcctgtccttagagc

SEQ ID NO: 36993 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
gccccagatttcattttagg

SEQ ID NO: 36994 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
agtcaacaagcaacttattg

SEQ ID NO: 36995 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
tggaatgaagaagaaatatg

SEQ ID NO: 36996 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
tgaaaatgcatatgcagtat

SEQ ID NO: 36997 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
gtaaaggaaaatgaaagaag

SEQ ID NO: 36998 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
ttaaaatttaaaaccacatt

SEQ ID NO: 36999 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
taaaaccacattaaaagatt

SEQ ID NO: 37000 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
gcacctattaagctgttact

SEQ ID NO: 37001 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
acagacagaacaaaagtggt

SEQ ID NO: 37002 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
tatcaaagaactcccccagg

SEQ ID NO: 37003 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
tcaggaggctgagacagtag

SEQ ID NO: 37004 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
actctgcaaatatgtacttt

SEQ ID NO: 37005 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
attgaagtaaacatttttct

SEQ ID NO: 37006 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
aactatatggcaagtaatct

SEQ ID NO: 37007 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
taatattaacaaatgtaatc

SEQ ID NO: 37008 - DNA, 20 bp, Artificial Sequence
  Description of Artificial Sequence: Synthetic oligonucleotide
  Target: ATXN1; (+) strand; PAM type: NNNNGHTT; PAM sequence: ATAAGCTT
agatgggaagatatggatag

SEQ ID NO: 37009 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
tctggagccaaagctctaag

SEQ ID NO: 37010 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
acctactaacagggccactg

SEQ ID NO: 37011 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
agaacatcagagatgtgagc

SEQ ID NO: 37012 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
ctccgccattgatctactgt

SEQ ID NO: 37013 - DNA, 20 bp, Artificial Sequence
  Description of Artificial Sequence: Synthetic oligonucleotide
  Target: ATXN1; (+) strand; PAM type: NNNNGHTT; PAM sequence: TCAAGCTT
tatgagcttaggcaagtccc

SEQ ID NO: 37014 - DNA, 20 bp, Artificial Sequence
  Description of Artificial Sequence: Synthetic oligonucleotide
  Target: ATXN1; (+) strand; PAM type: NNNNGHTT; PAM sequence: CCTTGCTT
taaaaatgggataccagcgg

SEQ ID NO: 37015 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
atggaagacaaggtatgtga

SEQ ID NO: 37016 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
gactctgaagtaccttcagg

SEQ ID NO: 37017 - DNA, 20 bp, Artificial Sequence
  Description of Artificial Sequence: Synthetic oligonucleotide
  Target: ATXN1; (+) strand; PAM type: NNNNGHTT; PAM sequence: CCTAGTTT
aaagattaaattatgttcag

SEQ ID NO: 37018 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
ccaccctagggtaggaaaaa

SEQ ID NO: 37019 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
ttaatctacctaagatgcct

SEQ ID NO: 37020 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
ttcttgctaagaatgaattc

SEQ ID NO: 37021 - DNA, 20 bp, Artificial Sequence
  Description of Artificial Sequence: Synthetic oligonucleotide
  Target: ATXN1; (+) strand; PAM type: NNNNGHTT; PAM sequence: ATCCGATT
aataacacaaatatatcact

SEQ ID NO: 37022 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
ctgagaagaggaaattaaca

SEQ ID NO: 37023 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
attaacatttagtttactgg

SEQ ID NO: 37024 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagtag

SEQ ID NO: 37025 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
tttttgtattttagtggagg

SEQ ID NO: 37026 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
tgtaaaagcacagttattta

SEQ ID NO: 37027 - DNA, 20 bp, Artificial Sequence
  Description of Artificial Sequence: Synthetic oligonucleotide
  Target: ATXN1; (+) strand; PAM type: NNNNGHTT; PAM sequence: TGTAGATT
tgtttaaattatttcaacac

SEQ ID NO: 37028 - DNA, 20 bp, Artificial Sequence
  Description of Artificial Sequence: Synthetic oligonucleotide
  Target: ATXN1; (+) strand; PAM type: NNNNGHTT; PAM sequence: TTCCGATT
actgtagattatgttatctt

SEQ ID NO: 37029 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
tgataagagggtcctactac

SEQ ID NO: 37030 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
gtttgaacatctccagtgac

SEQ ID NO: 37031 - DNA, 20 bp, Artificial Sequence
  Description of Artificial Sequence: Synthetic oligonucleotide
  Target: ATXN1; (+) strand; PAM type: NNNNGHTT; PAM sequence: ATCAGCTT
gaggtttcactgctaaatca

SEQ ID NO: 37032 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
cttgttccatttttagacag

SEQ ID NO: 37033 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
tactctaccaccacttcagt

SEQ ID NO: 37034 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
attttatcagttaggtaatg

SEQ ID NO: 37035 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
tggggtcctgccatcacata

SEQ ID NO: 37036 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
tatttctacttttgggaaaa

SEQ ID NO: 37037 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
agcagtcttatgagccaagt

SEQ ID NO: 37038 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
tgtagtatccagatgactac

SEQ ID NO: 37039 - DNA, 20 bp, Artificial Sequence
  Description of Artificial Sequence: Synthetic oligonucleotide
  Target: ATXN1; (+) strand; PAM type: NNNNGHTT; PAM sequence: GACAGCTT
tgggcccagcctaggacgga

SEQ ID NO: 37040 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
gtaccttcatcttgagaggt

SEQ ID NO: 37041 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
gcctgggcaacagagtgaga

SEQ ID NO: 37042 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
ctaggaatgagaattaatgt

SEQ ID NO: 37043 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
atgagaattaatgtatatga

SEQ ID NO: 37044 - DNA, 20 bp, Artificial Sequence
  Description of Artificial Sequence: Synthetic oligonucleotide
  Target: ATXN1; (+) strand; PAM type: NNNNGHTT; PAM sequence: TAGTGATT
ttaatgtatatgattcagct

SEQ ID NO: 37045 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
tgattcagcttagtgatttt

SEQ ID NO: 37046 - DNA, 20 bp, Artificial Sequence
  Description of Artificial Sequence: Synthetic oligonucleotide
  Target: ATXN1; (+) strand; PAM type: NNNNGHTT; PAM sequence: GATTGATT
tcagcttagtgattttatca

SEQ ID NO: 37047 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
tgattttatcagattgatta

SEQ ID NO: 37048 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
gattgattatctggtttctc

SEQ ID NO: 37049 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
cagatataggcaaatatgaa

SEQ ID NO: 37050 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
ctgtggcatcgagaagaatt

SEQ ID NO: 37051 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
aaattttataatacatttta

SEQ ID NO: 37052 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
atgatttctgccggaaaatg

SEQ ID NO: 37053 - DNA, 20 bp, Artificial Sequence
  Description of Artificial Sequence: Synthetic oligonucleotide
  Target: ATXN1; (+) strand; PAM type: NNNNGHTT; PAM sequence: TACGGTTT
attgaggaactcttaagaat

SEQ ID NO: 37054 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
tagtgctgtcataaagcccc

SEQ ID NO: 37055 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
cctcttttcagaatagtgga

SEQ ID NO: 37056 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
aacatggtagttccatcagt

SEQ ID NO: 37057 - DNA, 20 bp, Artificial Sequence
  Description of Artificial Sequence: Synthetic oligonucleotide
  Target: ATXN1; (+) strand; PAM type: NNNNGHTT; PAM sequence: CGAGGCTT
gagttttaaggaagcgttgg

SEQ ID NO: 37058 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
acagaacatatattagttaa

SEQ ID NO: 37059 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
catatattagttaattttgc

SEQ ID NO: 37060 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
cacaaaaattctaattacaa

SEQ ID NO: 37061 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
taatttccacttcttcaact

SEQ ID NO: 37062 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
ttccacttcttcaactatct

SEQ ID NO: 37063 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
gacgccatttagaatatagc

SEQ ID NO: 37064 - DNA, 20 bp, Artificial Sequence
  Description of Artificial Sequence: Synthetic oligonucleotide
  Target: ATXN1; (+) strand; PAM type: NNNNGHTT; PAM sequence: TAGGGCTT
ttttttggtacaaaaatctc

SEQ ID NO: 37065 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
taaagatcttttttttccta

SEQ ID NO: 37066 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
atataaaaacagcactctca

SEQ ID NO: 37067 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tctcactgggcttaatcccc

SEQ ID NO: 37068 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
actcttctaacaaagccaaa

SEQ ID NO: 37069 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
aataaccaatgggacatgga

SEQ ID NO: 37070 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
agaggcccactcaggcaccc

SEQ ID NO: 37071 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
ctgcagacatatctcaccca

SEQ ID NO: 37072 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
attagtgactgttgctgaag

SEQ ID NO: 37073 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
tgaagaagggcttcactgaa

SEQ ID NO: 37074 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
cactcccagtagctgggaga

SEQ ID NO: 37075 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
ggagatgatgcttcattgtt

SEQ ID NO: 37076 - DNA, 20 bp, Artificial Sequence
  Description of Artificial Sequence: Synthetic oligonucleotide
  Target: ATXN1; (+) strand; PAM type: NNNNGHTT; PAM sequence: AGTGGATT
acaaataaaccttttgctaa

SEQ ID NO: 37077 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
gacagataatttccacagtg

SEQ ID NO: 37078 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
aaactgttcttgaagtatga

SEQ ID NO: 37079 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
attaaattaggagtctggag

SEQ ID NO: 37080 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
atttaaccgcactaagcctc

SEQ ID NO: 37081 - DNA, 20 bp, Artificial Sequence
  Description of Artificial Sequence: Synthetic oligonucleotide
  Target: ATXN1; (+) strand; PAM type: NNNNGHTT; PAM sequence: TTAAGCTT
ttaggttcaattaaagccat

SEQ ID NO: 37082 - DNA, 20 bp, Artificial Sequence
  Description of Artificial Sequence: Synthetic oligonucleotide
  Target: ATXN1; (+) strand; PAM type: NNNNGHTT; PAM sequence: CTACGATT
gccatttaagctttaaaatt

SEQ ID NO: 37083 - DNA, 20 bp, Artificial Sequence
  Description of Artificial Sequence: Synthetic oligonucleotide
  Target: ATXN1; (+) strand; PAM type: NNNNGHTT; PAM sequence: ACCTGCTT
aataaactgtatttaataat

SEQ ID NO: 37084 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tctaaccagaaaagaataaa

SEQ ID NO: 37085 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tcttccaaagaaaaatagcc

SEQ ID NO: 37086 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
ttgttttctattgttcagtg

SEQ ID NO: 37087 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
gaatctttgacctcaccatt

SEQ ID NO: 37088 - DNA, 20 bp, Artificial Sequence
  Description of Artificial Sequence: Synthetic oligonucleotide
  Target: ATXN1; (+) strand; PAM type: NNNNGHTT; PAM sequence: GCTAGATT
catgtccggctgaattcaga

SEQ ID NO: 37089 - DNA, 20 bp, Artificial Sequence
  Description of Artificial Sequence: Synthetic oligonucleotide
  Target: ATXN1; (+) strand; PAM type: NNNNGHTT; PAM sequence: GTGGGTTT
aattcagagctagattccaa

SEQ ID NO: 37090 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
tgaagtcagagaactgcaaa

SEQ ID NO: 37091 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
actgcaaatgttgtttcacc

SEQ ID NO: 37092 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
tgtttcaccatctgtttatt

SEQ ID NO: 37093 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
tcatcagagtgaggtctgaa

SEQ ID NO: 37094 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
tgataagaagaaaaagaagc

SEQ ID NO: 37095 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
ccaaatgaaatgtcagactc

SEQ ID NO: 37096 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
tgggccattctttttgacca

SEQ ID NO: 37097 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
cagtaggaagcaacacagta

SEQ ID NO: 37098 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
ataaactattattaagccat

SEQ ID NO: 37099 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
tttatgaaacacatgtggta

SEQ ID NO: 37100 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
aaacacatgtggtaggcagt

SEQ ID NO: 37101 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
tgcagcagagaaaactcaaa

SEQ ID NO: 37102 - DNA, 20 bp, Artificial Sequence
  Description of Artificial Sequence: Synthetic oligonucleotide
  Target: ATXN1; (+) strand; PAM type: NNNNGHTT; PAM sequence: CCCTGATT
agaaaagataagaacacagt

SEQ ID NO: 37103 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
atttgcctctgcccctgttc

SEQ ID NO: 37104 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
aggagggtggaagaggagag

SEQ ID NO: 37105 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
tttaataaccttaccaggag

SEQ ID NO: 37106 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
ggccgacccaaacaatatac

SEQ ID NO: 37107 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
ataccccagcttcagcctcc

SEQ ID NO: 37108 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
tgtaacgtggtaagcagacg

SEQ ID NO: 37109 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
agacgtgctgcttttagctg

SEQ ID NO: 37110 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
tgctgcttttagctgctagg

SEQ ID NO: 37111 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
agctgctaggctttgcttct

SEQ ID NO: 37112 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
aattactatcacctttaaac

SEQ ID NO: 37113 - DNA, 20 bp, Artificial Sequence
  Description of Artificial Sequence: Synthetic oligonucleotide
  Target: ATXN1; (+) strand; PAM type: NNNNGHTT; PAM sequence: CGAGGTTT
tggtaatatctgaacagaag

SEQ ID NO: 37114 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
tggcatacgtgttgtgacgt

SEQ ID NO: 37115 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
ctatttgaagatgccattaa

SEQ ID NO: 37116 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
agaaagagacagaggaaaaa

SEQ ID NO: 37117 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
aaaagaggaagtcaaattgt

SEQ ID NO: 37118 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
atgagtgacctcctattcac

SEQ ID NO: 37119 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
ccatactgcccaaggtaatt

SEQ ID NO: 37120 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
gacaaaaacaagaaatgggg

SEQ ID NO: 37121 - DNA, 20 bp, Artificial Sequence
  Description of Artificial Sequence: Synthetic oligonucleotide
  Target: ATXN1; (+) strand; PAM type: NNNNGHTT; PAM sequence: GATGGATT
ttatacaaaaattaattcaa

SEQ ID NO: 37122 - DNA, 20 bp, Artificial Sequence
  Description of Artificial Sequence: Synthetic oligonucleotide
  Target: ATXN1; (+) strand; PAM type: NNNNGHTT; PAM sequence: AAGAGCTT
aatgggatctaattaaacta

SEQ ID NO: 37123 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
gagacataggaacattttta

SEQ ID NO: 37124 - DNA, 20 bp, Artificial Sequence
  Description of Artificial Sequence: Synthetic oligonucleotide
  Target: ATXN1; (+) strand; PAM type: NNNNGHTT; PAM sequence: TGGCGATT
aaccattgtggaagtcagtg

SEQ ID NO: 37125 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
ctataaagacacatgcacac

SEQ ID NO: 37126 - DNA, 20 bp, Artificial Sequence
  Description of Artificial Sequence: Synthetic oligonucleotide
  Target: ATXN1; (+) strand; PAM type: NNNNGHTT; PAM sequence: TGACGATT
ggagatatacctaatgtaaa

SEQ ID NO: 37127 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
ctctatgaaaagtattgcaa

SEQ ID NO: 37128 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
ctatactgggctgtgggggt

SEQ ID NO: 37129 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
gtaaatgtttcctttcttta

SEQ ID NO: 37130 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ccgggagcctgagccaggag

SEQ ID NO: 37131 - DNA, 20 bp, Artificial Sequence
  Description of Artificial Sequence: Synthetic oligonucleotide
  Target: ATXN1; (+) strand; PAM type: NNNNGHTT; PAM sequence: GCGAGATT
ctccagtgcaggcaacaaga

SEQ ID NO: 37132 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
ataacaacaacggttaaagc

SEQ ID NO: 37133 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
tcatggagcccacactgtac

SEQ ID NO: 37134 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
ggtctccagagcctgctaag

SEQ ID NO: 37135 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
ttctactcgggtgcaagagc

SEQ ID NO: 37136 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
tgcaagagcaatggcttatt

SEQ ID NO: 37137 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
cctctgaaccccctttcccc

SEQ ID NO: 37138 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
tctgtacagatcaaaatctc

SEQ ID NO: 37139 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
gggactgccataatttgagg

SEQ ID NO: 37140 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
tcctttgaagccgcagtgca

SEQ ID NO: 37141 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
acctcagagctgaagtgatc

SEQ ID NO: 37142 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
gaagtctcaaagttacacac

SEQ ID NO: 37143 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
acctctctcatctgtaattg

SEQ ID NO: 37144 - DNA, 20 bp, Artificial Sequence
  Description of Artificial Sequence: Synthetic oligonucleotide
  Target: ATXN1; (+) strand; PAM type: NNNNGHTT; PAM sequence: ACACGATT
gtctctgtgacaggaatatg

SEQ ID NO: 37145 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
cctacttcaaacaatagccc

SEQ ID NO: 37146 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
actgttttgctcaccccaca

SEQ ID NO: 37147 - DNA, 20 bp, Artificial Sequence
  Description of Artificial Sequence: Synthetic oligonucleotide
  Target: ATXN1; (+) strand; PAM type: NNNNGHTT; PAM sequence: CCTTGCTT
gctcatcaagtcctctaaat

SEQ ID NO: 37148 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
agaagccgcagcacacagac

SEQ ID NO: 37149 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
ttttcaacattcctctgtca

SEQ ID NO: 37150 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
tctgtcacctggatttctac

SEQ ID NO: 37151 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
tccaagataaaatccaagat

SEQ ID NO: 37152 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
gcctcactatggacctacca

SEQ ID NO: 37153 - DNA, 20 bp, Artificial Sequence
  Description of Artificial Sequence: Synthetic oligonucleotide
  Target: ATXN1; (+) strand; PAM type: NNNNGHTT; PAM sequence: CCAAGCTT
cttcttttgtctttctttgc

SEQ ID NO: 37154 - DNA, 20 bp, Artificial Sequence
  Description of Artificial Sequence: Synthetic oligonucleotide
  Target: ATXN1; (+) strand; PAM type: NNNNGHTT; PAM sequence: AAAAGCTT
ctgaacaactcctcattctg

SEQ ID NO: 37155 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
gtatgaaacataccctacca

SEQ ID NO: 37156 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
ccataatgcttaacagagag

SEQ ID NO: 37157 - DNA, 20 bp, Artificial Sequence
  Description of Artificial Sequence: Synthetic oligonucleotide
  Target: ATXN1; (+) strand; PAM type: NNNNGHTT; PAM sequence: TTATGCTT
gtcaaagaccacatcctatc

SEQ ID NO: 37158 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
aggaagagagggccgggcac

SEQ ID NO: 37159 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
tcaggagactgaggcaggag

SEQ ID NO: 37160 - DNA, 20 bp, Artificial Sequence
  Description of Artificial Sequence: Synthetic oligonucleotide
  Target: ATXN1; (+) strand; PAM type: NNNNGHTT; PAM sequence: CCGAGATT
gaggcggaagttgcagggag

SEQ ID NO: 37161 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
aagaggaccctgagagggtt

SEQ ID NO: 37162 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
cttcttccaatccatcccat

SEQ ID NO: 37163 - DNA, 20 bp, Artificial Sequence
  Description of Artificial Sequence: Synthetic oligonucleotide
  Target: ATXN1; (+) strand; PAM type: NNNNGHTT; PAM sequence: ACGAGCTT
actttatcacctcccgctag

SEQ ID NO: 37164 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
cctcccgctagacgagcttc

SEQ ID NO: 37165 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
tctatactaggacatatacc

SEQ ID NO: 37166 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
atttttagacataaaggaaa

SEQ ID NO: 37167 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
aaaggaaactatgtttatac

SEQ ID NO: 37168 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
aactatgtttatacctaagt

SEQ ID NO: 37169 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
gaagctaaaaatcttaataa

SEQ ID NO: 37170 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
tatacaatgacattaaaact

SEQ ID NO: 37171 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
gcaaaaggaacaaccaataa

SEQ ID NO: 37172 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
ttagcaattaaggaaaaaag

SEQ ID NO: 37173 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
ttccccacgtctgtgaatta

SEQ ID NO: 37174 - DNA, 20 bp, Artificial Sequence
  Description of Artificial Sequence: Synthetic oligonucleotide
  Target: ATXN1; (+) strand; PAM type: NNNNGHTT; PAM sequence: AGTAGATT
cttgtagccatattcagatc

SEQ ID NO: 37175 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
aatcacttgaacccagggaa

SEQ ID NO: 37176 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
ggaacagagtttgcagtgag

SEQ ID NO: 37177 - DNA, 20 bp, Artificial Sequence
  Description of Artificial Sequence: Synthetic oligonucleotide
  Target: ATXN1; (+) strand; PAM type: NNNNGHTT; PAM sequence: AAGAGCTT
aaacagtagttcattctttg

SEQ ID NO: 37178 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
gatgatacaactgttctgta

SEQ ID NO: 37179 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
aaagggaatattttacttta

SEQ ID NO: 37180 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
cacaaagagaactccaagcc

SEQ ID NO: 37181 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
ctggttcttatcccaggaac

SEQ ID NO: 37182 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
tcttatcccaggaactcaag

SEQ ID NO: 37183 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
ttatataaataatttgaaaa

SEQ ID NO: 37184 - DNA, 20 bp, Artificial Sequence
  Description of Artificial Sequence: Synthetic oligonucleotide
  Target: ATXN1; (+) strand; PAM type: NNNNGHTT; PAM sequence: CCGTGTTT
aaaaggcagagaaagatata

SEQ ID NO: 37185 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
gatataccgtgtttttgaat

SEQ ID NO: 37186 - DNA, 20 bp, Artificial Sequence
  Description of Artificial Sequence: Synthetic oligonucleotide
  Target: ATXN1; (+) strand; PAM type: NNNNGHTT; PAM sequence: TTATGATT
attttccttaaatttctctc

SEQ ID NO: 37187 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
gcaatctgaactaacttcta

SEQ ID NO: 37188 - DNA, 20 bp, Artificial Sequence
  Description of Artificial Sequence: Synthetic oligonucleotide
  Target: ATXN1; (+) strand; PAM type: NNNNGHTT; PAM sequence: GGGGGATT
acaggcttttttggggggta

SEQ ID NO: 37189 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
agacagagaggactcacgct

SEQ ID NO: 37190 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
aggactcacgctatctgttt

SEQ ID NO: 37191 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
caagatttaccataaagcta

SEQ ID NO: 37192 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
aggcacatgccacctcaccc

SEQ ID NO: 37193 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 37194 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcggcctcccaaagta

SEQ ID NO: 37195 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcagcctcccaaggtg

SEQ ID NO: 37196 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
cttaaaacacatataaaacc

SEQ ID NO: 37197 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
aaaaaaatcacttcaataat

SEQ ID NO: 37198 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
atttaaaggggctcatcaaa

SEQ ID NO: 37199 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
accatctatatctatataga

SEQ ID NO: 37200 - DNA, 20 bp, Artificial Sequence
  Description of Artificial Sequence: Synthetic oligonucleotide
  Target: ATXN1; (+) strand; PAM type: NNNNGHTT; PAM sequence: GATTGTTT
tctatatctatatagatata

SEQ ID NO: 37201 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
tatctatatagatatagatt

SEQ ID NO: 37202 - DNA, 20 bp, Artificial Sequence
  Description of Artificial Sequence: Synthetic oligonucleotide
  Target: ATXN1; (+) strand; PAM type: NNNNGHTT; PAM sequence: GCAGGCTT
tggcaccatcatgactcact

SEQ ID NO: 37203 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcagcctcctgagtat

SEQ ID NO: 37204 - DNA, 20 bp, Artificial Sequence
  Description of Artificial Sequence: Synthetic oligonucleotide
  Target: ATXN1; (+) strand; PAM type: NNNNGHTT; PAM sequence: CCTAGTTT
ggtgcgtgccactgctgccg

SEQ ID NO: 37205 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
ttttgtatttttaatagaga

SEQ ID NO: 37206 - DNA, 20 bp, Artificial Sequence
  Description of Artificial Sequence: Synthetic oligonucleotide
  Target: ATXN1; (+) strand; PAM type: NNNNGHTT; PAM sequence: GACTGATT
agcagatacgaaaaagtact

SEQ ID NO: 37207 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
ggtgatggaaatgtcccata

SEQ ID NO: 37208 - DNA, 20 bp, Artificial Sequence
  Description of Artificial Sequence: Synthetic oligonucleotide
  Target: ATXN1; (+) strand; PAM type: NNNNGHTT; PAM sequence: TGCTGATT
gtcccatatcttgattagga

SEQ ID NO: 37209 - DNA, 20 bp, Artificial Sequence
  Description of Artificial Sequence: Synthetic oligonucleotide
  Target: ATXN1; (+) strand; PAM type: NNNNGHTT; PAM sequence: GTACGCTT
tcatcaaaactcattgcgct

SEQ ID NO: 37210 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
tgcgctgtacgcttaagatg

SEQ ID NO: 37211 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
tccgtacaaaggaacagtga

SEQ ID NO: 37212 - DNA, 20 bp, Artificial Sequence
  Description of Artificial Sequence: Synthetic oligonucleotide
  Target: ATXN1; (+) strand; PAM type: NNNNGHTT; PAM sequence: TCGTGTTT
agaaagtaagagacctaaat

SEQ ID NO: 37213 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
cactcaaaaaaagaaccaaa

SEQ ID NO: 37214 - DNA, 20 bp, Artificial Sequence
  Description of Artificial Sequence: Synthetic oligonucleotide
  Target: ATXN1; (+) strand; PAM type: NNNNGHTT; PAM sequence: CTCCGTTT
gcagggacctgaacatatcc

SEQ ID NO: 37215 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
acctgaacatatccctccgt

SEQ ID NO: 37216 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
agtaactgccattcgccatt

SEQ ID NO: 37217 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
tatatgtacctgctaggata

SEQ ID NO: 37218 - DNA, 20 bp, Artificial Sequence
  Description of Artificial Sequence: Synthetic oligonucleotide
  Target: ATXN1; (+) strand; PAM type: NNNNGHTT; PAM sequence: GAGGGTTT
gagtggtaagggaagagttg

SEQ ID NO: 37219 - DNA, 20 bp, Artificial Sequence
  Description of Artificial Sequence: Synthetic oligonucleotide
  Target: ATXN1; (+) strand; PAM type: NNNNGHTT; PAM sequence: ATAAGTTT
ctagagggaccgctccatga

SEQ ID NO: 37220 - DNA, 20 bp, Artificial Sequence
  Description of Artificial Sequence: Synthetic oligonucleotide
  Target: ATXN1; (+) strand; PAM type: NNNNGHTT; PAM sequence: CACCGCTT
aatacaattgcggtaatcag

SEQ ID NO: 37221 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
tctatttcaatttacaaacg

SEQ ID NO: 37222 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
acaaacgctgggtttacagg

SEQ ID NO: 37223 - DNA, 20 bp, Artificial Sequence
  Description of Artificial Sequence: Synthetic oligonucleotide
  Target: ATXN1; (+) strand; PAM type: NNNNGHTT; PAM sequence: ATTAGCTT
ttctgagacattcctataaa

SEQ ID NO: 37224 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
tgctcaatccaagagttact

SEQ ID NO: 37225 - DNA, 20 bp, Artificial Sequence
  Description of Artificial Sequence: Synthetic oligonucleotide
  Target: ATXN1; (+) strand; PAM type: NNNNGHTT; PAM sequence: GAGTGATT
atctgagaaaacatagagtg

SEQ ID NO: 37226 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
agcaaatataaaatccaact

SEQ ID NO: 37227 - DNA, 20 bp, Artificial Sequence
  Description of Artificial Sequence: Synthetic oligonucleotide
  Target: ATXN1; (+) strand; PAM type: NNNNGHTT; PAM sequence: ACCCGCTT
catcctccatgcagttctcc

SEQ ID NO: 37228 - DNA, 20 bp, Artificial Sequence
  Description of Artificial Sequence: Synthetic oligonucleotide
  Target: ATXN1; (+) strand; PAM type: NNNNGHTT; PAM sequence: ATCAGTTT
gtggtcctggggccagcagc

SEQ ID NO: 37229 - DNA, 20 bp, Artificial Sequence
  Description of Artificial Sequence: Synthetic oligonucleotide
  Target: ATXN1; (+) strand; PAM type: NNNNGHTT; PAM sequence: GAGGGATT
ccagcagcatcagtttcacg

SEQ ID NO: 37230 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
cgggtggatcacatgaggcc

SEQ ID NO: 37231 - DNA, 20 bp, Artificial Sequence
  Description of Artificial Sequence: Synthetic oligonucleotide
  Target: ATXN1; (+) strand; PAM type: NNNNGHTT; PAM sequence: ACTAGATT
tcggaggtaggccgcccatc

SEQ ID NO: 37232 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
gacaaggatagcaagtcccc

SEQ ID NO: 37233 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
cttttccaatctattccttt

SEQ ID NO: 37234 - DNA, 20 bp, Artificial Sequence
  Description of Artificial Sequence: Synthetic oligonucleotide
  Target: ATXN1; (+) strand; PAM type: NNNNGHTT; PAM sequence: GATTGTTT
tccaatctattcctttttgt

SEQ ID NO: 37235 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
taggctgaactgctgggctg

SEQ ID NO: 37236 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
atgctgtaattctaattttt

SEQ ID NO: 37237 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
tatgccatcaagtcacagaa

SEQ ID NO: 37238 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
actctaatttgtgccttgtc

SEQ ID NO: 37239 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
gctttgggcatgaaacagaa

SEQ ID NO: 37240 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
catccgctaaaaatcattac

SEQ ID NO: 37241 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
tgttgcagacttcaggcact

SEQ ID NO: 37242 - DNA, 20 bp, Artificial Sequence
  Description of Artificial Sequence: Synthetic oligonucleotide
  Target: ATXN1; (+) strand; PAM type: NNNNGHTT; PAM sequence: TAGTGATT
aagaaagctcctatttctgt

SEQ ID NO: 37243 - DNA, 20 bp, Artificial Sequence
  Description of Artificial Sequence: Synthetic oligonucleotide
  Target: ATXN1; (+) strand; PAM type: NNNNGHTT; PAM sequence: CCATGCTT
ctgatgaccaaatctacaga

SEQ ID NO: 37244 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
tacaagaaatgtggtctccc

SEQ ID NO: 37245 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
ctcccatatgttttggaatc

SEQ ID NO: 37246 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
tccttagcatttgaaatgcc

SEQ ID NO: 37247 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
atttgaaatgccgtaagttt

SEQ ID NO: 37248 - DNA, 20 bp, Artificial Sequence
  Description of Artificial Sequence: Synthetic oligonucleotide
  Target: ATXN1; (+) strand; PAM type: NNNNGHTT; PAM sequence: ACTAGATT
ggctccaacttacttttcca

SEQ ID NO: 37249 - DNA, 20 bp, Artificial Sequence
  Description of Artificial Sequence: Synthetic oligonucleotide
  Target: ATXN1; (+) strand; PAM type: NNNNGHTT; PAM sequence: CAGGGATT
tcatccaaacttcccaaggg

SEQ ID NO: 37250 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
aaacttcccaagggcaggga

SEQ ID NO: 37251 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
catccctgaaatatggtagg

SEQ ID NO: 37252 - DNA, 20 bp, Artificial Sequence
  Description of Artificial Sequence: Synthetic oligonucleotide
  Target: ATXN1; (+) strand; PAM type: NNNNGHTT; PAM sequence: GTAAGATT
aaatatggtaggtactgttt

SEQ ID NO: 37253 - DNA, 20 bp, Artificial Sequence
  Description of Artificial Sequence: Synthetic oligonucleotide
  Target: ATXN1; (+) strand; PAM type: NNNNGHTT; PAM sequence: TAGTGATT
agtatcaatgccaagctggc

SEQ ID NO: 37254 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
tagtgattttgcctggggaa

SEQ ID NO: 37255 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
aaaatagctctgaccactaa

SEQ ID NO: 37256 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
tggaagatctgagctcaggt

SEQ ID NO: 37257 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
gtcacattccctctctgatc

SEQ ID NO: 37258 - DNA, 20 bp, Artificial Sequence
  Description of Artificial Sequence: Synthetic oligonucleotide
  Target: ATXN1; (+) strand; PAM type: NNNNGHTT; PAM sequence: GAGGGCTT
gggttgtgggggtgcaaaag

SEQ ID NO: 37259 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
aggatcagatagtagatatt

SEQ ID NO: 37260 - DNA, 20 bp, Artificial Sequence
  Description of Artificial Sequence: Synthetic oligonucleotide
  Target: ATXN1; (+) strand; PAM type: NNNNGHTT; PAM sequence: GCTGGATT
aactttatttacaagaacag

SEQ ID NO: 37261 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
gctggatttggcccatggac

SEQ ID NO: 37262 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
ccttgttgccattcagttca

SEQ ID NO: 37263 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
gggacttataagaaggacaa

SEQ ID NO: 37264 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
ccaagaacttgacaacgggg

SEQ ID NO: 37265 - DNA, 20 bp, Artificial Sequence
  Description of Artificial Sequence: Synthetic oligonucleotide
  Target: ATXN1; (+) strand; PAM type: NNNNGHTT; PAM sequence: AGCGGTTT
ggggaagagattgcctagtt

SEQ ID NO: 37266 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
gtcctcaaaagggcgccagg

SEQ ID NO: 37267 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
gagatgaacagagaggcagg

SEQ ID NO: 37268 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
tgaacagagaggcaggctat

SEQ ID NO: 37269 - DNA, 20 bp, Artificial Sequence
  Description of Artificial Sequence: Synthetic oligonucleotide
  Target: ATXN1; (+) strand; PAM type: NNNNGHTT; PAM sequence: TTCCGATT
caactcatcccactcccttg

SEQ ID NO: 37270 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
ttctcaaggcacatcaataa

SEQ ID NO: 37271 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
atcaataaagtagcttccag

SEQ ID NO: 37272 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
agttaggatttacattccca

SEQ ID NO: 37273 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
ggccttgagagtatgttagt

SEQ ID NO: 37274 - DNA, 20 bp, Artificial Sequence
  Description of Artificial Sequence: Synthetic oligonucleotide
  Target: ATXN1; (+) strand; PAM type: NNNNGHTT; PAM sequence: TGCGGATT
atgttagtaatggtttccac

SEQ ID NO: 37275 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
cagccagccctcgctgacag

SEQ ID NO: 37276 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
ttctggctctactcactttc

SEQ ID NO: 37277 - DNA, 20 bp, Artificial Sequence
  Description of Artificial Sequence: Synthetic oligonucleotide
  Target: ATXN1; (+) strand; PAM type: NNNNGHTT; PAM sequence: AGCTGTTT
ctttcaactgattttcacag

SEQ ID NO: 37278 - DNA, 20 bp, Artificial Sequence
  Description of Artificial Sequence: Synthetic oligonucleotide
  Target: ATXN1; (+) strand; PAM type: NNNNGHTT; PAM sequence: TGGTGCTT
gatgatgaagccaaagaacc

SEQ ID NO: 37279 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
aagaacctggtgcttcagga

SEQ ID NO: 37280 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
ctggtgcttcaggacaaagt

SEQ ID NO: 37281 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
tgcttcaggacaaagtttct

SEQ ID NO: 37282 - DNA, 20 bp, Artificial Sequence
  Description of Artificial Sequence: Synthetic oligonucleotide
  Target: ATXN1; (+) strand; PAM type: NNNNGHTT; PAM sequence: ACAAGATT
tgtatagaatggaaactggc

SEQ ID NO: 37283 - DNA, 20 bp, Artificial Sequence
  Description of Artificial Sequence: Synthetic oligonucleotide
  Target: ATXN1; (+) strand; PAM type: NNNNGHTT; PAM sequence: AACAGTTT
ccacacaacaaggtgcaatg

SEQ ID NO: 37284 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
caaggtgcaatgaacagttt

SEQ ID NO: 37285 - DNA, 20 bp, Artificial Sequence
  Description of Artificial Sequence: Synthetic oligonucleotide
  Target: ATXN1; (+) strand; PAM type: NNNNGHTT; PAM sequence: GCCTGTTT
attccagaaagaaggtcagt

SEQ ID NO: 37286 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
cagaacttctaacctatagg

SEQ ID NO: 37287 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
accaagggagtaaggaagct

SEQ ID NO: 37288 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
aagctgctggtttccaaaga

SEQ ID NO: 37289 - DNA, 20 bp, Artificial Sequence
  Description of Artificial Sequence: Synthetic oligonucleotide
  Target: ATXN1; (+) strand; PAM type: NNNNGHTT; PAM sequence: AAGCGTTT
atgcttacttcccatttgca

SEQ ID NO: 37290 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
tggagaccatctgaactgcc

SEQ ID NO: 37291 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
aactgccaagagttttaaca

SEQ ID NO: 37292 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
gtgagaaagaacatttcccc

SEQ ID NO: 37293 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
aaagaacatttcccctgctg

SEQ ID NO: 37294 - DNA, 20 bp, Artificial Sequence
  Description of Artificial Sequence: Synthetic oligonucleotide
  Target: ATXN1; (+) strand; PAM type: NNNNGHTT; PAM sequence: AGCTGTTT
ttttcagctaagttcagcct

SEQ ID NO: 37295 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
agctaagttcagcctagctg

SEQ ID NO: 37296 - DNA, 20 bp, Artificial Sequence
  Description of Artificial Sequence: Synthetic oligonucleotide
  Target: ATXN1; (+) strand; PAM type: NNNNGHTT; PAM sequence: GCTAGCTT
gcctagctgtttagttttca

SEQ ID NO: 37297 - DNA, 20 bp, Artificial Sequence
  Description of Artificial Sequence: Synthetic oligonucleotide
  Target: ATXN1; (+) strand; PAM type: NNNNGHTT; PAM sequence: ATAGGTTT
acaaccacacacttttgttc

SEQ ID NO: 37298 - DNA, 20 bp, Artificial Sequence
  Description of Artificial Sequence: Synthetic oligonucleotide
  Target: ATXN1; (+) strand; PAM type: NNNNGHTT; PAM sequence: ATAGGATT
tttttactgggaattttcac

SEQ ID NO: 37299 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
catgataaaactgtcatttc

SEQ ID NO: 37300 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
ctacccaccataatttggga

SEQ ID NO: 37301 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
caccataatttgggaagtgg

SEQ ID NO: 37302 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
gcacttaataaacatttgtt

SEQ ID NO: 37303 - DNA, 20 bp, Artificial Sequence
  Description of Artificial Sequence: Synthetic oligonucleotide
  Target: ATXN1; (+) strand; PAM type: NNNNGHTT; PAM sequence: TATTGATT
aaactgtcaagtgaaataat

SEQ ID NO: 37304 - DNA, 20 bp, Artificial Sequence
  Description of Artificial Sequence: Synthetic oligonucleotide
  Target: ATXN1; (+) strand; PAM type: NNNNGHTT; PAM sequence: TGTAGATT
gcattaaaattaaaaacgaa

SEQ ID NO: 37305 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
aatgtagattaataaatgaa

SEQ ID NO: 37306 - DNA, 20 bp, Artificial Sequence
  Description of Artificial Sequence: Synthetic oligonucleotide
  Target: ATXN1; (+) strand; PAM type: NNNNGHTT; PAM sequence: TAGGGCTT
gaatctgccagtcagggcta

SEQ ID NO: 37307 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
agggctatagggcttagaat

SEQ ID NO: 37308 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
ccagcccctgacataaatgt

SEQ ID NO: 37309 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
gcaaggaaaggttctcccaa

SEQ ID NO: 37310 - DNA, 20 bp, Artificial Sequence
  Description of Artificial Sequence: Synthetic oligonucleotide
  Target: ATXN1; (+) strand; PAM type: NNNNGHTT; PAM sequence: ACCTGATT
gggagtgtggcccggctgac

SEQ ID NO: 37311 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
actttgagagaacaaattcc

SEQ ID NO: 37312 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
attcctgttgttttaaccca

SEQ ID NO: 37313 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
gagcagccctggaaaactaa

SEQ ID NO: 37314 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
cttcctttacagtgctcatc

SEQ ID NO: 37315 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
gagggcagggacttagacaa

SEQ ID NO: 37316 - DNA, 20 bp, Artificial Sequence
  Description of Artificial Sequence: Synthetic oligonucleotide
  Target: ATXN1; (+) strand; PAM type: NNNNGHTT; PAM sequence: CTGTGCTT
agaatgaataaattattttt

SEQ ID NO: 37317 - DNA, 20 bp, Artificial Sequence
  Description of Artificial Sequence: Synthetic oligonucleotide
  Target: ATXN1; (+) strand; PAM type: NNNNGHTT; PAM sequence: ACTTGATT
cactcaattataaaagcctg

SEQ ID NO: 37318 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
gattagcaccatcaagacat

SEQ ID NO: 37319 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
ttctctgcattgcaagtcaa

SEQ ID NO: 37320 - DNA, 20 bp, Artificial Sequence
  Description of Artificial Sequence: Synthetic oligonucleotide
  Target: ATXN1; (+) strand; PAM type: NNNNGHTT; PAM sequence: GAGGGTTT
tattatttttgaaaatatct

SEQ ID NO: 37321 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
taaaactcagttgatccaaa

SEQ ID NO: 37322 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
agttgatccaaacatggctt

SEQ ID NO: 37323 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
ttgtgcagatgtaatggaat

SEQ ID NO: 37324 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
gatgtaatggaatctgagat

SEQ ID NO: 37325 - DNA, 20 bp, Artificial Sequence
  Description of Artificial Sequence: Synthetic oligonucleotide
  Target: ATXN1; (+) strand; PAM type: NNNNGHTT; PAM sequence: ATTAGTTT
atggttcccttaagacagct

SEQ ID NO: 37326 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
ttgggaggctgaggtgggag

SEQ ID NO: 37327 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
tcgggaggctggaacaagag

SEQ ID NO: 37328 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
cgtaccaggtatgtctgcaa

SEQ ID NO: 37329 - DNA, 20 bp, Artificial Sequence
  Description of Artificial Sequence: Synthetic oligonucleotide
  Target: ATXN1; (+) strand; PAM type: NNNNGHTT; PAM sequence: GGTAGCTT
atttttaattgaataaaata

SEQ ID NO: 37330 - DNA, 20 bp, Artificial Sequence
  Description of Artificial Sequence: Synthetic oligonucleotide
  Target: ATXN1; (+) strand; PAM type: NNNNGHTT; PAM sequence: TATGGCTT
attgaataaaataggtagct

SEQ ID NO: 37331 - DNA, 20 bp, Artificial Sequence
  Description of Artificial Sequence: Synthetic oligonucleotide
  Target: ATXN1; (+) strand; PAM type: NNNNGHTT; PAM sequence: GCTTGTTT
aataaaataggtagcttatg

SEQ ID NO: 37332 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
aacattttgttaagcctttc

SEQ ID NO: 37333 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
agaaacagaattcttggagg

SEQ ID NO: 37334 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
gtggcctcacctgaccactg

SEQ ID NO: 37335 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
gcccaaagttcagcaaatgg

SEQ ID NO: 37336 - DNA, 20 bp, Artificial Sequence
  Description of Artificial Sequence: Synthetic oligonucleotide
  Target: ATXN1; (+) strand; PAM type: NNNNGHTT; PAM sequence: TTGAGCTT
ttttacaagaaaatgaaatc

SEQ ID NO: 37337 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
gagcttttaattttactgaa

SEQ ID NO: 37338 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
aattttactgaaatgtgatt

SEQ ID NO: 37339 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
gtatctccccccacctgccc

SEQ ID NO: 37340 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
ccccactgtttgttcaataa

SEQ ID NO: 37341 - DNA, 20 bp, Artificial Sequence
  Description of Artificial Sequence: Synthetic oligonucleotide
  Target: ATXN1; (+) strand; PAM type: NNNNGHTT; PAM sequence: TATCGCTT
catacactgaaccatctcac

SEQ ID NO: 37342 - DNA, 20 bp, Artificial Sequence
  Description of Artificial Sequence: Synthetic oligonucleotide
  Target: ATXN1; (+) strand; PAM type: NNNNGHTT; PAM sequence: ATTGGCTT
gtaatcaaacctgagtctct

SEQ ID NO: 37343 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
ttgctaaagctgaaacacac

SEQ ID NO: 37344 - DNA, 20 bp, Artificial Sequence
  Description of Artificial Sequence: Synthetic oligonucleotide
  Target: ATXN1; (+) strand; PAM type: NNNNGHTT; PAM sequence: GCGAGTTT
gaatgcagtgtcagtaacat

SEQ ID NO: 37345 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
agtaacatgcgagttttctg

SEQ ID NO: 37346 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
gctctgcttcaaaagatctg

SEQ ID NO: 37347 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
tttctaccaaagaaggtaca

SEQ ID NO: 37348 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
tacatttaaaatatttcaga

SEQ ID NO: 37349 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
gaaataaaggagaattctac

SEQ ID NO: 37350 - DNA, 20 bp, Artificial Sequence
  Description of Artificial Sequence: Synthetic oligonucleotide
  Target: ATXN1; (+) strand; PAM type: NNNNGHTT; PAM sequence: CCGTGATT
ctaaggattaaaagtcactg

SEQ ID NO: 37351 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
tattatcatttttcctactt

SEQ ID NO: 37352 - DNA, 20 bp, Artificial Sequence
  Description of Artificial Sequence: Synthetic oligonucleotide
  Target: ATXN1; (+) strand; PAM type: NNNNGHTT; PAM sequence: GTCAGCTT
aatgagttcaactacccaca

SEQ ID NO: 37353 - DNA, 20 bp, Artificial Sequence
  Description of Artificial Sequence: Synthetic oligonucleotide
  Target: ATXN1; (+) strand; PAM type: NNNNGHTT; PAM sequence: TTAAGCTT
ccctcgtaggctaaatttcc

SEQ ID NO: 37354 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
gcattcaacagaataagttc

SEQ ID NO: 37355 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
aaaaaatagcccatgagcca

SEQ ID NO: 37356 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
atgagccaagcagcttcact

SEQ ID NO: 37357 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
tgtaacatttccacagtatg

SEQ ID NO: 37358 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
tcatgtccattttcactcga

SEQ ID NO: 37359 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
tttaacataagactaaagca

SEQ ID NO: 37360 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
tcagcccaatcagctctccc

SEQ ID NO: 37361 - DNA, 20 bp, Artificial Sequence
  Description of Artificial Sequence: Synthetic oligonucleotide
  Target: ATXN1; (+) strand; PAM type: NNNNGHTT; PAM sequence: TAGGGCTT
tgagcaggaattccagtgcc

SEQ ID NO: 37362 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
gctttcagttctttgtgcat

SEQ ID NO: 37363 - DNA, 20 bp, Artificial Sequence
  Description of Artificial Sequence: Synthetic oligonucleotide
  Target: ATXN1; (+) strand; PAM type: NNNNGHTT; PAM sequence: ATAGGTTT
agacccgagttctatgtaca

SEQ ID NO: 37364 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
tttattataggatatattaa

SEQ ID NO: 37365 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
ttggtaaagctgatatagag

SEQ ID NO: 37366 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
taaagctgatatagagtcag

SEQ ID NO: 37367 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
gtttgattgctgatatagaa

SEQ ID NO: 37368 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
gattgctgatatagaatcag

SEQ ID NO: 37369 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
tttgattactgtcatgactc

SEQ ID NO: 37370 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
acatattttatctggataac

SEQ ID NO: 37371 - DNA, 20 bp, Artificial Sequence
  Description of Artificial Sequence: Synthetic oligonucleotide
  Target: ATXN1; (+) strand; PAM type: NNNNGHTT; PAM sequence: ACCAGCTT
gcctgagctcagtcactatt

SEQ ID NO: 37372 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
gtggagaagtccaggctaac

SEQ ID NO: 37373 - DNA, 20 bp, Artificial Sequence
  Description of Artificial Sequence: Synthetic oligonucleotide
  Target: ATXN1; (+) strand; PAM type: NNNNGHTT; PAM sequence: AACCGTTT
caggtcagatgactaaaact

SEQ ID NO: 37374 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
tgactaaaactaaccgttta

SEQ ID NO: 37375 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
ttgaagaatggaagtggcta

SEQ ID NO: 37376 - DNA, 20 bp, Artificial Sequence
  Description of Artificial Sequence: Synthetic oligonucleotide
  Target: ATXN1; (+) strand; PAM type: NNNNGHTT; PAM sequence: TATGGCTT
atgaaagtatgttaacttcc

SEQ ID NO: 37377 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
ctatggctttaaatggtgtg

SEQ ID NO: 37378 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
agccttcttaagtacgagag

SEQ ID NO: 37379 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
aagtacgagagctgagtttt

SEQ ID NO: 37380 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
gctgagttttctgtgtttat

SEQ ID NO: 37381 - DNA, 20 bp, Artificial Sequence
  Description of Artificial Sequence: Synthetic oligonucleotide
  Target: ATXN1; (+) strand; PAM type: NNNNGHTT; PAM sequence: GCGTGTTT
ctatttattactccgatact

SEQ ID NO: 37382 - DNA, 20 bp, Artificial Sequence
  Description of Artificial Sequence: Synthetic oligonucleotide
  Target: ATXN1; (+) strand; PAM type: NNNNGHTT; PAM sequence: GTGTGATT
cgtgttttcattccagagga

SEQ ID NO: 37383 - DNA, 20 bp, Artificial Sequence
  Description of Artificial Sequence: Synthetic oligonucleotide
  Target: ATXN1; (+) strand; PAM type: NNNNGHTT; PAM sequence: GGGGGATT
tgactcactgctaaagacat

SEQ ID NO: 37384 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
aaacaagaaaaagagctaaa

SEQ ID NO: 37385 - DNA, 20 bp, Artificial Sequence
  Description of Artificial Sequence: Synthetic oligonucleotide
  Target: ATXN1; (+) strand; PAM type: NNNNGHTT; PAM sequence: AATAGTTT
tggttgaaatgccctgtgaa

SEQ ID NO: 37386 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
atcatcctttcacaagctga

SEQ ID NO: 37387 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
agagaaaaaaagcatcaaaa

SEQ ID NO: 37388 - DNA, 20 bp, Artificial Sequence
  Description of Artificial Sequence: Synthetic oligonucleotide
  Target: ATXN1; (+) strand; PAM type: NNNNGHTT; PAM sequence: GCCCGCTT
aaggcagctgatatttctct

SEQ ID NO: 37389 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
attaagatgaagccctagaa

SEQ ID NO: 37390 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
ggagcagaggctgcagtgag

SEQ ID NO: 37391 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
cagttctgcccactaacatt

SEQ ID NO: 37392 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tcaggaggctgaggcagaag

SEQ ID NO: 37393 - DNA, 20 bp, Artificial Sequence
  Description of Artificial Sequence: Synthetic oligonucleotide
  Target: ATXN1; (+) strand; PAM type: NNNNGHTT; PAM sequence: GATGGATT
cttaacagggtcctacttca

SEQ ID NO: 37394 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
tattttttccagaaagtcat

SEQ ID NO: 37395 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
aaacataaataagtaaccaa

SEQ ID NO: 37396 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
tatgttaattaagcaaatta

SEQ ID NO: 37397 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
taaagttcaaaatctttcat

SEQ ID NO: 37398 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
ggaaataaataattccaaag

SEQ ID NO: 37399 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
aagaaaacaagtccaaatta

SEQ ID NO: 37400 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
tacaatgtttcaagaagaaa

SEQ ID NO: 37401 - DNA, 20 bp, Artificial Sequence
  Description of Artificial Sequence: Synthetic oligonucleotide
  Target: ATXN1; (+) strand; PAM type: NNNNGHTT; PAM sequence: GAGAGCTT
ttacttaatgaatagactaa

SEQ ID NO: 37402 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
catgcaaacaggaacttcca

SEQ ID NO: 37403 - DNA, 20 bp, Artificial Sequence
  Description of Artificial Sequence: Synthetic oligonucleotide
  Target: ATXN1; (+) strand; PAM type: NNNNGHTT; PAM sequence: GACCGTTT
gaaagtgaaaattcgtcaga

SEQ ID NO: 37404 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
cattttgcatgaggaggctg

SEQ ID NO: 37405 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
tgaggaggctgtgaggatta

SEQ ID NO: 37406 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
gattaaacgcctggagcatg

SEQ ID NO: 37407 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
acagggcagtggggagggaa

SEQ ID NO: 37408 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
aactttccgtcccggagaag

SEQ ID NO: 37409 - DNA, 20 bp, Artificial Sequence
  Description of Artificial Sequence: Synthetic oligonucleotide
  Target: ATXN1; (+) strand; PAM type: NNNNGHTT; PAM sequence: TATTGATT
aatactaggggtattacgta

SEQ ID NO: 37410 - DNA, 20 bp, Artificial Sequence
  Description of Artificial Sequence: Synthetic oligonucleotide
  Target: ATXN1; (+) strand; PAM type: NNNNGHTT; PAM sequence: GACAGCTT
agtgtggatcccagctgcag

SEQ ID NO: 37411 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
tggcattcccttccccgtca

SEQ ID NO: 37412 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
tgcctctctggcaactgaga

SEQ ID NO: 37413 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
ctgtacaaagtatctggtca

SEQ ID NO: 37414 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
aaagtttgttattggcagaa

SEQ ID NO: 37415 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
ttctcccaaggtgtatattt

SEQ ID NO: 37416 - DNA, 20 bp, Artificial Sequence
  Description of Artificial Sequence: Synthetic oligonucleotide
  Target: ATXN1; (+) strand; PAM type: NNNNGHTT; PAM sequence: AGGAGCTT
agccaaaggcagacttcaaa

SEQ ID NO: 37417 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
tgttaaatatataagcgttc

SEQ ID NO: 37418 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
gcgttcgctggctttctttg

SEQ ID NO: 37419 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
ctcatctaaacttgggagct

SEQ ID NO: 37420 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
ttaaatgaggcaataactga

SEQ ID NO: 37421 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
aaatggcttaaccagggaga

SEQ ID NO: 37422 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
gttgggggaacctaccaaca

SEQ ID NO: 37423 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
agatctcacagcccacacta

SEQ ID NO: 37424 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
caacggttatatttttgttc

SEQ ID NO: 37425 - DNA, 20 bp, Artificial Sequence
  Description of Artificial Sequence: Synthetic oligonucleotide
  Target: ATXN1; (+) strand; PAM type: NNNNGHTT; PAM sequence: ACCTGATT
ctatggattctggccctccc

SEQ ID NO: 37426 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
acgtagggtacttaaggact

SEQ ID NO: 37427 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
taaggactaagtgcttagca

SEQ ID NO: 37428 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
cacagtaggtgctcaataaa

SEQ ID NO: 37429 - DNA, 20 bp, Artificial Sequence
  Description of Artificial Sequence: Synthetic oligonucleotide
  Target: ATXN1; (+) strand; PAM type: NNNNGHTT; PAM sequence: AACAGATT
cctctcatctcagagatggc

SEQ ID NO: 37430 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
gagatggacattacagtgac

SEQ ID NO: 37431 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
ttagatgtctgcatattaaa

SEQ ID NO: 37432 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
gcatattaaatgaagtttgt

SEQ ID NO: 37433 - DNA, 20 bp, Artificial Sequence
  Description of Artificial Sequence: Synthetic oligonucleotide
  Target: ATXN1; (+) strand; PAM type: NNNNGHTT; PAM sequence: GCTTGATT
attaaatgaagtttgttact

SEQ ID NO: 37434 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
tgcttgattacaatttaaat

SEQ ID NO: 37435 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
gggaaaaagatgtgtgaacg

SEQ ID NO: 37436 - DNA, 20 bp, Artificial Sequence
  Description of Artificial Sequence: Synthetic oligonucleotide
  Target: ATXN1; (+) strand; PAM type: NNNNGHTT; PAM sequence: TGAAGATT
tttaggaatagcaccctgcc

SEQ ID NO: 37437 - DNA, 20 bp, Artificial Sequence
  Description of Artificial Sequence: Synthetic oligonucleotide
  Target: ATXN1; (+) strand; PAM type: NNNNGHTT; PAM sequence: ACATGATT
ttgaagcataaagaagttaa

SEQ ID NO: 37438 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
ctgcagggtgaaattttgac

SEQ ID NO: 37439 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
gtgaaattttgacttttgat

SEQ ID NO: 37440 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
atattgacaagatagaagga

SEQ ID NO: 37441 - DNA, 20 bp, Artificial Sequence
  Description of Artificial Sequence: Synthetic oligonucleotide
  Target: ATXN1; (+) strand; PAM type: NNNNGHTT; PAM sequence: GGAGGTTT
tcaaatgcctacaaatggaa

SEQ ID NO: 37442 - DNA, 20 bp, Artificial Sequence
  Description of Artificial Sequence: Synthetic oligonucleotide
  Target: ATXN1; (+) strand; PAM type: NNNNGHTT; PAM sequence: AGCAGTTT
ctgaatcacaatccacgaga

SEQ ID NO: 37443 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
agagccagggaagaatgaaa

SEQ ID NO: 37444 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
aaaaaaaaatcacaagcatg

SEQ ID NO: 37445 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
cagattagacagataacgag

SEQ ID NO: 37446 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
ataaaaacggaggtcattcc

SEQ ID NO: 37447 - DNA, 20 bp, Artificial Sequence
  Description of Artificial Sequence: Synthetic oligonucleotide
  Target: ATXN1; (+) strand; PAM type: NNNNGHTT; PAM sequence: AGGAGCTT
aggtcattcctcttgctttc

SEQ ID NO: 37448 - DNA, 20 bp, Artificial Sequence
  Description of Artificial Sequence: Synthetic oligonucleotide
  Target: ATXN1; (+) strand; PAM type: NNNNGHTT; PAM sequence: CAAGGCTT
accagagcgaccaagggctg

SEQ ID NO: 37449 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
atcccaggaagttgtctgta

SEQ ID NO: 37450 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
ttgctttctgctaccacact

SEQ ID NO: 37451 - DNA, 20 bp, Artificial Sequence
  Description of Artificial Sequence: Synthetic oligonucleotide
  Target: ATXN1; (+) strand; PAM type: NNNNGHTT; PAM sequence: TGCCGTTT
taatttttatctaattgtat

SEQ ID NO: 37452 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
gcattctctgtggtcaaaga

SEQ ID NO: 37453 - DNA, 20 bp, Artificial Sequence
  Description of Artificial Sequence: Synthetic oligonucleotide
  Target: ATXN1; (+) strand; PAM type: NNNNGHTT; PAM sequence: CACGGCTT
agtactttagagtactcaaa

SEQ ID NO: 37454 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
ctagttgtcatatttttata

SEQ ID NO: 37455 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
tgtagctcttttttcatatt

SEQ ID NO: 37456 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
acacttcaatctcatcgtta

SEQ ID NO: 37457 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
caggtggatcacttgaggtc

SEQ ID NO: 37458 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
tttggaggctgaggcaggag

SEQ ID NO: 37459 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
tatgcccttattaagtactt

SEQ ID NO: 37460 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
gtacttttatgtttgactag

SEQ ID NO: 37461 - DNA, 20 bp, Artificial Sequence
  Description of Artificial Sequence: Synthetic oligonucleotide
  Target: ATXN1; (+) strand; PAM type: NNNNGHTT; PAM sequence: TTTAGCTT
tgtgcttcttttgaaatctt

SEQ ID NO: 37462 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
gaaatctttttagcttcatt

SEQ ID NO: 37463 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
ctgccatgccgggacccatt

SEQ ID NO: 37464 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
tatcttaacatattccactt

SEQ ID NO: 37465 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
aacatattccacttaatggt

SEQ ID NO: 37466 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
gccctcacattggttcccaa

SEQ ID NO: 37467 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
ttgggaggccgaggcgggag

SEQ ID NO: 37468 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
cttgaggccaagagttcgag

SEQ ID NO: 37469 - DNA, 20 bp, Artificial Sequence
  Description of Artificial Sequence: Synthetic oligonucleotide
  Target: ATXN1; (+) strand; PAM type: NNNNGHTT; PAM sequence: ACCAGCTT
gccgaggtcgggagttcaag

SEQ ID NO: 37470 - DNA, 20 bp, Artificial Sequence
  Description of Artificial Sequence: Synthetic oligonucleotide
  Target: ATXN1; (+) strand; PAM type: NNNNGHTT; PAM sequence: GGTGGATT
cactttgggaggccaaggta

SEQ ID NO: 37471 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tccggaggctgacgcaggag

SEQ ID NO: 37472 - DNA, 20 bp, Artificial Sequence
  Description of Artificial Sequence: Synthetic oligonucleotide
  Target: ATXN1; (+) strand; PAM type: NNNNGHTT; PAM sequence: CGGAGATT
aatcgcttgaacccaagagg

SEQ ID NO: 37473 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
aatgtctatagactatagag

SEQ ID NO: 37474 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
gatttgtgaattataacctg

SEQ ID NO: 37475 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
gaaatcatccttctcaggtg

SEQ ID NO: 37476 - DNA, 20 bp, Artificial Sequence
  Description of Artificial Sequence: Synthetic oligonucleotide
  Target: ATXN1; (+) strand; PAM type: NNNNGHTT; PAM sequence: GCATGCTT
tctgtttgctacaaaacata

SEQ ID NO: 37477 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
aacgctcgccttcacttttt

SEQ ID NO: 37478 - DNA, 20 bp, Artificial Sequence
  Description of Artificial Sequence: Synthetic oligonucleotide
  Target: ATXN1; (+) strand; PAM type: NNNNGHTT; PAM sequence: ACAGGATT
atttttgtattttagtaaag

SEQ ID NO: 37479 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgccttggcctctcaaagtg

SEQ ID NO: 37480 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
cttaaaaatattttaaaacg

SEQ ID NO: 37481 - DNA, 20 bp, Artificial Sequence
  Description of Artificial Sequence: Synthetic oligonucleotide
  Target: ATXN1; (+) strand; PAM type: NNNNGHTT; PAM sequence: ACAAGATT
tctgaggtgggaagaatgtg

SEQ ID NO: 37482 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
tggagataataatgacctat

SEQ ID NO: 37483 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
tgacctatgtaggtttactg

SEQ ID NO: 37484 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
gtaggtttactgtgaggatt

SEQ ID NO: 37485 - DNA, 20 bp, Artificial Sequence
  Description of Artificial Sequence: Synthetic oligonucleotide
  Target: ATXN1; (+) strand; PAM type: NNNNGHTT; PAM sequence: GTGGGCTT
aagaacaggctccctgcatt

SEQ ID NO: 37486 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
tgagtgtgtacactccctcc

SEQ ID NO: 37487 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
cgcaaataaatatttattaa

SEQ ID NO: 37488 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
tgaatggaggaaacaaatct

SEQ ID NO: 37489 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
aaaaagcatcaaagagtaat

SEQ ID NO: 37490 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
caaagagtaatcaaagatta

SEQ ID NO: 37491 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
agaattaaattgaatgcaaa

SEQ ID NO: 37492 - DNA, 20 bp, Artificial Sequence
  Description of Artificial Sequence: Synthetic oligonucleotide
  Target: ATXN1; (+) strand; PAM type: NNNNGHTT; PAM sequence: AGATGTTT
caaaatgagattagacaaaa

SEQ ID NO: 37493 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
aaaaagatgtttaaagaccc

SEQ ID NO: 37494 - DNA, 20 bp, Artificial Sequence
  Description of Artificial Sequence: Synthetic oligonucleotide
  Target: ATXN1; (+) strand; PAM type: NNNNGHTT; PAM sequence: TATTGATT
tgcctaaatactcaaactgt

SEQ ID NO: 37495 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
taatgtgagcatgttcaatc

SEQ ID NO: 37496 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
tgagcatgttcaatctacag

SEQ ID NO: 37497 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
tcaatctacagctttgattt

SEQ ID NO: 37498 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
attaagaatatgcctacctg

SEQ ID NO: 37499 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
tgaaagaacgaaattaaggc

SEQ ID NO: 37500 - DNA, 20 bp, Artificial Sequence
  Description of Artificial Sequence: Synthetic oligonucleotide
  Target: ATXN1; (+) strand; PAM type: NNNNGHTT; PAM sequence: AAGAGCTT
atgaaatcaaccttaaaata

SEQ ID NO: 37501 - DNA, 20 bp, Artificial Sequence
  Description of Artificial Sequence: Synthetic oligonucleotide
  Target: ATXN1; (+) strand; PAM type: NNNNGHTT; PAM sequence: TACTGATT
actgaatatattttatgaga

SEQ ID NO: 37502 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
gaacaaagggaaatccaatt

SEQ ID NO: 37503 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
gtgtctgcacgtatatcgca

SEQ ID NO: 37504 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
tctgccacacttcaaactga

SEQ ID NO: 37505 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
aagtggaaaatcaagagaca

SEQ ID NO: 37506 - DNA, 20 bp, Artificial Sequence
  Description of Artificial Sequence: Synthetic oligonucleotide
  Target: ATXN1; (+) strand; PAM type: NNNNGHTT; PAM sequence: TTTAGTTT
aaagtcaaaatgcaatgtta

SEQ ID NO: 37507 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
aagaatgtatgcacaaaaca

SEQ ID NO: 37508 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
tgtatgcacaaaacacctgg

SEQ ID NO: 37509 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
caaaacacctggatttgctt

SEQ ID NO: 37510 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
ccttgccagtaacttttttt

SEQ ID NO: 37511 - DNA, 20 bp, Artificial Sequence
  Description of Artificial Sequence: Synthetic oligonucleotide
  Target: ATXN1; (+) strand; PAM type: NNNNGHTT; PAM sequence: AGACGTTT
ccatgcacagatggaagtac

SEQ ID NO: 37512 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
atttggttcagaggacccat

SEQ ID NO: 37513 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
ccacagcaaagaacacagaa

SEQ ID NO: 37514 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
aaagaccagttgatgactgt

SEQ ID NO: 37515 - DNA, 20 bp, Artificial Sequence
  Description of Artificial Sequence: Synthetic oligonucleotide
  Target: ATXN1; (+) strand; PAM type: NNNNGHTT; PAM sequence: AATAGATT
aaatgaatctcataatgaca

SEQ ID NO: 37516 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
ggcctaatctcattagcagg

SEQ ID NO: 37517 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
atctcattagcaggagaagt

SEQ ID NO: 37518 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
ataaacaatgaacaggttgg

SEQ ID NO: 37519 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
aacaggttggaactgtttgg

SEQ ID NO: 37520 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
atttacaaaacaaaaaaaaa

SEQ ID NO: 37521 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
taacagaactttattcctcg

SEQ ID NO: 37522 - DNA, 20 bp, Artificial Sequence
  Description of Artificial Sequence: Synthetic oligonucleotide
  Target: ATXN1; (+) strand; PAM type: NNNNGHTT; PAM sequence: ATTAGCTT
ttaaaccgctaacactggct

SEQ ID NO: 37523 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
tgaggagaagaaaaaaggta

SEQ ID NO: 37524 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
aagactagaattttaaaaaa

SEQ ID NO: 37525 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
ctgaattatttatagttgca

SEQ ID NO: 37526 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
ttattactgcaggcactggc

SEQ ID NO: 37527 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
agaaatgttatttcatttag

SEQ ID NO: 37528 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
tgtaacactagccactgtga

SEQ ID NO: 37529 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
aatatggttgtcagaacaag

SEQ ID NO: 37530 - DNA, 20 bp, Artificial Sequence
  Description of Artificial Sequence: Synthetic oligonucleotide
  Target: ATXN1; (+) strand; PAM type: NNNNGHTT; PAM sequence: AGCAGATT
gtatccattctccaatacac

SEQ ID NO: 37531 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
cacagcagatttatatttca

SEQ ID NO: 37532 - DNA, 20 bp, Artificial Sequence
  Description of Artificial Sequence: Synthetic oligonucleotide
  Target: ATXN1; (+) strand; PAM type: NNNNGHTT; PAM sequence: GTCAGCTT
ccaacgaggggcatatattt

SEQ ID NO: 37533 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
aggggcatatatttgtcagc

SEQ ID NO: 37534 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
tctgtttgcacttgttctat

SEQ ID NO: 37535 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
agtgatcaaattttttttgt

SEQ ID NO: 37536 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
agactatgggacagctaaaa

SEQ ID NO: 37537 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
ctcctgggggaaaagctgta

SEQ ID NO: 37538 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
agagagatagatggcctttg

SEQ ID NO: 37539 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
tagatggcctttgtcttgtt

SEQ ID NO: 37540 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
cttgtttgcagtttcactaa

SEQ ID NO: 37541 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
tgaggtttccagatataaaa

SEQ ID NO: 37542 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
tctgtcaagtctaaatgtga

SEQ ID NO: 37543 - DNA, 20 bp, Artificial Sequence
  Description of Artificial Sequence: Synthetic oligonucleotide
  Target: ATXN1; (+) strand; PAM type: NNNNGHTT; PAM sequence: AAAGGCTT
actacttctgcaaagaaaga

SEQ ID NO: 37544 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
agaaaaggcttcataatagt

SEQ ID NO: 37545 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
gatggacagtgtattttact

SEQ ID NO: 37546 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
taattattggggaagtaact

SEQ ID NO: 37547 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
cttcttgcctagcagaataa

SEQ ID NO: 37548 - DNA, 20 bp, Artificial Sequence
  Description of Artificial Sequence: Synthetic oligonucleotide
  Target: ATXN1; (+) strand; PAM type: NNNNGHTT; PAM sequence: AAGAGCTT
gctgattcacaggtggctgg

SEQ ID NO: 37549 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
gatacctacacagagaaatg

SEQ ID NO: 37550 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
agagcagatgacattaaatt

SEQ ID NO: 37551 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
agattccatatatgagatca

SEQ ID NO: 37552 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
atgagatcaatttgatttcc

SEQ ID NO: 37553 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
gctgcaaaatgaaaatcatt

SEQ ID NO: 37554 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
aatcattctctgtttatcca

SEQ ID NO: 37555 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgccttggcctcccaaagca

SEQ ID NO: 37556 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
catctaaatttataatgaag

SEQ ID NO: 37557 - DNA, 20 bp, Artificial Sequence
  Description of Artificial Sequence: Synthetic oligonucleotide
  Target: ATXN1; (+) strand; PAM type: NNNNGHTT; PAM sequence: AAGGGATT
actgggaattgcacataccc

SEQ ID NO: 37558 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
ctgaactacaagtcagaaaa

SEQ ID NO: 37559 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
aaatcagtcaacctcgtagg

SEQ ID NO: 37560 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
ctgcacatggtctggataac

SEQ ID NO: 37561 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
accctggacatttaaaatga

SEQ ID NO: 37562 - DNA, 20 bp, Artificial Sequence
  Description of Artificial Sequence: Synthetic oligonucleotide
  Target: ATXN1; (+) strand; PAM type: NNNNGHTT; PAM sequence: TTGCGATT
acccttcagagacagaaact

SEQ ID NO: 37563 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
tacagcaggacagccaacag

SEQ ID NO: 37564 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
agatgatatgaactgtgtca

SEQ ID NO: 37565 - DNA, 20 bp, Artificial Sequence
  Description of Artificial Sequence: Synthetic oligonucleotide
  Target: ATXN1; (+) strand; PAM type: NNNNGHTT; PAM sequence: AGACGTTT
tttcaaggtcctactcagaa

SEQ ID NO: 37566 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
aagacgtttcttcattttaa

SEQ ID NO: 37567 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
ctaatcactaggatgactga

SEQ ID NO: 37568 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
agtagtcttcctccttttat

SEQ ID NO: 37569 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
cctccttttatatctgttta

SEQ ID NO: 37570 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
agaaaggttcaaggggttac

SEQ ID NO: 37571 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
ccaaaataaaacaccgaaat

SEQ ID NO: 37572 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
agaaagcaaagttgtatgga

SEQ ID NO: 37573 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
gctgcagcggtcaaaggacc

SEQ ID NO: 37574 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
gcggtcaaaggacccagggc

SEQ ID NO: 37575 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
gccaactcaaaagggcacag

SEQ ID NO: 37576 - DNA, 20 bp, Artificial Sequence
  Description of Artificial Sequence: Synthetic oligonucleotide
  Target: ATXN1; (+) strand; PAM type: NNNNGHTT; PAM sequence: ACCGGTTT
ttagatggacctcctacccc

SEQ ID NO: 37577 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
ccggtttcatacttgacgag

SEQ ID NO: 37578 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
gacgagcagggtttgcagaa

SEQ ID NO: 37579 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
gtattgaatttcaataataa

SEQ ID NO: 37580 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
tgcagtactataaaacttaa

SEQ ID NO: 37581 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
gaattcagcactctattacg

SEQ ID NO: 37582 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
gacctttctttctccttagc

SEQ ID NO: 37583 - DNA, 20 bp, Artificial Sequence
  Description of Artificial Sequence: Synthetic oligonucleotide
  Target: ATXN1; (+) strand; PAM type: NNNNGHTT; PAM sequence: CATAGCTT
ccagtggaacaaacaggtgc

SEQ ID NO: 37584 - DNA, 20 bp, Artificial Sequence
  Description of Artificial Sequence: Synthetic oligonucleotide
  Target: ATXN1; (+) strand; PAM type: NNNNGHTT; PAM sequence: AAGGGCTT
aataacatagtccctagtcc

SEQ ID NO: 37585 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
cgtgaggaagagactctaag

SEQ ID NO: 37586 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
caaaacctatggagccaggc

SEQ ID NO: 37587 - DNA, 20 bp, Artificial Sequence
  Description of Artificial Sequence: Synthetic oligonucleotide
  Target: ATXN1; (+) strand; PAM type: NNNNGHTT; PAM sequence: AGCAGATT
ttaagaaaaacagagatgtc

SEQ ID NO: 37588 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
aaatactaacaaatgttcat

SEQ ID NO: 37589 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
tggttagactttggccaggc

SEQ ID NO: 37590 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
ctagtcagggaggctgccag

SEQ ID NO: 37591 - DNA, 20 bp, Artificial Sequence
  Description of Artificial Sequence: Synthetic oligonucleotide
  Target: ATXN1; (+) strand; PAM type: NNNNGHTT; PAM sequence: AATGGATT
gtagcaaataggacttttta

SEQ ID NO: 37592 - DNA, 20 bp, Artificial Sequence
  Description of Artificial Sequence: Synthetic oligonucleotide
  Target: ATXN1; (+) strand; PAM type: NNNNGHTT; PAM sequence: CATAGATT
acatataaagagctcatata

SEQ ID NO: 37593 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
aatagtaagtcccacaatta

SEQ ID NO: 37594 - DNA, 20 bp, Artificial Sequence
  Description of Artificial Sequence: Synthetic oligonucleotide
  Target: ATXN1; (+) strand; PAM type: NNNNGHTT; PAM sequence: TGCGGCTT
ttgtgtgcaaagacattcgc

SEQ ID NO: 37595 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
tgtatagctgaagttactaa

SEQ ID NO: 37596 - DNA, 20 bp, Artificial Sequence
  Description of Artificial Sequence: Synthetic oligonucleotide
  Target: ATXN1; (+) strand; PAM type: NNNNGHTT; PAM sequence: ACTTGATT
aaaacaacacataaaaatga

SEQ ID NO: 37597 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
atggtggaatcaaagggaac

SEQ ID NO: 37598 - DNA, 20 bp, Artificial Sequence
  Description of Artificial Sequence: Synthetic oligonucleotide
  Target: ATXN1; (+) strand; PAM type: NNNNGHTT; PAM sequence: ATTGGCTT
caaagggaacttttgctttt

SEQ ID NO: 37599 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
ttggctttcctttattattg

SEQ ID NO: 37600 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
tattgtaaggtttgggcaat

SEQ ID NO: 37601 - DNA, 20 bp, Artificial Sequence
  Description of Artificial Sequence: Synthetic oligonucleotide
  Target: ATXN1; (+) strand; PAM type: NNNNGHTT; PAM sequence: GGGTGCTT
gtcactgccaggttagtgga

SEQ ID NO: 37602 - DNA, 20 bp, Artificial Sequence
  Description of Artificial Sequence: Synthetic oligonucleotide
  Target: ATXN1; (+) strand; PAM type: NNNNGHTT; PAM sequence: GGGTGCTT
gtcactgacaggttagtgga

SEQ ID NO: 37603 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
cccaaatttcaaaggtcctt

SEQ ID NO: 37604 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
aatgcagcactttcctttgt

SEQ ID NO: 37605 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
gtgtgtgtgtgtgtgtgtgt

SEQ ID NO: 37606 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
gagtgcacatttaatctttc

SEQ ID NO: 37607 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
cagatgaggaaattgaggat

SEQ ID NO: 37608 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
aaagccaggagccagagcca

SEQ ID NO: 37609 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
aatcaagaggcatctgtatg

SEQ ID NO: 37610 - DNA, 20 bp, Artificial Sequence
  Description of Artificial Sequence: Synthetic oligonucleotide
  Target: ATXN1; (+) strand; PAM type: NNNNGHTT; PAM sequence: AAACGATT
ggtaaaaccaaatgacatca

SEQ ID NO: 37611 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
cagaatatggcccttgatat

SEQ ID NO: 37612 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
gatattactgcttagaaaag

SEQ ID NO: 37613 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
aaataatcccacaatcagct

SEQ ID NO: 37614 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
attccacctccagaaatgga

SEQ ID NO: 37615 - DNA, 20 bp, Artificial Sequence
  Description of Artificial Sequence: Synthetic oligonucleotide
  Target: ATXN1; (+) strand; PAM type: NNNNGHTT; PAM sequence: CACCGCTT
gggtgataaatgaatttagg

SEQ ID NO: 37616 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
caaagtcaaacaacagcaaa

SEQ ID NO: 37617 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
gatcatttctttcaacctcc

SEQ ID NO: 37618 - DNA, 20 bp, Artificial Sequence
  Description of Artificial Sequence: Synthetic oligonucleotide
  Target: ATXN1; (+) strand; PAM type: NNNNGHTT; PAM sequence: CCTGGTTT
gggcacattttaaaaagaag

SEQ ID NO: 37619 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
cattttaaaaagaagcctgg

SEQ ID NO: 37620 - DNA, 20 bp, Artificial Sequence
  Description of Artificial Sequence: Synthetic oligonucleotide
  Target: ATXN1; (+) strand; PAM type: NNNNGHTT; PAM sequence: CGGTGTTT
ttggaaaactgcacgctgct

SEQ ID NO: 37621 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
gaaatattaacaggccatat

SEQ ID NO: 37622 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
catatcccccaggcctacag

SEQ ID NO: 37623 - DNA, 20 bp, Artificial Sequence
  Description of Artificial Sequence: Synthetic oligonucleotide
  Target: ATXN1; (+) strand; PAM type: NNNNGHTT; PAM sequence: AGGAGCTT
gacatacaactgttacaggg

SEQ ID NO: 37624 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
tgtaaataaaaatgcatcac

SEQ ID NO: 37625 - DNA, 20 bp, Artificial Sequence
  Description of Artificial Sequence: Synthetic oligonucleotide
  Target: ATXN1; (+) strand; PAM type: NNNNGHTT; PAM sequence: TCTCGATT
tagtaaatcttgcatcctct

SEQ ID NO: 37626 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
atcatcttgacatgaatgag

SEQ ID NO: 37627 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
gggcagaggggatgtgagtt

SEQ ID NO: 37628 - DNA, 20 bp, Artificial Sequence
  Description of Artificial Sequence: Synthetic oligonucleotide
  Target: ATXN1; (+) strand; PAM type: NNNNGHTT; PAM sequence: GCACGTTT
aagcgtgacctccttttgct

SEQ ID NO: 37629 - DNA, 20 bp, Artificial Sequence
  Description of Artificial Sequence: Synthetic oligonucleotide
  Target: ATXN1; (+) strand; PAM type: NNNNGHTT; PAM sequence: TAGAGCTT
tttgctgcacgttttattct

SEQ ID NO: 37630 - DNA, 20 bp, Artificial Sequence
  Description of Artificial Sequence: Synthetic oligonucleotide
  Target: ATXN1; (+) strand; PAM type: NNNNGHTT; PAM sequence: GTAAGCTT
cttgccttatgcactcgact

SEQ ID NO: 37631 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
gactgtaagcttcttaagga

SEQ ID NO: 37632 - DNA, 20 bp, Artificial Sequence
  Description of Artificial Sequence: Synthetic oligonucleotide
  Target: ATXN1; (+) strand; PAM type: NNNNGHTT; PAM sequence: GCACGATT
gagtgtagactgggatccaa

SEQ ID NO: 37633 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
attattcaccctctctgtgc

SEQ ID NO: 37634 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
cctacctcaaaggactgtaa

SEQ ID NO: 37635 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
caagaacgatctgcccctgg

SEQ ID NO: 37636 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
ttgatgaaagttaaataagt

SEQ ID NO: 37637 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gactaactttctccccagac

SEQ ID NO: 37638 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
acaaaacacacccaaattaa

SEQ ID NO: 37639 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
agagtcaagtagatggcaca

SEQ ID NO: 37640 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
ggaattgttgttaaaacgta

SEQ ID NO: 37641 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
ttcactgaaaatcttaataa

SEQ ID NO: 37642 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
tagaggaaaatagaaggatc

SEQ ID NO: 37643 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
tcatttttatacacacacac

SEQ ID NO: 37644 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
tttaaaggtcttaaaggaag

SEQ ID NO: 37645 - DNA, 20 bp, Artificial Sequence
  Description of Artificial Sequence: Synthetic oligonucleotide
  Target: ATXN1; (+) strand; PAM type: NNNNGHTT; PAM sequence: ACAAGATT
ttaaaggaagagaggttttg

SEQ ID NO: 37646 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
cattgaactgtagttcagca

SEQ ID NO: 37647 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
atcttcagacttgacctctc

SEQ ID NO: 37648 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
attcagatgtccaccagcac

SEQ ID NO: 37649 - DNA, 20 bp, Artificial Sequence
  Description of Artificial Sequence: Synthetic oligonucleotide
  Target: ATXN1; (+) strand; PAM type: NNNNGHTT; PAM sequence: ATTGGCTT
tggtcagttacataccgtgc

SEQ ID NO: 37650 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
tattcgtattcattatttca

SEQ ID NO: 37651 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
ccattcccacagcaccatgc

SEQ ID NO: 37652 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
gaaccagaaagaactataat

SEQ ID NO: 37653 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
atgaggccattattgatgca

SEQ ID NO: 37654 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
attgatgcaaaatgtttaga

SEQ ID NO: 37655 - DNA, 20 bp, Artificial Sequence
  Description of Artificial Sequence: Synthetic oligonucleotide
  Target: ATXN1; (+) strand; PAM type: NNNNGHTT; PAM sequence: ATAAGCTT
aaaatgtttagataatgctt

SEQ ID NO: 37656 - DNA, 20 bp, Artificial Sequence
  Description of Artificial Sequence: Synthetic oligonucleotide
  Target: ATXN1; (+) strand; PAM type: NNNNGHTT; PAM sequence: CAGCGCTT
aatgcaatcatagaaaatgt

SEQ ID NO: 37657 - DNA, 20 bp, Artificial Sequence
  Description of Artificial Sequence: Synthetic oligonucleotide
  Target: ATXN1; (+) strand; PAM type: NNNNGHTT; PAM sequence: GCCTGTTT
aagagatatgactttttgct

SEQ ID NO: 37658 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
tttccccaaagatctaaatg

SEQ ID NO: 37659 - DNA, 20 bp, Artificial Sequence
  Description of Artificial Sequence: Synthetic oligonucleotide
  Target: ATXN1; (+) strand; PAM type: NNNNGHTT; PAM sequence: CCAGGATT
gctcactgcaacctctgcct

SEQ ID NO: 37660 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctctgcctccaggattc

SEQ ID NO: 37661 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagtgtcccaagtag

SEQ ID NO: 37662 - DNA, 20 bp, Artificial Sequence
  Description of Artificial Sequence: Synthetic oligonucleotide
  Target: ATXN1; (+) strand; PAM type: NNNNGHTT; PAM sequence: ACAGGATT
tttttatatttttagtagag

SEQ ID NO: 37663 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
ggtctcaaactcctgacctc

SEQ ID NO: 37664 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcagcctcccaaagtg

SEQ ID NO: 37665 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
gctgacacttgtagatctta

SEQ ID NO: 37666 - DNA, 20 bp, Artificial Sequence
  Description of Artificial Sequence: Synthetic oligonucleotide
  Target: ATXN1; (+) strand; PAM type: NNNNGHTT; PAM sequence: GGCTGTTT
tcccccactgggactttttt

SEQ ID NO: 37667 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
aggcataatacttcagtcac

SEQ ID NO: 37668 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
aatacttcagtcactcaggt

SEQ ID NO: 37669 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
caaaaacaaataaaaggctc

SEQ ID NO: 37670 - DNA, 20 bp, Artificial Sequence
  Description of Artificial Sequence: Synthetic oligonucleotide
  Target: ATXN1; (+) strand; PAM type: NNNNGHTT; PAM sequence: GGTTGATT
ccagatcttaagtccagatg

SEQ ID NO: 37671 - DNA, 20 bp, Artificial Sequence
  Description of Artificial Sequence: Synthetic oligonucleotide
  Target: ATXN1; (+) strand; PAM type: NNNNGHTT; PAM sequence: TATTGTTT
ttcaaagaaatctggtcaat

SEQ ID NO: 37672 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
atccatctacctcttgaaaa

SEQ ID NO: 37673 - DNA, 20 bp, Artificial Sequence
  Description of Artificial Sequence: Synthetic oligonucleotide
  Target: ATXN1; (+) strand; PAM type: NNNNGHTT; PAM sequence: GGGAGATT
gaaaattcaaattttcaaat

SEQ ID NO: 37674 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
ggagatttgctaaaagtaga

SEQ ID NO: 37675 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
gcatcagtgcctagacagat

SEQ ID NO: 37676 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
aatgattccagcaggaaaca

SEQ ID NO: 37677 - DNA, 20 bp, Artificial Sequence
  Description of Artificial Sequence: Synthetic oligonucleotide
  Target: ATXN1; (+) strand; PAM type: NNNNGHTT; PAM sequence: AGGTGATT
tctatttttttaagctctcc

SEQ ID NO: 37678 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
caggtgattctgttgcctag

SEQ ID NO: 37679 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
cctctaatctagtctgtctt

SEQ ID NO: 37680 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
ctagcaaacctctttttcct

SEQ ID NO: 37681 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
ccaaacagacacaaagaaat

SEQ ID NO: 37682 - DNA, 20 bp, Artificial Sequence
  Description of Artificial Sequence: Synthetic oligonucleotide
  Target: ATXN1; (+) strand; PAM type: NNNNGHTT; PAM sequence: CTCTGTTT
gttcccctaaacaaataggt

SEQ ID NO: 37683 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
aatgaaagtcttcatgaaca

SEQ ID NO: 37684 - DNA, 20 bp, Artificial Sequence
  Description of Artificial Sequence: Synthetic oligonucleotide
  Target: ATXN1; (+) strand; PAM type: NNNNGHTT; PAM sequence: CGAAGTTT
aaatagatagatactttaat

SEQ ID NO: 37685 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
cttcccacactatgcccaaa

SEQ ID NO: 37686 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
ccctgtagtggcagtggagg

SEQ ID NO: 37687 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
acaaggatgacaaacaaatc

SEQ ID NO: 37688 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
ccaaaatgaaaaacagaata

SEQ ID NO: 37689 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
cagccagctcaaaaggcagg

SEQ ID NO: 37690 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
gccgctgtcattcttttctc

SEQ ID NO: 37691 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
gagtatcaggtgaaaatggg

SEQ ID NO: 37692 - DNA, 20 bp, Artificial Sequence
  Description of Artificial Sequence: Synthetic oligonucleotide
  Target: ATXN1; (+) strand; PAM type: NNNNGHTT; PAM sequence: GGGAGCTT
ttccatatacctttccatca

SEQ ID NO: 37693 - DNA, 20 bp, Artificial Sequence
  Description of Artificial Sequence: Synthetic oligonucleotide
  Target: ATXN1; (+) strand; PAM type: NNNNGHTT; PAM sequence: TGGTGCTT
tacctttccatcagggagct

SEQ ID NO: 37694 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
tcagggagcttggtgcttgt

SEQ ID NO: 37695 - DNA, 20 bp, Artificial Sequence
  Description of Artificial Sequence: Synthetic oligonucleotide
  Target: ATXN1; (+) strand; PAM type: NNNNGHTT; PAM sequence: GACTGATT
ccccaaactagtgaatgctg

SEQ ID NO: 37696 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
atgctggactgattttcagt

SEQ ID NO: 37697 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
ttactggagctgatctgcac

SEQ ID NO: 37698 - DNA, 20 bp, Artificial Sequence
  Description of Artificial Sequence: Synthetic oligonucleotide
  Target: ATXN1; (+) strand; PAM type: NNNNGHTT; PAM sequence: GGCTGATT
ctgatctgcacatttgctta

SEQ ID NO: 37699 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
ttgcttaggctgattttaaa

SEQ ID NO: 37700 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
aggctgattttaaacttagt

SEQ ID NO: 37701 - DNA, 20 bp, Artificial Sequence
  Description of Artificial Sequence: Synthetic oligonucleotide
  Target: ATXN1; (+) strand; PAM type: NNNNGHTT; PAM sequence: CCAGGTTT
aacagtaggaagaaggaggc

SEQ ID NO: 37702 - DNA, 20 bp, Artificial Sequence
  Description of Artificial Sequence: Synthetic oligonucleotide
  Target: ATXN1; (+) strand; PAM type: NNNNGHTT; PAM sequence: TCATGATT
atggcaacacatctcggtac

SEQ ID NO: 37703 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
tcaccaagcatttatttaag

SEQ ID NO: 37704 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
aagaaggaattcttgtagtc

SEQ ID NO: 37705 - DNA, 20 bp, Artificial Sequence
  Description of Artificial Sequence: Synthetic oligonucleotide
  Target: ATXN1; (+) strand; PAM type: NNNNGHTT; PAM sequence: ACTTGATT
ctcaaattaagcatcaaaat

SEQ ID NO: 37706 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
aggtaccataaatttacaga

SEQ ID NO: 37707 - DNA, 20 bp, Artificial Sequence
  Description of Artificial Sequence: Synthetic oligonucleotide
  Target: ATXN1; (+) strand; PAM type: NNNNGHTT; PAM sequence: GAGTGTTT
tatgagctcaccagttggga

SEQ ID NO: 37708 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
gacaatgtgtgtgcacacaa

SEQ ID NO: 37709 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
tttacatatcacctggcaga

SEQ ID NO: 37710 - DNA, 20 bp, Artificial Sequence
  Description of Artificial Sequence: Synthetic oligonucleotide
  Target: ATXN1; (+) strand; PAM type: NNNNGHTT; PAM sequence: CCTAGTTT
agtccaagttacaacctcct

SEQ ID NO: 37711 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
aaacatgatgtaaatgccat

SEQ ID NO: 37712 - DNA, 20 bp, Artificial Sequence
  Description of Artificial Sequence: Synthetic oligonucleotide
  Target: ATXN1; (+) strand; PAM type: NNNNGHTT; PAM sequence: GTATGCTT
attactttactcttgcatga

SEQ ID NO: 37713 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
gcactagttaggataataca

SEQ ID NO: 37714 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
aatacaatactattaatatt

SEQ ID NO: 37715 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
aaattaagggcacaagaaaa

SEQ ID NO: 37716 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
attttcaggtaggatacaat

SEQ ID NO: 37717 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
gaaatatgtcaaacaaaata

SEQ ID NO: 37718 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
gtcaaacaaaatataatgct

SEQ ID NO: 37719 - DNA, 20 bp, Artificial Sequence
  Description of Artificial Sequence: Synthetic oligonucleotide
  Target: ATXN1; (+) strand; PAM type: NNNNGHTT; PAM sequence: ACGTGTTT
tccataattgttctctctaa

SEQ ID NO: 37720 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
aataaaataaaaaactttcc

SEQ ID NO: 37721 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
ctattaccatttctacaatg

SEQ ID NO: 37722 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
tttctacaatgtattgcttt

SEQ ID NO: 37723 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
cttttatcaaaataaggagg

SEQ ID NO: 37724 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
atgtgttattttcagataac

SEQ ID NO: 37725 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
tcccacatttacctacttac

SEQ ID NO: 37726 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
agtttcagaattttagtaaa

SEQ ID NO: 37727 - DNA, 20 bp, Artificial Sequence
  Description of Artificial Sequence: Synthetic oligonucleotide
  Target: ATXN1; (+) strand; PAM type: NNNNGHTT; PAM sequence: TATTGCTT
gaattttagtaaaatatgtt

SEQ ID NO: 37728 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
aacaaaaacaggagtcatag

SEQ ID NO: 37729 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
gacatgtaatcttgtggcta

SEQ ID NO: 37730 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
taatcttgtggctaaagagt

SEQ ID NO: 37731 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
catttttgacaaagtgtcac

SEQ ID NO: 37732 - DNA, 20 bp, Artificial Sequence
  Description of Artificial Sequence: Synthetic oligonucleotide
  Target: ATXN1; (+) strand; PAM type: NNNNGHTT; PAM sequence: CCTTGCTT
gcattgtgtaatattgacat

SEQ ID NO: 37733 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
atagctcattttaactacag

SEQ ID NO: 37734 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
agccctgggggaaaaaattt

SEQ ID NO: 37735 - DNA, 20 bp, Artificial Sequence
  Description of Artificial Sequence: Synthetic oligonucleotide
  Target: ATXN1; (+) strand; PAM type: NNNNGHTT; PAM sequence: TTTAGCTT
tgggggaaaaaatttaccag

SEQ ID NO: 37736 - DNA, 20 bp, Artificial Sequence
  Description of Artificial Sequence: Synthetic oligonucleotide
  Target: ATXN1; (+) strand; PAM type: NNNNGHTT; PAM sequence: GTTGGATT
cccgccccctgccccactta

SEQ ID NO: 37737 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
gttggattgcctgagcagca

SEQ ID NO: 37738 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
tttgccataatattatttct

SEQ ID NO: 37739 - DNA, 20 bp, Artificial Sequence
  Description of Artificial Sequence: Synthetic oligonucleotide
  Target: ATXN1; (+) strand; PAM type: NNNNGHTT; PAM sequence: GCCAGCTT
atattatttctctttgctta

SEQ ID NO: 37740 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
ccctaatgcaaagactagaa

SEQ ID NO: 37741 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
attacatcctaaaataaagt

SEQ ID NO: 37742 - DNA, 20 bp, Artificial Sequence
  Description of Artificial Sequence: Synthetic oligonucleotide
  Target: ATXN1; (+) strand; PAM type: NNNNGHTT; PAM sequence: TATCGTTT
gtcctctagctataggcctc

SEQ ID NO: 37743 - DNA, 20 bp, Artificial Sequence
  Description of Artificial Sequence: Synthetic oligonucleotide
  Target: ATXN1; (+) strand; PAM type: NNNNGHTT; PAM sequence: TCTCGCTT
agctataggcctctatcgtt

SEQ ID NO: 37744 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
aatgtctgcctactgtcagt

SEQ ID NO: 37745 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
agtttttgttatgatggctg

SEQ ID NO: 37746 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
gcaccagactgcaaaagaaa

SEQ ID NO: 37747 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
tgttgctttagtgagctctg

SEQ ID NO: 37748 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
tctgttcacaataaacacca

SEQ ID NO: 37749 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
tacatactgcacctaggaag

SEQ ID NO: 37750 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
tgaaatagtggagtctctcg

SEQ ID NO: 37751 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
gttcaggggagcccttcaac

SEQ ID NO: 37752 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
cacagtgagagggcaatcag

SEQ ID NO: 37753 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
ccctttccaagagttcctgt

SEQ ID NO: 37754 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
caggattttctcttctctct

SEQ ID NO: 37755 - DNA, 20 bp, Artificial Sequence
  Description of Artificial Sequence: Synthetic oligonucleotide
  Target: ATXN1; (+) strand; PAM type: NNNNGHTT; PAM sequence: ATAAGCTT
ctctggtggtttcctcagac

SEQ ID NO: 37756 - DNA, 20 bp, Artificial Sequence
  Description of Artificial Sequence: Synthetic oligonucleotide
  Target: ATXN1; (+) strand; PAM type: NNNNGHTT; PAM sequence: GTGGGCTT
cccatcaaataaaccgaagg

SEQ ID NO: 37757 - DNA, 20 bp, Artificial Sequence
  Description of Artificial Sequence: Synthetic oligonucleotide
  Target: ATXN1; (+) strand; PAM type: NNNNGHTT; PAM sequence: GGGGGCTT
aaccgaagggtgggcttaag

SEQ ID NO: 37758 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
ctgtgtgcaatatataacaa

SEQ ID NO: 37759 - DNA, 20 bp, Artificial Sequence
  Description of Artificial Sequence: Synthetic oligonucleotide
  Target: ATXN1; (+) strand; PAM type: NNNNGHTT; PAM sequence: ACTAGATT
aatgtcattgagatgtgact

SEQ ID NO: 37760 - DNA, 20 bp, Artificial Sequence
  Description of Artificial Sequence: Synthetic oligonucleotide
  Target: ATXN1; (+) strand; PAM type: NNNNGHTT; PAM sequence: ATTAGTTT
ggagaaagccactgtaaggc

SEQ ID NO: 37761 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
agaatctcttcggggacaga

SEQ ID NO: 37762 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
catacggtaaacaaaataaa

SEQ ID NO: 37763 - DNA, 20 bp, Artificial Sequence
  Description of Artificial Sequence: Synthetic oligonucleotide
  Target: ATXN1; (+) strand; PAM type: NNNNGHTT; PAM sequence: ACCAGCTT
gccacatcgcgcattatata

SEQ ID NO: 37764 - DNA, 20 bp, Artificial Sequence
  Description of Artificial Sequence: Synthetic oligonucleotide
  Target: ATXN1; (+) strand; PAM type: NNNNGHTT; PAM sequence: GACTGTTT
ttatataaccagcttcttcc

SEQ ID NO: 37765 - DNA, 20 bp, Artificial Sequence
  Description of Artificial Sequence: Synthetic oligonucleotide
  Target: ATXN1; (+) strand; PAM type: NNNNGHTT; PAM sequence: GTAGGATT
tttatattacccttttatct

SEQ ID NO: 37766 - DNA, 20 bp, Artificial Sequence
  Description of Artificial Sequence: Synthetic oligonucleotide
  Target: ATXN1; (+) strand; PAM type: NNNNGHTT; PAM sequence: AACGGATT
gaatccccgccgtccttaga

SEQ ID NO: 37767 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
gtccttagaaacggattttt

SEQ ID NO: 37768 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tagaaacggatttttttttg

SEQ ID NO: 37769 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
acggatttttttttgttttg

SEQ ID NO: 37770 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
caatctccctagaaaacctg

SEQ ID NO: 37771 - DNA, 20 bp, Artificial Sequence
  Description of Artificial Sequence: Synthetic oligonucleotide
  Target: ATXN1; (+) strand; PAM type: NNNNGHTT; PAM sequence: CGGAGTTT
caaaatgaaagcacaagcca

SEQ ID NO: 37772 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
ctcctcctccttcccctcct

SEQ ID NO: 37773 - DNA, 20 bp, Artificial Sequence
  Description of Artificial Sequence: Synthetic oligonucleotide
  Target: ATXN1; (+) strand; PAM type: NNNNGHTT; PAM sequence: CGTCGATT
cacacacacagaacacgacg

SEQ ID NO: 37774 - DNA, 20 bp, Artificial Sequence
  Description of Artificial Sequence: Synthetic oligonucleotide
  Target: ATXN1; (+) strand; PAM type: NNNNGHTT; PAM sequence: AGCTGTTT
atttccttcgctcctcttcc

SEQ ID NO: 37775 - DNA, 20 bp, Artificial Sequence
  Description of Artificial Sequence: Synthetic oligonucleotide
  Target: ATXN1; (+) strand; PAM type: NNNNGHTT; PAM sequence: AGCCGATT
cttccagctgttttccgtgc

SEQ ID NO: 37776 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ctgttttccgtgcagccgat

SEQ ID NO: 37777 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
ccgtgcagccgattggggtt

SEQ ID NO: 37778 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
gcagccgattggggttttgg

SEQ ID NO: 37779 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
ttttgggtttgtttgctggt

SEQ ID NO: 37780 - DNA, 20 bp, Artificial Sequence
  Description of Artificial Sequence: Synthetic oligonucleotide
  Target: ATXN1; (+) strand; PAM type: NNNNGHTT; PAM sequence: GAGGGATT
ctctcgggagatcgggggag

SEQ ID NO: 37781 - DNA, 20 bp, Artificial Sequence
  Description of Artificial Sequence: Synthetic oligonucleotide
  Target: ATXN1; (+) strand; PAM type: NNNNGHTT; PAM sequence: CGGGGCTT
ttgctctggctgctgctcca

SEQ ID NO: 37782 - DNA, 20 bp, Artificial Sequence
  Description of Artificial Sequence: Synthetic oligonucleotide
  Target: ATXN1; (+) strand; PAM type: NNNNGHTT; PAM sequence: GCTTGTTT
tctggctgctgctccacggg

SEQ ID NO: 37783 - DNA, 20 bp, Artificial Sequence
  Description of Artificial Sequence: Synthetic oligonucleotide
  Target: ATXN1; (+) strand; PAM type: NNNNGHTT; PAM sequence: CCAGGTTT
accggagggcaaggttcctt

SEQ ID NO: 37784 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
ggggactcccccaagggctg

SEQ ID NO: 37785 - DNA, 20 bp, Artificial Sequence
  Description of Artificial Sequence: Synthetic oligonucleotide
  Target: ATXN1; (+) strand; PAM type: NNNNGHTT; PAM sequence: CGTCGCTT
cacgttaagccacaaaccgg

SEQ ID NO: 37786 - DNA, 20 bp, Artificial Sequence
  Description of Artificial Sequence: Synthetic oligonucleotide
  Target: ATXN1; (+) strand; PAM type: NNNNGHTT; PAM sequence: CGGGGATT
gaacccaggcctgggggccg

SEQ ID NO: 37787 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
tgcctctgcgtgcaactccg

SEQ ID NO: 37788 - DNA, 20 bp, Artificial Sequence
  Description of Artificial Sequence: Synthetic oligonucleotide
  Target: ATXN1; (+) strand; PAM type: NNNNGHTT; PAM sequence: ATCGGCTT
cttcgcacgcaggtccggaa

SEQ ID NO: 37789 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
gaggaacttaaatctggact

SEQ ID NO: 37790 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
cagtgcggcgttcttgttgc

SEQ ID NO: 37791 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
ggcgacatttgaccttcttc

SEQ ID NO: 37792 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
tggaaacatgatcctttcgc

SEQ ID NO: 37793 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
gtatttgagagatcttttgg

SEQ ID NO: 37794 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
aggatgaccaaaaaaaaagt

SEQ ID NO: 37795 - DNA, 20 bp, Artificial Sequence
  Description of Artificial Sequence: Synthetic oligonucleotide
  Target: ATXN1; (+) strand; PAM type: NNNNGHTT; PAM sequence: ACGTGCTT
actctggcctgcaagagcct

SEQ ID NO: 37796 - DNA, 20 bp, Artificial Sequence
  Description of Artificial Sequence: Synthetic oligonucleotide
  Target: ATXN1; (+) strand; PAM type: NNNNGHTT; PAM sequence: AATCGATT
cttttttttttccatttaaa

SEQ ID NO: 37797 - DNA, 20 bp, Artificial Sequence
  Description of Artificial Sequence: Synthetic oligonucleotide
  Target: ATXN1; (+) strand; PAM type: NNNNGHTT; PAM sequence: TACGGTTT
atttaaaaatcgattattgt

SEQ ID NO: 37798 - DNA, 20 bp, Artificial Sequence
  Description of Artificial Sequence: Synthetic oligonucleotide
  Target: ATXN1; (+) strand; PAM type: NNNNGHTT; PAM sequence: ATCAGTTT
gcctctagtggacagttaac

SEQ ID NO: 37799 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
agtttcctgaaaaggctctg

SEQ ID NO: 37800 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
cctgaaaaggctctgactgg

SEQ ID NO: 37801 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
gactggttttgttttcgttg

SEQ ID NO: 37802 - DNA, 20 bp, Artificial Sequence
  Description of Artificial Sequence: Synthetic oligonucleotide
  Target: ATXN1; (+) strand; PAM type: NNNNGHTT; PAM sequence: CCCTGCTT
cctcacccccgcccccaaca

SEQ ID NO: 37803 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
agacgacttcagaaaggagc

SEQ ID NO: 37804 - DNA, 20 bp, Artificial Sequence
  Description of Artificial Sequence: Synthetic oligonucleotide
  Target: ATXN1; (+) strand; PAM type: NNNNGHTT; PAM sequence: GTTGGCTT
tcagaaaggagcagaagctt

SEQ ID NO: 37805 - DNA, 20 bp, Artificial Sequence
  Description of Artificial Sequence: Synthetic oligonucleotide
  Target: ATXN1; (+) strand; PAM type: NNNNGHTT; PAM sequence: GTATGCTT
tggctttatatagaaaagac

SEQ ID NO: 37806 - DNA, 20 bp, Artificial Sequence
  Description of Artificial Sequence: Synthetic oligonucleotide
  Target: ATXN1; (+) strand; PAM type: NNNNGHTT; PAM sequence: GAAAGCTT
tactggactgtgaataaaca

SEQ ID NO: 37807 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
agaaagcttctgctattcat

SEQ ID NO: 37808 - DNA, 20 bp, Artificial Sequence
  Description of Artificial Sequence: Synthetic oligonucleotide
  Target: ATXN1; (+) strand; PAM type: NNNNGHTT; PAM sequence: GACAGCTT
tgctattcatttcagtttca

SEQ ID NO: 37809 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
ataacagaaaatattggttg

SEQ ID NO: 37810 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
aaaatattggttgccatgtt

SEQ ID NO: 37811 - DNA, 20 bp, Artificial Sequence
  Description of Artificial Sequence: Synthetic oligonucleotide
  Target: ATXN1; (+) strand; PAM type: NNNNGHTT; PAM sequence: CGATGTTT
ccatgtttttggcttaactg

SEQ ID NO: 37812 - DNA, 20 bp, Artificial Sequence
  Description of Artificial Sequence: Synthetic oligonucleotide
  Target: ATXN1; (+) strand; PAM type: NNNNGHTT; PAM sequence: ACGTGATT
ttggcacaagcagttaattt

SEQ ID NO: 37813 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
ccttaaattaaaacacataa

SEQ ID NO: 37814 - DNA, 20 bp, Artificial Sequence
  Description of Artificial Sequence: Synthetic oligonucleotide
  Target: ATXN1; (+) strand; PAM type: NNNNGHTT; PAM sequence: TTAAGTTT
gtcatttactttcttagcca

SEQ ID NO: 37815 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ttacctttagtactgaaata

SEQ ID NO: 37816 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
gtacaatcacaaataacagg

SEQ ID NO: 37817 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
aaaaactcaatgaaaaaggg

SEQ ID NO: 37818 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
tcctactcataaggctggtg

SEQ ID NO: 37819 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
aaatcgataaataaggcctg

SEQ ID NO: 37820 - DNA, 20 bp, Artificial Sequence
  Description of Artificial Sequence: Synthetic oligonucleotide
  Target: ATXN1; (+) strand; PAM type: NNNNGHTT; PAM sequence: CATAGATT
gcttgactcgtatcctgtgt

SEQ ID NO: 37821 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
gactcgtatcctgtgtcata

SEQ ID NO: 37822 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
ttgtaatcacatatctattt

SEQ ID NO: 37823 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
tattacacccttacttaaag

SEQ ID NO: 37824 - DNA, 20 bp, Artificial Sequence
  Description of Artificial Sequence: Synthetic oligonucleotide
  Target: ATXN1; (+) strand; PAM type: NNNNGHTT; PAM sequence: GGGAGCTT
aagtcgccacagcagcactt

SEQ ID NO: 37825 - DNA, 20 bp, Artificial Sequence
  Description of Artificial Sequence: Synthetic oligonucleotide
  Target: ATXN1; (+) strand; PAM type: NNNNGHTT; PAM sequence: GGGTGATT
tgcctttgaaccaggcccct

SEQ ID NO: 37826 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
taagtacagcccttattaat

SEQ ID NO: 37827 - DNA, 20 bp, Artificial Sequence
  Description of Artificial Sequence: Synthetic oligonucleotide
  Target: ATXN1; (+) strand; PAM type: NNNNGHTT; PAM sequence: ATATGCTT
caatgaaaaattattatgtt

SEQ ID NO: 37828 - DNA, 20 bp, Artificial Sequence
  Description of Artificial Sequence: Synthetic oligonucleotide
  Target: ATXN1; (+) strand; PAM type: NNNNGHTT; PAM sequence: GAGTGCTT
tggcagcagagggagcacaa

SEQ ID NO: 37829 - DNA, 20 bp, Artificial Sequence
  Description of Artificial Sequence: Synthetic oligonucleotide
  Target: ATXN1; (+) strand; PAM type: NNNNGHTT; PAM sequence: GACAGATT
cacaggtctctccaaatcat

SEQ ID NO: 37830 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
gacagattttacattgtagt

SEQ ID NO: 37831 - DNA, 20 bp, Artificial Sequence
  Description of Artificial Sequence: Synthetic oligonucleotide
  Target: ATXN1; (+) strand; PAM type: NNNNGHTT; PAM sequence: ATAGGCTT
aatcaactgagcaaacacag

SEQ ID NO: 37832 - DNA, 20 bp, Artificial Sequence
  Description of Artificial Sequence: Synthetic oligonucleotide
  Target: ATXN1; (+) strand; PAM type: NNNNGHTT; PAM sequence: AACAGATT
tcataacaactatgtaactg

SEQ ID NO: 37833 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
aaaataaagataaacttctt

SEQ ID NO: 37834 - DNA, 20 bp, Artificial Sequence
  Description of Artificial Sequence: Synthetic oligonucleotide
  Target: ATXN1; (+) strand; PAM type: NNNNGHTT; PAM sequence: TTAGGCTT
agataaacttctttagagtt

SEQ ID NO: 37835 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
ctcaaaagtgaaaaagatgc

SEQ ID NO: 37836 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
atcaggcaaccctaagatgc

SEQ ID NO: 37837 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
caggcaaccctaatagtagc

SEQ ID NO: 37838 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
taaggtccatgcgccttttg

SEQ ID NO: 37839 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
tttacactcagaataatttt

SEQ ID NO: 37840 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
taattttaggggtttctcct

SEQ ID NO: 37841 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
ctccttaatgcttgcagtgg

SEQ ID NO: 37842 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
atgcttgcagtggtgaggat

SEQ ID NO: 37843 - DNA, 20 bp, Artificial Sequence
  Description of Artificial Sequence: Synthetic oligonucleotide
  Target: ATXN1; (+) strand; PAM type: NNNNGHTT; PAM sequence: TCGTGCTT
caaaaagttatggaaccaca

SEQ ID NO: 37844 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
ttcataacattgagtcattt

SEQ ID NO: 37845 - DNA, 20 bp, Artificial Sequence
  Description of Artificial Sequence: Synthetic oligonucleotide
  Target: ATXN1; (+) strand; PAM type: NNNNGHTT; PAM sequence: TAGTGCTT
gagtcatttaattgtttcag

SEQ ID NO: 37846 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
taaagatccagagcattttt

SEQ ID NO: 37847 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
agagcattttttacagtttt

SEQ ID NO: 37848 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
ttcaaagttattcttagata

SEQ ID NO: 37849 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
atttttaccacgttgaaaca

SEQ ID NO: 37850 - DNA, 20 bp, Artificial Sequence
  Description of Artificial Sequence: Synthetic oligonucleotide
  Target: ATXN1; (+) strand; PAM type: NNNNGHTT; PAM sequence: GAGGGTTT
aatttttctcccacactaaa

SEQ ID NO: 37851 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
cccacactaaagagggtttg

SEQ ID NO: 37852 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
tggctgtgtaataaatccca

SEQ ID NO: 37853 - DNA, 20 bp, Artificial Sequence
  Description of Artificial Sequence: Synthetic oligonucleotide
  Target: ATXN1; (+) strand; PAM type: NNNNGHTT; PAM sequence: GTGTGCTT
aaaaatctgagcaaaccata

SEQ ID NO: 37854 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
tgcaaaacaaatatactttc

SEQ ID NO: 37855 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
ctccaccaaactgtagcaag

SEQ ID NO: 37856 - DNA, 20 bp, Artificial Sequence
  Description of Artificial Sequence: Synthetic oligonucleotide
  Target: ATXN1; (-) strand; PAM type: NRG; PAM sequence: AAG
tggcctatggcatgaacact

SEQ ID NO: 37857 - DNA, 20 bp, Artificial Sequence
  Description of Artificial Sequence: Synthetic oligonucleotide
  Target: ATXN1; (-) strand; PAM type: NRG; PAM sequence: TGG
agaaactcaagtctggccta

SEQ ID NO: 37858 - DNA, 20 bp, Artificial Sequence
  Description of Artificial Sequence: Synthetic oligonucleotide
  Target: ATXN1; (-) strand; PAM type: NRG; PAM sequence: TGG
agtatttagaaactcaagtc

SEQ ID NO: 37859 - DNA, 20 bp, Artificial Sequence
  Description of Artificial Sequence: Synthetic oligonucleotide
  Target: ATXN1; (-) strand; PAM type: NRG; PAM sequence: AAG
agaggagtatttagaaactc

SEQ ID NO: 37860 - DNA, 20 bp, Artificial Sequence
  Description of Artificial Sequence: Synthetic oligonucleotide
  Target: ATXN1; (-) strand; PAM type: NRG; PAM sequence: TAG
cacattttcagaggagtatt

SEQ ID NO: 37861 - DNA, 20 bp, Artificial Sequence
  Description of Artificial Sequence: Synthetic oligonucleotide
  Target: ATXN1; (-) strand; PAM type: NRG; PAM sequence: GAG
caacgttcacattttcagag

SEQ ID NO: 37862 - DNA, 20 bp, Artificial Sequence
  Description of Artificial Sequence: Synthetic oligonucleotide
  Target: ATXN1; (-) strand; PAM type: NRG; PAM sequence: AGG
agcaacgttcacattttcag

SEQ ID NO: 37863 - DNA, 20 bp, Artificial Sequence
  Description of Artificial Sequence: Synthetic oligonucleotide
  Target: ATXN1; (-) strand; PAM type: NRG; PAM sequence: GAG
tagcaacgttcacattttca

SEQ ID NO: 37864 - DNA, 20 bp, Artificial Sequence
  Description of Artificial Sequence: Synthetic oligonucleotide
  Target: ATXN1; (-) strand; PAM type: NRG; PAM sequence: CAG
gatagcaacgttcacatttt

SEQ ID NO: 37865 - DNA, 20 bp, Artificial Sequence
  Description of Artificial Sequence: Synthetic oligonucleotide
  Target: ATXN1; (-) strand; PAM type: NRG; PAM sequence: TAG
agaggcttccaggctttgga

SEQ ID NO: 37866 - DNA, 20 bp, Artificial Sequence
  Description of Artificial Sequence: Synthetic oligonucleotide
  Target: ATXN1; (-) strand; PAM type: NRG; PAM sequence: TGG
caccagaggcttccaggctt

SEQ ID NO: 37867 - DNA, 20 bp, Artificial Sequence
  Description of Artificial Sequence: Synthetic oligonucleotide
  Target: ATXN1; (-) strand; PAM type: NRG; PAM sequence: AGG
tcttagcaccagaggcttcc

SEQ ID NO: 37868 - DNA, 20 bp, Artificial Sequence
  Description of Artificial Sequence: Synthetic oligonucleotide
  Target: ATXN1; (-) strand; PAM type: NRG; PAM sequence: CAG
gtcttagcaccagaggcttc

SEQ ID NO: 37869 - DNA, 20 bp, Artificial Sequence
  Description of Artificial Sequence: Synthetic oligonucleotide
  Target: ATXN1; (-) strand; PAM type: NRG; PAM sequence: AGG
aagacctgtcttagcaccag

SEQ ID NO: 37870 - DNA, 20 bp, Artificial Sequence
  Description of Artificial Sequence: Synthetic oligonucleotide
  Target: ATXN1; (-) strand; PAM type: NRG; PAM sequence: GAG
caagacctgtcttagcacca

SEQ ID NO: 37871 - DNA, 20 bp, Artificial Sequence
  Description of Artificial Sequence: Synthetic oligonucleotide
  Target: ATXN1; (-) strand; PAM type: NRG; PAM sequence: CAG
accaagacctgtcttagcac

SEQ ID NO: 37872 - DNA, 20 bp, Artificial Sequence
  Description of Artificial Sequence: Synthetic oligonucleotide
  Target: ATXN1; (-) strand; PAM type: NRG; PAM sequence: TAG
aggagaaccaagacctgtct

SEQ ID NO: 37873 - DNA, 20 bp, Artificial Sequence
  Description of Artificial Sequence: Synthetic oligonucleotide
  Target: ATXN1; (-) strand; PAM type: NRG; PAM sequence: AAG
ggtggaatcagaggagaacc

SEQ ID NO: 37874 - DNA, 20 bp, Artificial Sequence
  Description of Artificial Sequence: Synthetic oligonucleotide
  Target: ATXN1; (-) strand; PAM type: NRG; PAM sequence: GAG
caagcaaggtggaatcagag

SEQ ID NO: 37875 - DNA, 20 bp, Artificial Sequence
  Description of Artificial Sequence: Synthetic oligonucleotide
  Target: ATXN1; (-) strand; PAM type: NRG; PAM sequence: AGG
tccaagcaaggtggaatcag

SEQ ID NO: 37876 - DNA, 20 bp, Artificial Sequence
  Description of Artificial Sequence: Synthetic oligonucleotide
  Target: ATXN1; (-) strand; PAM type: NRG; PAM sequence: GAG
gtccaagcaaggtggaatca

SEQ ID NO: 37877 - DNA, 20 bp, Artificial Sequence
  Description of Artificial Sequence: Synthetic oligonucleotide
  Target: ATXN1; (-) strand; PAM type: NRG; PAM sequence: CAG
gggtccaagcaaggtggaat

SEQ ID NO: 37878 - DNA, 20 bp, Artificial Sequence
  Description of Artificial Sequence: Synthetic oligonucleotide
  Target: ATXN1; (-) strand; PAM type: NRG; PAM sequence: TGG
atgtgtgggtccaagcaagg

SEQ ID NO: 37879 - DNA, 20 bp, Artificial Sequence
  Description of Artificial Sequence: Synthetic oligonucleotide
  Target: ATXN1; (-) strand; PAM type: NRG; PAM sequence: AGG
cacatgtgtgggtccaagca

SEQ ID NO: 37880 - DNA, 20 bp, Artificial Sequence
  Description of Artificial Sequence: Synthetic oligonucleotide
  Target: ATXN1; (-) strand; PAM type: NRG; PAM sequence: AAG
gcacatgtgtgggtccaagc

SEQ ID NO: 37881 - DNA, 20 bp, Artificial Sequence
  Description of Artificial Sequence: Synthetic oligonucleotide
  Target: ATXN1; (-) strand; PAM type: NRG; PAM sequence: AAG
ccctgcacatgtgtgggtcc

SEQ ID NO: 37882 - DNA, 20 bp, Artificial Sequence
  Description of Artificial Sequence: Synthetic oligonucleotide
  Target: ATXN1; (-) strand; PAM type: NRG; PAM sequence: GGG
ctatcaccctgcacatgtgt

SEQ ID NO: 37883 - DNA, 20 bp, Artificial Sequence
  Description of Artificial Sequence: Synthetic oligonucleotide
  Target: ATXN1; (-) strand; PAM type: NRG; PAM sequence: TGG
cctatcaccctgcacatgtg

SEQ ID NO: 37884 - DNA, 20 bp, Artificial Sequence
  Description of Artificial Sequence: Synthetic oligonucleotide
  Target: ATXN1; (-) strand; PAM type: NRG; PAM sequence: AGG
tcgactccctgttctcttac

SEQ ID NO: 37885 - DNA, 20 bp, Artificial Sequence
  Description of Artificial Sequence: Synthetic oligonucleotide
  Target: ATXN1; (-) strand; PAM type: NRG; PAM sequence: CAG
ttcgactccctgttctctta

SEQ ID NO: 37886 - DNA, 20 bp, Artificial Sequence
  Description of Artificial Sequence: Synthetic oligonucleotide
  Target: ATXN1; (-) strand; PAM type: NRG; PAM sequence: CAG
ctgggtacactggccacccc

SEQ ID NO: 37887 - DNA, 20 bp, Artificial Sequence
  Description of Artificial Sequence: Synthetic oligonucleotide
  Target: ATXN1; (-) strand; PAM type: NRG; PAM sequence: TGG
ttctgctttgctgggtacac

SEQ ID NO: 37888 - DNA, 20 bp, Artificial Sequence
  Description of Artificial Sequence: Synthetic oligonucleotide
  Target: ATXN1; (-) strand; PAM type: NRG; PAM sequence: GGG
gcctgtctttctgctttgct

SEQ ID NO: 37889 - DNA, 20 bp, Artificial Sequence
  Description of Artificial Sequence: Synthetic oligonucleotide
  Target: ATXN1; (-) strand; PAM type: NRG; PAM sequence: TGG
tgcctgtctttctgctttgc

SEQ ID NO: 37890 - DNA, 20 bp, Artificial Sequence
  Description of Artificial Sequence: Synthetic oligonucleotide
  Target: ATXN1; (-) strand; PAM type: NRG; PAM sequence: TAG
ttgaagtggctctgttttga

SEQ ID NO: 37891 - DNA, 20 bp, Artificial Sequence
  Description of Artificial Sequence: Synthetic oligonucleotide
  Target: ATXN1; (-) strand; PAM type: NRG; PAM sequence: TGG
gcaaggtgatttcattgaag

SEQ ID NO: 37892 - DNA, 20 bp, Artificial Sequence
  Description of Artificial Sequence: Synthetic oligonucleotide
  Target: ATXN1; (-) strand; PAM type: NRG; PAM sequence: AAG
ccagcaaggtgatttcattg

SEQ ID NO: 37893 - DNA, 20 bp, Artificial Sequence
  Description of Artificial Sequence: Synthetic oligonucleotide
  Target: ATXN1; (-) strand; PAM type: NRG; PAM sequence: AGG
ttacgtggaaatcaccagca

SEQ ID NO: 37894 - DNA, 20 bp, Artificial Sequence
  Description of Artificial Sequence: Synthetic oligonucleotide
  Target: ATXN1; (-) strand; PAM type: NRG; PAM sequence: AAG
cttacgtggaaatcaccagc

SEQ ID NO: 37895 - DNA, 20 bp, Artificial Sequence
  Description of Artificial Sequence: Synthetic oligonucleotide
  Target: ATXN1; (-) strand; PAM type: NRG; PAM sequence: CAG
ccagcttacgtggaaatcac

SEQ ID NO: 37896 - DNA, 20 bp, Artificial Sequence
  Description of Artificial Sequence: Synthetic oligonucleotide
  Target: ATXN1; (-) strand; PAM type: NRG; PAM sequence: TGG
gcaggtcctaccagcttacg

SEQ ID NO: 37897 - DNA, 20 bp, Artificial Sequence
  Description of Artificial Sequence: Synthetic oligonucleotide
  Target: ATXN1; (-) strand; PAM type: NRG; PAM sequence: CAG
atggatagcgcaggtcctac

SEQ ID NO: 37898 - DNA, 20 bp, Artificial Sequence
  Description of Artificial Sequence: Synthetic oligonucleotide
  Target: ATXN1; (-) strand; PAM type: NRG; PAM sequence: AGG
ggacataaaatggatagcgc

SEQ ID NO: 37899 - DNA, 20 bp, Artificial Sequence
  Description of Artificial Sequence: Synthetic oligonucleotide
  Target: ATXN1; (-) strand; PAM type: NRG; PAM sequence: CAG
aggacataaaatggatagcg

SEQ ID NO: 37900 - DNA, 20 bp, Artificial Sequence
  Description of Artificial Sequence: Synthetic oligonucleotide
  Target: ATXN1; (-) strand; PAM type: NRG; PAM sequence: TAG
cgaggaggacataaaatgga

SEQ ID NO: 37901 - DNA, 20 bp, Artificial Sequence
  Description of Artificial Sequence: Synthetic oligonucleotide
  Target: ATXN1; (-) strand; PAM type: NRG; PAM sequence: TGG
aggacgaggaggacataaaa

SEQ ID NO: 37902 - DNA, 20 bp, Artificial Sequence
  Description of Artificial Sequence: Synthetic oligonucleotide
  Target: ATXN1; (-) strand; PAM type: NRG; PAM sequence: AGG
gggggacgaccaggacgagg

SEQ ID NO: 37903 - DNA, 20 bp, Artificial Sequence
  Description of Artificial Sequence: Synthetic oligonucleotide
  Target: ATXN1; (-) strand; PAM type: NRG; PAM sequence: GAG
agggggacgaccaggacgag

SEQ ID NO: 37904 - DNA, 20 bp, Artificial Sequence
  Description of Artificial Sequence: Synthetic oligonucleotide
  Target: ATXN1; (-) strand; PAM type: NRG; PAM sequence: AGG
caagggggacgaccaggacg

SEQ ID NO: 37905 - DNA, 20 bp, Artificial Sequence
  Description of Artificial Sequence: Synthetic oligonucleotide
  Target: ATXN1; (-) strand; PAM type: NRG; PAM sequence: GAG
tcaagggggacgaccaggac

SEQ ID NO: 37906 - DNA, 20 bp, Artificial Sequence
  Description of Artificial Sequence: Synthetic oligonucleotide
  Target: ATXN1; (-) strand; PAM type: NRG; PAM sequence: AGG
tgtcttcaagggggacgacc

SEQ ID NO: 37907 - DNA, 20 bp, Artificial Sequence
  Description of Artificial Sequence: Synthetic oligonucleotide
  Target: ATXN1; (-) strand; PAM type: NRG; PAM sequence: CAG
gtgtcttcaagggggacgac

SEQ ID NO: 37908 - DNA, 20 bp, Artificial Sequence
  Description of Artificial Sequence: Synthetic oligonucleotide
  Target: ATXN1; (-) strand; PAM type: NRG; PAM sequence: GGG
gaaatcaagtgtcttcaagg

SEQ ID NO: 37909 - DNA, 20 bp, Artificial Sequence
  Description of Artificial Sequence: Synthetic oligonucleotide
  Target: ATXN1; (-) strand; PAM type: NRG; PAM sequence: GGG
agaaatcaagtgtcttcaag

SEQ ID NO: 37910 - DNA, 20 bp, Artificial Sequence
  Description of Artificial Sequence: Synthetic oligonucleotide
  Target: ATXN1; (-) strand; PAM type: NRG; PAM sequence: GGG
cagaaatcaagtgtcttcaa

SEQ ID NO: 37911 - DNA, 20 bp, Artificial Sequence
  Description of Artificial Sequence: Synthetic oligonucleotide
  Target: ATXN1; (-) strand; PAM type: NRG; PAM sequence: AGG
tcagaaatcaagtgtcttca

SEQ ID NO: 37912 - DNA, 20 bp, Artificial Sequence
  Description of Artificial Sequence: Synthetic oligonucleotide
  Target: ATXN1; (-) strand; PAM type: NRG; PAM sequence: AAG
atcagaaatcaagtgtcttc

SEQ ID NO: 37913 - DNA, 20 bp, Artificial Sequence
  Description of Artificial Sequence: Synthetic oligonucleotide
  Target: ATXN1; (-) strand; PAM type: NRG; PAM sequence: AAG
ctggtctaagatcagaaatc

SEQ ID NO: 37914 - DNA, 20 bp, Artificial Sequence
  Description of Artificial Sequence: Synthetic oligonucleotide
  Target: ATXN1; (-) strand; PAM type: NRG; PAM sequence: CAG
ccgcctgtctggtctaagat

SEQ ID NO: 37915 - DNA, 20 bp, Artificial Sequence
  Description of Artificial Sequence: Synthetic oligonucleotide
  Target: ATXN1; (-) strand; PAM type: NRG; PAM sequence: AAG
acctcccgcctgtctggtct

SEQ ID NO: 37916 - DNA, 20 bp, Artificial Sequence
  Description of Artificial Sequence: Synthetic oligonucleotide
  Target: ATXN1; (-) strand; PAM type: NRG; PAM sequence: TGG
agcttcacctcccgcctgtc

SEQ ID NO: 37917 - DNA, 20 bp, Artificial Sequence
  Description of Artificial Sequence: Synthetic oligonucleotide
  Target: ATXN1; (-) strand; PAM type: NRG; PAM sequence: GAG
tcaacaacaggaaaagtcca

SEQ ID NO: 37918 - DNA, 20 bp, Artificial Sequence
  Description of Artificial Sequence: Synthetic oligonucleotide
  Target: ATXN1; (-) strand; PAM type: NRG; PAM sequence: CAG
cgtcaacaacaggaaaagtc

SEQ ID NO: 37919 - DNA, 20 bp, Artificial Sequence
  Description of Artificial Sequence: Synthetic oligonucleotide
  Target: ATXN1; (-) strand; PAM type: NRG; PAM sequence: AAG
tcctacgtcaacaacaggaa

SEQ ID NO: 37920 - DNA, 20 bp, Artificial Sequence
  Description of Artificial Sequence: Synthetic oligonucleotide
  Target: ATXN1; (-) strand; PAM type: NRG; PAM sequence: AGG
tgtcctcctacgtcaacaac

SEQ ID NO: 37921 - DNA, 20 bp, Artificial Sequence
  Description of Artificial Sequence: Synthetic oligonucleotide
  Target: ATXN1; (-) strand; PAM type: NRG; PAM sequence: CAG
ctgtcctcctacgtcaacaa

SEQ ID NO: 37922 - DNA, 20 bp, Artificial Sequence
  Description of Artificial Sequence: Synthetic oligonucleotide
  Target: ATXN1; (-) strand; PAM type: NRG; PAM sequence: CAG
ggccgattcccccctggaaa

SEQ ID NO: 37923 - DNA, 20 bp, Artificial Sequence
  Description of Artificial Sequence: Synthetic oligonucleotide
  Target: ATXN1; (-) strand; PAM type: NRG; PAM sequence: TGG
ggccctggccgattcccccc

SEQ ID NO: 37924 - DNA, 20 bp, Artificial Sequence
  Description of Artificial Sequence: Synthetic oligonucleotide
  Target: ATXN1; (-) strand; PAM type: NRG; PAM sequence: TGG
aaatgcccccagaatggccc

SEQ ID NO: 37925 - DNA, 20 bp, Artificial Sequence
  Description of Artificial Sequence: Synthetic oligonucleotide
  Target: ATXN1; (-) strand; PAM type: NRG; PAM sequence: TGG
agcccaaaatgcccccagaa

SEQ ID NO: 37926 - DNA, 20 bp, Artificial Sequence
  Description of Artificial Sequence: Synthetic oligonucleotide
  Target: ATXN1; (-) strand; PAM type: NRG; PAM sequence: CAG
ccaggagcccaaaatgcccc

SEQ ID NO: 37927 - DNA, 20 bp, Artificial Sequence
  Description of Artificial Sequence: Synthetic oligonucleotide
  Target: ATXN1; (-) strand; PAM type: NRG; PAM sequence: GAG
accaacttcccaacaaccag

SEQ ID NO: 37928 - DNA, 20 bp, Artificial Sequence
  Description of Artificial Sequence: Synthetic oligonucleotide
  Target: ATXN1; (-) strand; PAM type: NRG; PAM sequence: AGG
acaccaacttcccaacaacc

SEQ ID NO: 37929 - DNA, 20 bp, Artificial Sequence
  Description of Artificial Sequence: Synthetic oligonucleotide
  Target: ATXN1; (-) strand; PAM type: NRG; PAM sequence: CAG
cacaccaacttcccaacaac

SEQ ID NO: 37930 - DNA, 20 bp, Artificial Sequence
  Description of Artificial Sequence: Synthetic oligonucleotide
  Target: ATXN1; (-) strand; PAM type: NRG; PAM sequence: CAG
gtgctcccctctgctgctaa

SEQ ID NO: 37931 - DNA, 20 bp, Artificial Sequence
  Description of Artificial Sequence: Synthetic oligonucleotide
  Target: ATXN1; (-) strand; PAM type: NRG; PAM sequence: CAG
ctgcttggtgccattctctc

SEQ ID NO: 37932 - DNA, 20 bp, Artificial Sequence
  Description of Artificial Sequence: Synthetic oligonucleotide
  Target: ATXN1; (-) strand; PAM type: NRG; PAM sequence: TGG
gggacccataacaccctgct

SEQ ID NO: 37933 - DNA, 20 bp, Artificial Sequence
  Description of Artificial Sequence: Synthetic oligonucleotide
  Target: ATXN1; (-) strand; PAM type: NRG; PAM sequence: GGG
agcagcgcttgaaggagtca

SEQ ID NO: 37934 - DNA, 20 bp, Artificial Sequence
  Description of Artificial Sequence: Synthetic oligonucleotide
  Target: ATXN1; (-) strand; PAM type: NRG; PAM sequence: AGG
gagcagcgcttgaaggagtc

SEQ ID NO: 37935 - DNA, 20 bp, Artificial Sequence
  Description of Artificial Sequence: Synthetic oligonucleotide
  Target: ATXN1; (-) strand; PAM type: NRG; PAM sequence: CAG
tgagcagcgcttgaaggagt

SEQ ID NO: 37936 - DNA, 20 bp, Artificial Sequence
  Description of Artificial Sequence: Synthetic oligonucleotide
  Target: ATXN1; (-) strand; PAM type: NRG; PAM sequence: GAG
ctggtgagcagcgcttgaag

SEQ ID NO: 37937 - DNA, 20 bp, Artificial Sequence
  Description of Artificial Sequence: Synthetic oligonucleotide
  Target: ATXN1; (-) strand; PAM type: NRG; PAM sequence: AGG
tcctggtgagcagcgcttga

SEQ ID NO: 37938 - DNA, 20 bp, Artificial Sequence
  Description of Artificial Sequence: Synthetic oligonucleotide
  Target: ATXN1; (-) strand; PAM type: NRG; PAM sequence: AAG
gtcctggtgagcagcgcttg

SEQ ID NO: 37939 - DNA, 20 bp, Artificial Sequence
  Description of Artificial Sequence: Synthetic oligonucleotide
  Target: ATXN1; (-) strand; PAM type: NRG; PAM sequence: CAG
gagaggaaagtcctggtgag

SEQ ID NO: 37940 - DNA, 20 bp, Artificial Sequence
  Description of Artificial Sequence: Synthetic oligonucleotide
  Target: ATXN1; (-) strand; PAM type: NRG; PAM sequence: GAG
gcggagaggaaagtcctggt

SEQ ID NO: 37941 - DNA, 20 bp, Artificial Sequence
  Description of Artificial Sequence: Synthetic oligonucleotide
  Target: ATXN1; (-) strand; PAM type: NRG; PAM sequence: TGG
tgttgcggagaggaaagtcc

SEQ ID NO: 37942 - DNA, 20 bp, Artificial Sequence
  Description of Artificial Sequence: Synthetic oligonucleotide
  Target: ATXN1; (-) strand; PAM type: NRG; PAM sequence: AAG
cctgcatgttgcggagagga

SEQ ID NO: 37943 - DNA, 20 bp, Artificial Sequence
  Description of Artificial Sequence: Synthetic oligonucleotide
  Target: ATXN1; (-) strand; PAM type: NRG; PAM sequence: AGG
ctgccctgcatgttgcggag

SEQ ID NO: 37944 - DNA, 20 bp, Artificial Sequence
  Description of Artificial Sequence: Synthetic oligonucleotide
  Target: ATXN1; (-) strand; PAM type: NRG; PAM sequence: GAG
gctgccctgcatgttgcgga

SEQ ID NO: 37945 - DNA, 20 bp, Artificial Sequence
  Description of Artificial Sequence: Synthetic oligonucleotide
  Target: ATXN1; (-) strand; PAM type: NRG; PAM sequence: GAG
tggctgccctgcatgttgcg

SEQ ID NO: 37946 - DNA, 20 bp, Artificial Sequence
  Description of Artificial Sequence: Synthetic oligonucleotide
  Target: ATXN1; (-) strand; PAM type: NRG; PAM sequence: CGG
gctggctgccctgcatgttg

SEQ ID NO: 37947 - DNA, 20 bp, Artificial Sequence
  Description of Artificial Sequence: Synthetic oligonucleotide
  Target: ATXN1; (-) strand; PAM type: NRG; PAM sequence: TGG
aaagggcacgggctcattgc

SEQ ID NO: 37948 - DNA, 20 bp, Artificial Sequence
  Description of Artificial Sequence: Synthetic oligonucleotide
  Target: ATXN1; (-) strand; PAM type: NRG; PAM sequence: GGG
tcctcccgcccaaagggcac

SEQ ID NO: 37949 - DNA, 20 bp, Artificial Sequence
  Description of Artificial Sequence: Synthetic oligonucleotide
  Target: ATXN1; (-) strand; PAM type: NRG; PAM sequence: CGG
ttcctcccgcccaaagggca

SEQ ID NO: 37950 - DNA, 20 bp, Artificial Sequence
  Description of Artificial Sequence: Synthetic oligonucleotide
  Target: ATXN1; (-) strand; PAM type: NRG; PAM sequence: GGG
acacattcctcccgcccaaa

SEQ ID NO: 37951 - DNA, 20 bp, Artificial Sequence
  Description of Artificial Sequence: Synthetic oligonucleotide
  Target: ATXN1; (-) strand; PAM type: NRG; PAM sequence: AGG
aacacattcctcccgcccaa

SEQ ID NO: 37952 - DNA, 20 bp, Artificial Sequence
  Description of Artificial Sequence: Synthetic oligonucleotide
  Target: ATXN1; (-) strand; PAM type: NRG; PAM sequence: AAG
gaacacattcctcccgccca

SEQ ID NO: 37953 - DNA, 20 bp, Artificial Sequence
  Description of Artificial Sequence: Synthetic oligonucleotide
  Target: ATXN1; (-) strand; PAM type: NRG; PAM sequence: CAG
caagatgatcaccagcatct

SEQ ID NO: 37954 - DNA, 20 bp, Artificial Sequence
  Description of Artificial Sequence: Synthetic oligonucleotide
  Target: ATXN1; (-) strand; PAM type: NRG; PAM sequence: CAG
ccaagtgccaagatgatcac

SEQ ID NO: 37955 - DNA, 20 bp, Artificial Sequence
  Description of Artificial Sequence: Synthetic oligonucleotide
  Target: ATXN1; (-) strand; PAM type: NRG; PAM sequence: AAG
ccacatttctaccaagtgcc

SEQ ID NO: 37956 - DNA, 20 bp, Artificial Sequence
  Description of Artificial Sequence: Synthetic oligonucleotide
  Target: ATXN1; (-) strand; PAM type: NRG; PAM sequence: AAG
cccatccccacatttctacc

SEQ ID NO: 37957 - DNA, 20 bp, Artificial Sequence
  Description of Artificial Sequence: Synthetic oligonucleotide
  Target: ATXN1; (-) strand; PAM type: NRG; PAM sequence: CAG
ccccaaggcactcagaaaac

SEQ ID NO: 37958 - DNA, 20 bp, Artificial Sequence
  Description of Artificial Sequence: Synthetic oligonucleotide
  Target: ATXN1; (-) strand; PAM type: NRG; PAM sequence: CAG
tctgtagcccccaaggcact

SEQ ID NO: 37959 - DNA, 20 bp, Artificial Sequence
  Description of Artificial Sequence: Synthetic oligonucleotide
  Target: ATXN1; (-) strand; PAM type: NRG; PAM sequence: AGG
agcactttctgtagccccca

SEQ ID NO: 37960 - DNA, 20 bp, Artificial Sequence
  Description of Artificial Sequence: Synthetic oligonucleotide
  Target: ATXN1; (-) strand; PAM type: NRG; PAM sequence: AAG
cagcactttctgtagccccc

SEQ ID NO: 37961 - DNA, 20 bp, Artificial Sequence
  Description of Artificial Sequence: Synthetic oligonucleotide
  Target: ATXN1; (-) strand; PAM type: NRG; PAM sequence: TAG
cccagctccagcactttctg

SEQ ID NO: 37962 - DNA, 20 bp, Artificial Sequence
  Description of Artificial Sequence: Synthetic oligonucleotide
  Target: ATXN1; (-) strand; PAM type: NRG; PAM sequence: CAG
attagaattactcccagctc

SEQ ID NO: 37963 - DNA, 20 bp, Artificial Sequence
  Description of Artificial Sequence: Synthetic oligonucleotide
  Target: ATXN1; (-) strand; PAM type: NRG; PAM sequence: CAG
agcccaattagaattactcc

SEQ ID NO: 37964 - DNA, 20 bp, Artificial Sequence
  Description of Artificial Sequence: Synthetic oligonucleotide
  Target: ATXN1; (-) strand; PAM type: NRG; PAM sequence: TAG
ccccaccttaagagcccaat

SEQ ID NO: 37965 - DNA, 20 bp, Artificial Sequence
  Description of Artificial Sequence: Synthetic oligonucleotide
  Target: ATXN1; (-) strand; PAM type: NRG; PAM sequence: GAG
agtttcccgccccaccttaa

SEQ ID NO: 37966 - DNA, 20 bp, Artificial Sequence
  Description of Artificial Sequence: Synthetic oligonucleotide
  Target: ATXN1; (-) strand; PAM type: NRG; PAM sequence: AAG
ctagtttcccgccccacctt

SEQ ID NO: 37967 - DNA, 20 bp, Artificial Sequence
  Description of Artificial Sequence: Synthetic oligonucleotide
  Target: ATXN1; (-) strand; PAM type: NRG; PAM sequence: TAG
atagaagttttctttttatc

SEQ ID NO: 37968 - DNA, 20 bp, Artificial Sequence
  Description of Artificial Sequence: Synthetic oligonucleotide
  Target: ATXN1; (-) strand; PAM type: NRG; PAM sequence: AAG
gaggctctggaagacgatag

SEQ ID NO: 37969 - DNA, 20 bp, Artificial Sequence
  Description of Artificial Sequence: Synthetic oligonucleotide
  Target: ATXN1; (-) strand; PAM type: NRG; PAM sequence: TAG
tcagaggctctggaagacga

SEQ ID NO: 37970 - DNA, 20 bp, Artificial Sequence
  Description of Artificial Sequence: Synthetic oligonucleotide
  Target: ATXN1; (-) strand; PAM type: NRG; PAM sequence: AAG
cttaccctcagaggctctgg

SEQ ID NO: 37971 - DNA, 20 bp, Artificial Sequence
  Description of Artificial Sequence: Synthetic oligonucleotide
  Target: ATXN1; (-) strand; PAM type: NRG; PAM sequence: TGG
agtcttaccctcagaggctc

SEQ ID NO: 37972 - DNA, 20 bp, Artificial Sequence
  Description of Artificial Sequence: Synthetic oligonucleotide
  Target: ATXN1; (-) strand; PAM type: NRG; PAM sequence: AGG
ttccacagtcttaccctcag

SEQ ID NO: 37973 - DNA, 20 bp, Artificial Sequence
  Description of Artificial Sequence: Synthetic oligonucleotide
  Target: ATXN1; (-) strand; PAM type: NRG; PAM sequence: GAG
cttccacagtcttaccctca

SEQ ID NO: 37974 - DNA, 20 bp, Artificial Sequence
  Description of Artificial Sequence: Synthetic oligonucleotide
  Target: ATXN1; (-) strand; PAM type: NRG; PAM sequence: CAG
aacttccacagtcttaccct

SEQ ID NO: 37975 - DNA, 20 bp, Artificial Sequence
  Description of Artificial Sequence: Synthetic oligonucleotide
  Target: ATXN1; (-) strand; PAM type: NRG; PAM sequence: CAG
tcctttgtaaggaacttcca

SEQ ID NO: 37976 - DNA, 20 bp, Artificial Sequence
  Description of Artificial Sequence: Synthetic oligonucleotide
  Target: ATXN1; (-) strand; PAM type: NRG; PAM sequence: AGG
ttttccacatctcctttgta

SEQ ID NO: 37977 - DNA, 20 bp, Artificial Sequence
  Description of Artificial Sequence: Synthetic oligonucleotide
  Target: ATXN1; (-) strand; PAM type: NRG; PAM sequence: AAG
gttttccacatctcctttgt

SEQ ID NO: 37978 - DNA, 20 bp, Artificial Sequence
  Description of Artificial Sequence: Synthetic oligonucleotide
  Target: ATXN1; (-) strand; PAM type: NRG; PAM sequence: TAG
tcccccgagaatatccagga

SEQ ID NO: 37979 - DNA, 20 bp, Artificial Sequence
  Description of Artificial Sequence: Synthetic oligonucleotide
  Target: ATXN1; (-) strand; PAM type: NRG; PAM sequence: AGG
tcagtcccccgagaatatcc

SEQ ID NO: 37980 - DNA, 20 bp, Artificial Sequence
  Description of Artificial Sequence: Synthetic oligonucleotide
  Target: ATXN1; (-) strand; PAM type: NRG; PAM sequence: CAG
ctcagtcccccgagaatatc

SEQ ID NO: 37981 - DNA, 20 bp, Artificial Sequence
  Description of Artificial Sequence: Synthetic oligonucleotide
  Target: ATXN1; (-) strand; PAM type: NRG; PAM sequence: GAG
cacgtggacctcagtccccc

SEQ ID NO: 37982 - DNA, 20 bp, Artificial Sequence
  Description of Artificial Sequence: Synthetic oligonucleotide
  Target: ATXN1; (-) strand; PAM type: NRG; PAM sequence: CAG
acgtaggtgcacgtggacct

SEQ ID NO: 37983 - DNA, 20 bp, Artificial Sequence
  Description of Artificial Sequence: Synthetic oligonucleotide
  Target: ATXN1; (-) strand; PAM type: NRG; PAM sequence: TGG
ggcccccacgtaggtgcacg

SEQ ID NO: 37984 - DNA, 20 bp, Artificial Sequence
  Description of Artificial Sequence: Synthetic oligonucleotide
  Target: ATXN1; (-) strand; PAM type: NRG; PAM sequence: AGG
gagtttggcggcccccacgt

SEQ ID NO: 37985 - DNA, 20 bp, Artificial Sequence
  Description of Artificial Sequence: Synthetic oligonucleotide
  Target: ATXN1; (-) strand; PAM type: NRG; PAM sequence: TAG
tgagtttggcggcccccacg

SEQ ID NO: 37986 - DNA, 20 bp, Artificial Sequence
  Description of Artificial Sequence: Synthetic oligonucleotide
  Target: ATXN1; (-) strand; PAM type: NRG; PAM sequence: CGG
gctgagctccttgagtttgg

SEQ ID NO: 37987 - DNA, 20 bp, Artificial Sequence
  Description of Artificial Sequence: Synthetic oligonucleotide
  Target: ATXN1; (-) strand; PAM type: NRG; PAM sequence: TGG
cctgctgagctccttgagtt

SEQ ID NO: 37988 - DNA, 20 bp, Artificial Sequence
  Description of Artificial Sequence: Synthetic oligonucleotide
  Target: ATXN1; (-) strand; PAM type: NRG; PAM sequence: GAG
gccctcctgctgagctcctt

SEQ ID NO: 37989 - DNA, 20 bp, Artificial Sequence
  Description of Artificial Sequence: Synthetic oligonucleotide
  Target: ATXN1; (-) strand; PAM type: NRG; PAM sequence: GAG
atgaatgttgccctcctgct

SEQ ID NO: 37990 - DNA, 20 bp, Artificial Sequence
  Description of Artificial Sequence: Synthetic oligonucleotide
  Target: ATXN1; (-) strand; PAM type: NRG; PAM sequence: CGG
tgttgtgctgctgggtcacc

SEQ ID NO: 37991 - DNA, 20 bp, Artificial Sequence
  Description of Artificial Sequence: Synthetic oligonucleotide
  Target: ATXN1; (-) strand; PAM type: NRG; PAM sequence: GGG
gaacacggtgttgtgctgct

SEQ ID NO: 37992 - DNA, 20 bp, Artificial Sequence
  Description of Artificial Sequence: Synthetic oligonucleotide
  Target: ATXN1; (-) strand; PAM type: NRG; PAM sequence: TGG
tgaacacggtgttgtgctgc

SEQ ID NO: 37993 - DNA, 20 bp, Artificial Sequence
  Description of Artificial Sequence: Synthetic oligonucleotide
  Target: ATXN1; (-) strand; PAM type: NRG; PAM sequence: CGG
tccccagggttagctgaaca

SEQ ID NO: 37994 - DNA, 20 bp, Artificial Sequence
  Description of Artificial Sequence: Synthetic oligonucleotide
  Target: ATXN1; (-) strand; PAM type: NRG; PAM sequence: TAG
cgctgctttgtccccagggt

SEQ ID NO: 37995 - DNA, 20 bp, Artificial Sequence
  Description of Artificial Sequence: Synthetic oligonucleotide
  Target: ATXN1; (-) strand; PAM type: NRG; PAM sequence: GGG
cagacgctgctttgtcccca

SEQ ID NO: 37996 - DNA, 20 bp, Artificial Sequence
  Description of Artificial Sequence: Synthetic oligonucleotide
  Target: ATXN1; (-) strand; PAM type: NRG; PAM sequence: AGG
ccagacgctgctttgtcccc

SEQ ID NO: 37997 - DNA, 20 bp, Artificial Sequence
  Description of Artificial Sequence: Synthetic oligonucleotide
  Target: ATXN1; (-) strand; PAM type: NRG; PAM sequence: CAG
gccagacgctgctttgtccc

SEQ ID NO: 37998 - DNA, 20 bp, Artificial Sequence
  Description of Artificial Sequence: Synthetic oligonucleotide
  Target: ATXN1; (-) strand; PAM type: NRG; PAM sequence: CAG
ttggacgcttccactcgagc

SEQ ID NO: 37999 - DNA, 20 bp, Artificial Sequence
  Description of Artificial Sequence: Synthetic oligonucleotide
  Target: ATXN1; (-) strand; PAM type: NRG; PAM sequence: GAG
aggtttggacgcttccactc

SEQ ID NO: 38000 - DNA, 20 bp, Artificial Sequence
  Description of Artificial Sequence: Synthetic oligonucleotide
  Target: ATXN1; (-) strand; PAM type: NRG; PAM sequence: TGG
ggagatgggaaaagcaggtt

SEQ ID NO: 38001 - DNA, 20 bp, Artificial Sequence
  Description of Artificial Sequence: Synthetic oligonucleotide
  Target: ATXN1; (-) strand; PAM type: NRG; PAM sequence: AGG
tggggggagatgggaaaagc

SEQ ID NO: 38002 - DNA, 20 bp, Artificial Sequence
  Description of Artificial Sequence: Synthetic oligonucleotide
  Target: ATXN1; (-) strand; PAM type: NRG; PAM sequence: CAG
ttggggggagatgggaaaag

SEQ ID NO: 38003 - DNA, 20 bp, Artificial Sequence
  Description of Artificial Sequence: Synthetic oligonucleotide
  Target: ATXN1; (-) strand; PAM type: NRG; PAM sequence: AAG
gacttggggggagatgggaa

SEQ ID NO: 38004 - DNA, 20 bp, Artificial Sequence
  Description of Artificial Sequence: Synthetic oligonucleotide
  Target: ATXN1; (-) strand; PAM type: NRG; PAM sequence: GGG
gaacagacttggggggagat

SEQ ID NO: 38005 - DNA, 20 bp, Artificial Sequence
  Description of Artificial Sequence: Synthetic oligonucleotide
  Target: ATXN1; (-) strand; PAM type: NRG; PAM sequence: TGG
ggaacagacttggggggaga

SEQ ID NO: 38006 - DNA, 20 bp, Artificial Sequence
  Description of Artificial Sequence: Synthetic oligonucleotide
  Target: ATXN1; (-) strand; PAM type: NRG; PAM sequence: GAG
tgacggaacagacttggggg

SEQ ID NO: 38007 - DNA, 20 bp, Artificial Sequence
  Description of Artificial Sequence: Synthetic oligonucleotide
  Target: ATXN1; (-) strand; PAM type: NRG; PAM sequence: GGG
tctgacggaacagacttggg

SEQ ID NO: 38008 - DNA, 20 bp, Artificial Sequence
  Description of Artificial Sequence: Synthetic oligonucleotide
  Target: ATXN1; (-) strand; PAM type: NRG; PAM sequence: GGG
ctctgacggaacagacttgg

SEQ ID NO: 38009 - DNA, 20 bp, Artificial Sequence
  Description of Artificial Sequence: Synthetic oligonucleotide
  Target: ATXN1; (-) strand; PAM type: NRG; PAM sequence: GGG
gctctgacggaacagacttg

SEQ ID NO: 38010 - DNA, 20 bp, Artificial Sequence
  Description of Artificial Sequence: Synthetic oligonucleotide
  Target: ATXN1; (-) strand; PAM type: NRG; PAM sequence: GGG
agctctgacggaacagactt

SEQ ID NO: 38011 - DNA, 20 bp, Artificial Sequence
  Description of Artificial Sequence: Synthetic oligonucleotide
  Target: ATXN1; (-) strand; PAM type: NRG; PAM sequence: TGG
aagctctgacggaacagact

SEQ ID NO: 38012 - DNA, 20 bp, Artificial Sequence
  Description of Artificial Sequence: Synthetic oligonucleotide
  Target: ATXN1; (-) strand; PAM type: NRG; PAM sequence: CAG
agccagaagctctgacggaa

SEQ ID NO: 38013 - DNA, 20 bp, Artificial Sequence
  Description of Artificial Sequence: Synthetic oligonucleotide
  Target: ATXN1; (-) strand; PAM type: NRG; PAM sequence: CGG
ggagcagccagaagctctga

SEQ ID NO: 38014 - DNA, 20 bp, Artificial Sequence
  Description of Artificial Sequence: Synthetic oligonucleotide
  Target: ATXN1; (-) strand; PAM type: NRG; PAM sequence: AAG
caccattcaggagcagccag

SEQ ID NO: 38015 - DNA, 20 bp, Artificial Sequence
  Description of Artificial Sequence: Synthetic oligonucleotide
  Target: ATXN1; (-) strand; PAM type: NRG; PAM sequence: CAG
ttccaccattcaggagcagc

SEQ ID NO: 38016 - DNA, 20 bp, Artificial Sequence
  Description of Artificial Sequence: Synthetic oligonucleotide
  Target: ATXN1; (-) strand; PAM type: NRG; PAM sequence: CAG
agcattccaccattcaggag

SEQ ID NO: 38017 - DNA, 20 bp, Artificial Sequence
  Description of Artificial Sequence: Synthetic oligonucleotide
  Target: ATXN1; (-) strand; PAM type: NRG; PAM sequence: GAG
cacagcattccaccattcag

SEQ ID NO: 38018 - DNA, 20 bp, Artificial Sequence
  Description of Artificial Sequence: Synthetic oligonucleotide
  Target: ATXN1; (-) strand; PAM type: NRG; PAM sequence: AGG
gacacagcattccaccattc

SEQ ID NO: 38019 - DNA, 20 bp, Artificial Sequence
  Description of Artificial Sequence: Synthetic oligonucleotide
  Target: ATXN1; (-) strand; PAM type: NRG; PAM sequence: CAG
ggacacagcattccaccatt

SEQ ID NO: 38020 - DNA, 20 bp, Artificial Sequence
  Description of Artificial Sequence: Synthetic oligonucleotide
  Target: ATXN1; (-) strand; PAM type: NRG; PAM sequence: CAG
aggagacagaagagaggaca

SEQ ID NO: 38021 - DNA, 20 bp, Artificial Sequence
  Description of Artificial Sequence: Synthetic oligonucleotide
  Target: ATXN1; (-) strand; PAM type: NRG; PAM sequence: AGG
ggcagcaggagacagaagag

SEQ ID NO: 38022 - DNA, 20 bp, Artificial Sequence
  Description of Artificial Sequence: Synthetic oligonucleotide
  Target: ATXN1; (-) strand; PAM type: NRG; PAM sequence: GAG
aggcagcaggagacagaaga

SEQ ID NO: 38023 - DNA, 20 bp, Artificial Sequence
  Description of Artificial Sequence: Synthetic oligonucleotide
  Target: ATXN1; (-) strand; PAM type: NRG; PAM sequence: GAG
ccaggcagcaggagacagaa

SEQ ID NO: 38024 - DNA, 20 bp, Artificial Sequence
  Description of Artificial Sequence: Synthetic oligonucleotide
  Target: ATXN1; (-) strand; PAM type: NRG; PAM sequence: AAG
ctccaggcagcaggagacag

SEQ ID NO: 38025 - DNA, 20 bp, Artificial Sequence
  Description of Artificial Sequence: Synthetic oligonucleotide
  Target: ATXN1; (-) strand; PAM type: NRG; PAM sequence: CAG
agcctccaggcagcaggaga

SEQ ID NO: 38026 - DNA, 20 bp, Artificial Sequence
  Description of Artificial Sequence: Synthetic oligonucleotide
  Target: ATXN1; (-) strand; PAM type: NRG; PAM sequence: GAG
ccgaagcctccaggcagcag

SEQ ID NO: 38027 - DNA, 20 bp, Artificial Sequence
  Description of Artificial Sequence: Synthetic oligonucleotide
  Target: ATXN1; (-) strand; PAM type: NRG; PAM sequence: AGG
ccccgaagcctccaggcagc

SEQ ID NO: 38028 - DNA, 20 bp, Artificial Sequence
  Description of Artificial Sequence: Synthetic oligonucleotide
  Target: ATXN1; (-) strand; PAM type: NRG; PAM sequence: CAG
gccccgaagcctccaggcag

SEQ ID NO: 38029 - DNA, 20 bp, Artificial Sequence
  Description of Artificial Sequence: Synthetic oligonucleotide
  Target: ATXN1; (-) strand; PAM type: NRG; PAM sequence: CAG
agagccccgaagcctccagg

SEQ ID NO: 38030 - DNA, 20 bp, Artificial Sequence
  Description of Artificial Sequence: Synthetic oligonucleotide
  Target: ATXN1; (-) strand; PAM type: NRG; PAM sequence: AGG
gggagagccccgaagcctcc

SEQ ID NO: 38031 - DNA, 20 bp, Artificial Sequence
  Description of Artificial Sequence: Synthetic oligonucleotide
  Target: ATXN1; (-) strand; PAM type: NRG; PAM sequence: CAG
cgggagagccccgaagcctc

SEQ ID NO: 38032 - DNA, 20 bp, Artificial Sequence
  Description of Artificial Sequence: Synthetic oligonucleotide
  Target: ATXN1; (-) strand; PAM type: NRG; PAM sequence: AAG
aggcaggcgggagagccccg

SEQ ID NO: 38033 - DNA, 20 bp, Artificial Sequence
  Description of Artificial Sequence: Synthetic oligonucleotide
  Target: ATXN1; (-) strand; PAM type: NRG; PAM sequence: GAG
ccccgagaaggcaggcggga

SEQ ID NO: 38034 - DNA, 20 bp, Artificial Sequence
  Description of Artificial Sequence: Synthetic oligonucleotide
  Target: ATXN1; (-) strand; PAM type: NRG; PAM sequence: GAG
ggccccgagaaggcaggcgg

SEQ ID NO: 38035 - DNA, 20 bp, Artificial Sequence
  Description of Artificial Sequence: Synthetic oligonucleotide
  Target: ATXN1; (-) strand; PAM type: NRG; PAM sequence: GGG
tgggccccgagaaggcaggc

SEQ ID NO: 38036 - DNA, 20 bp, Artificial Sequence
  Description of Artificial Sequence: Synthetic oligonucleotide
  Target: ATXN1; (-) strand; PAM type: NRG; PAM sequence: CGG
ctgggccccgagaaggcagg

SEQ ID NO: 38037 - DNA, 20 bp, Artificial Sequence
  Description of Artificial Sequence: Synthetic oligonucleotide
  Target: ATXN1; (-) strand; PAM type: NRG; PAM sequence: AGG
cgtctgggccccgagaaggc

SEQ ID NO: 38038 - DNA, 20 bp, Artificial Sequence
  Description of Artificial Sequence: Synthetic oligonucleotide
  Target: ATXN1; (-) strand; PAM type: NRG; PAM sequence: CAG
gcgtctgggccccgagaagg

SEQ ID NO: 38039 - DNA, 20 bp, Artificial Sequence
  Description of Artificial Sequence: Synthetic oligonucleotide
  Target: ATXN1; (-) strand; PAM type: NRG; PAM sequence: AGG
cttgcgtctgggccccgaga

SEQ ID NO: 38040 - DNA, 20 bp, Artificial Sequence
  Description of Artificial Sequence: Synthetic oligonucleotide
  Target: ATXN1; (-) strand; PAM type: NRG; PAM sequence: AAG
ccttgcgtctgggccccgag

SEQ ID NO: 38041 - DNA, 20 bp, Artificial Sequence
  Description of Artificial Sequence: Synthetic oligonucleotide
  Target: ATXN1; (-) strand; PAM type: NRG; PAM sequence: GAG
gtgccttgcgtctgggcccc

SEQ ID NO: 38042 - DNA, 20 bp, Artificial Sequence
  Description of Artificial Sequence: Synthetic oligonucleotide
  Target: ATXN1; (-) strand; PAM type: NRG; PAM sequence: GGG
ccaatcggtgccttgcgtct

SEQ ID NO: 38043 - DNA, 20 bp, Artificial Sequence
  Description of Artificial Sequence: Synthetic oligonucleotide
  Target: ATXN1; (-) strand; PAM type: NRG; PAM sequence: TGG
cccaatcggtgccttgcgtc

SEQ ID NO: 38044 - DNA, 20 bp, Artificial Sequence
  Description of Artificial Sequence: Synthetic oligonucleotide
  Target: ATXN1; (-) strand; PAM type: NRG; PAM sequence: CGG
ggctctgatgttggcccaat

SEQ ID NO: 38045 - DNA, 20 bp, Artificial Sequence
  Description of Artificial Sequence: Synthetic oligonucleotide
  Target: ATXN1; (-) strand; PAM type: NRG; PAM sequence: TGG
gggcagcagggctctgatgt

SEQ ID NO: 38046 - DNA, 20 bp, Artificial Sequence
  Description of Artificial Sequence: Synthetic oligonucleotide
  Target: ATXN1; (-) strand; PAM type: NRG; PAM sequence: GGG
gttatgagttctgggcagca

SEQ ID NO: 38047 - DNA, 20 bp, Artificial Sequence
  Description of Artificial Sequence: Synthetic oligonucleotide
  Target: ATXN1; (-) strand; PAM type: NRG; PAM sequence: AGG
ggttatgagttctgggcagc

SEQ ID NO: 38048 - DNA, 20 bp, Artificial Sequence
  Description of Artificial Sequence: Synthetic oligonucleotide
  Target: ATXN1; (-) strand; PAM type: NRG; PAM sequence: CAG
aggttatgagttctgggcag

SEQ ID NO: 38049 - DNA, 20 bp, Artificial Sequence
  Description of Artificial Sequence: Synthetic oligonucleotide
  Target: ATXN1; (-) strand; PAM type: NRG; PAM sequence: CAG
atgaggttatgagttctggg

SEQ ID NO: 38050 - DNA, 20 bp, Artificial Sequence
  Description of Artificial Sequence: Synthetic oligonucleotide
  Target: ATXN1; (-) strand; PAM type: NRG; PAM sequence: GGG
acaatgaggttatgagttct

SEQ ID NO: 38051 - DNA, 20 bp, Artificial Sequence
  Description of Artificial Sequence: Synthetic oligonucleotide
  Target: ATXN1; (-) strand; PAM type: NRG; PAM sequence: TGG
aacaatgaggttatgagttc

SEQ ID NO: 38052 - DNA, 20 bp, Artificial Sequence
  Description of Artificial Sequence: Synthetic oligonucleotide
  Target: ATXN1; (-) strand; PAM type: NRG; PAM sequence: GAG
ggtttgaacaatgaggttat

SEQ ID NO: 38053 - DNA, 20 bp, Artificial Sequence
  Description of Artificial Sequence: Synthetic oligonucleotide
  Target: ATXN1; (-) strand; PAM type: NRG; PAM sequence: AGG
aagtgttggtttgaacaatg

SEQ ID NO: 38054 - DNA, 20 bp, Artificial Sequence
  Description of Artificial Sequence: Synthetic oligonucleotide
  Target: ATXN1; (-) strand; PAM type: NRG; PAM sequence: GAG
caagtgttggtttgaacaat

SEQ ID NO: 38055 - DNA, 20 bp, Artificial Sequence
  Description of Artificial Sequence: Synthetic oligonucleotide
  Target: ATXN1; (-) strand; PAM type: NRG; PAM sequence: TGG
aaagagaaaggtgcaagtgt

SEQ ID NO: 38056 - DNA, 20 bp, Artificial Sequence
  Description of Artificial Sequence: Synthetic oligonucleotide
  Target: ATXN1; (-) strand; PAM type: NRG; PAM sequence: AAG
agagaaaaagagaaaggtgc

SEQ ID NO: 38057 - DNA, 20 bp, Artificial Sequence
  Description of Artificial Sequence: Synthetic oligonucleotide
  Target: ATXN1; (-) strand; PAM type: NRG; PAM sequence: AGG
agagaaagagaaaaagagaa

SEQ ID NO: 38058 - DNA, 20 bp, Artificial Sequence
  Description of Artificial Sequence: Synthetic oligonucleotide
  Target: ATXN1; (-) strand; PAM type: NRG; PAM sequence: AAG
gagagaaagagaaaaagaga

SEQ ID NO: 38059 - DNA, 20 bp, Artificial Sequence
  Description of Artificial Sequence: Synthetic oligonucleotide
  Target: ATXN1; (-) strand; PAM type: NRG; PAM sequence: GAG
gggagagagaaagagaaaaa

SEQ ID NO: 38060 - DNA, 20 bp, Artificial Sequence
  Description of Artificial Sequence: Synthetic oligonucleotide
  Target: ATXN1; (-) strand; PAM type: NRG; PAM sequence: AAG
aagggagagagaaagagaaa

SEQ ID NO: 38061 - DNA, 20 bp, Artificial Sequence
  Description of Artificial Sequence: Synthetic oligonucleotide
  Target: ATXN1; (-) strand; PAM type: NRG; PAM sequence: GAG
caaagaaagggagagagaaa

SEQ ID NO: 38062 - DNA, 20 bp, Artificial Sequence
  Description of Artificial Sequence: Synthetic oligonucleotide
  Target: ATXN1; (-) strand; PAM type: NRG; PAM sequence: AAG
aacaaagaaagggagagaga

SEQ ID NO: 38063 - DNA, 20 bp, Artificial Sequence
  Description of Artificial Sequence: Synthetic oligonucleotide
  Target: ATXN1; (-) strand; PAM type: NRG; PAM sequence: GAG
gaaaaacaaagaaagggaga

SEQ ID NO: 38064 - DNA, 20 bp, Artificial Sequence
  Description of Artificial Sequence: Synthetic oligonucleotide
  Target: ATXN1; (-) strand; PAM type: NRG; PAM sequence: GAG
aagaaaaacaaagaaaggga

SEQ ID NO: 38065 - DNA, 20 bp, Artificial Sequence
  Description of Artificial Sequence: Synthetic oligonucleotide
  Target: ATXN1; (-) strand; PAM type: NRG; PAM sequence: GAG
gaaagaaaaacaaagaaagg

SEQ ID NO: 38066 - DNA, 20 bp, Artificial Sequence
  Description of Artificial Sequence: Synthetic oligonucleotide
  Target: ATXN1; (-) strand; PAM type: NRG; PAM sequence: GGG
aagaaagaaaaacaaagaaa

SEQ ID NO: 38067 - DNA, 20 bp, Artificial Sequence
  Description of Artificial Sequence: Synthetic oligonucleotide
  Target: ATXN1; (-) strand; PAM type: NRG; PAM sequence: AGG
aaagaaagaaaaacaaagaa

SEQ ID NO: 38068 - DNA, 20 bp, Artificial Sequence
  Description of Artificial Sequence: Synthetic oligonucleotide
  Target: ATXN1; (-) strand; PAM type: NRG; PAM sequence: AAG
aaaagaaagaaaaacaaaga

SEQ ID NO: 38069 - DNA, 20 bp, Artificial Sequence
  Description of Artificial Sequence: Synthetic oligonucleotide
  Target: ATXN1; (-) strand; PAM type: NRG; PAM sequence: AAG
ttaaaaaagaaagaaaaaca

SEQ ID NO: 38070 - DNA, 20 bp, Artificial Sequence
  Description of Artificial Sequence: Synthetic oligonucleotide
  Target: ATXN1; (-) strand; PAM type: NRG; PAM sequence: AAG
ccatcttcttttaaaaaaga

SEQ ID NO: 38071 - DNA, 20 bp, Artificial Sequence
  Description of Artificial Sequence: Synthetic oligonucleotide
  Target: ATXN1; (-) strand; PAM type: NRG; PAM sequence: AAG
gaaaccatcttcttttaaaa

SEQ ID NO: 38072 - DNA, 20 bp, Artificial Sequence
  Description of Artificial Sequence: Synthetic oligonucleotide
  Target: ATXN1; (-) strand; PAM type: NRG; PAM sequence: AAG
aagataatagcattatatta

SEQ ID NO: 38073 - DNA, 20 bp, Artificial Sequence
  Description of Artificial Sequence: Synthetic oligonucleotide
  Target: ATXN1; (-) strand; PAM type: NRG; PAM sequence: TAG
tccattaagtcttaagataa

SEQ ID NO: 38074 - DNA, 20 bp, Artificial Sequence
  Description of Artificial Sequence: Synthetic oligonucleotide
  Target: ATXN1; (-) strand; PAM type: NRG; PAM sequence: AAG
cagcaactccattaagtctt

SEQ ID NO: 38075 - DNA, 20 bp, Artificial Sequence
  Description of Artificial Sequence: Synthetic oligonucleotide
  Target: ATXN1; (-) strand; PAM type: NRG; PAM sequence: AAG
caaactccagcaactccatt

SEQ ID NO: 38076 - DNA, 20 bp, Artificial Sequence
  Description of Artificial Sequence: Synthetic oligonucleotide
  Target: ATXN1; (-) strand; PAM type: NRG; PAM sequence: CAG
actcctggaaatacaaactc

SEQ ID NO: 38077 - DNA, 20 bp, Artificial Sequence
  Description of Artificial Sequence: Synthetic oligonucleotide
  Target: ATXN1; (-) strand; PAM type: NRG; PAM sequence: TGG
aaaccattcaacttgactcc

SEQ ID NO: 38078 - DNA, 20 bp, Artificial Sequence
  Description of Artificial Sequence: Synthetic oligonucleotide
  Target: ATXN1; (-) strand; PAM type: NRG; PAM sequence: TAG
catcagcctgtctaggaagg

SEQ ID NO: 38079 - DNA, 20 bp, Artificial Sequence
  Description of Artificial Sequence: Synthetic oligonucleotide
  Target: ATXN1; (-) strand; PAM type: NRG; PAM sequence: AGG
tgccatcagcctgtctagga

SEQ ID NO: 38080 - DNA, 20 bp, Artificial Sequence
  Description of Artificial Sequence: Synthetic oligonucleotide
  Target: ATXN1; (-) strand; PAM type: NRG; PAM sequence: AAG
ttgccatcagcctgtctagg

SEQ ID NO: 38081 - DNA, 20 bp, Artificial Sequence
  Description of Artificial Sequence: Synthetic oligonucleotide
  Target: ATXN1; (-) strand; PAM type: NRG; PAM sequence: AGG
ggcttgccatcagcctgtct

SEQ ID NO: 38082 - DNA, 20 bp, Artificial Sequence
  Description of Artificial Sequence: Synthetic oligonucleotide
  Target: ATXN1; (-) strand; PAM type: NRG; PAM sequence: TAG
aggcttgccatcagcctgtc

SEQ ID NO: 38083 - DNA, 20 bp, Artificial Sequence
  Description of Artificial Sequence: Synthetic oligonucleotide
  Target: ATXN1; (-) strand; PAM type: NRG; PAM sequence: CAG
cgccgggagaggcttgccat

SEQ ID NO: 38084 - DNA, 20 bp, Artificial Sequence
  Description of Artificial Sequence: Synthetic oligonucleotide
  Target: ATXN1; (-) strand; PAM type: NRG; PAM sequence: AGG
tgtctgctaatcgccgggag

SEQ ID NO: 38085 - DNA, 20 bp, Artificial Sequence
  Description of Artificial Sequence: Synthetic oligonucleotide
  Target: ATXN1; (-) strand; PAM type: NRG; PAM sequence: GAG
ttgtctgctaatcgccggga

SEQ ID NO: 38086 - DNA, 20 bp, Artificial Sequence
  Description of Artificial Sequence: Synthetic oligonucleotide
  Target: ATXN1; (-) strand; PAM type: NRG; PAM sequence: GAG
acttgtctgctaatcgccgg

SEQ ID NO: 38087 - DNA, 20 bp, Artificial Sequence
  Description of Artificial Sequence: Synthetic oligonucleotide
  Target: ATXN1; (-) strand; PAM type: NRG; PAM sequence: GGG
tgacttgtctgctaatcgcc

SEQ ID NO: 38088 - DNA, 20 bp, Artificial Sequence
  Description of Artificial Sequence: Synthetic oligonucleotide
  Target: ATXN1; (-) strand; PAM type: NRG; PAM sequence: CGG
gtgacttgtctgctaatcgc

SEQ ID NO: 38089 - DNA, 20 bp, Artificial Sequence
  Description of Artificial Sequence: Synthetic oligonucleotide
  Target: ATXN1; (-) strand; PAM type: NRG; PAM sequence: AGG
tcctctccttgcccctccta

SEQ ID NO: 38090 - DNA, 20 bp, Artificial Sequence
  Description of Artificial Sequence: Synthetic oligonucleotide
  Target: ATXN1; (-) strand; PAM type: NRG; PAM sequence: AAG
ctcctctccttgcccctcct

SEQ ID NO: 38091 - DNA, 20 bp, Artificial Sequence
  Description of Artificial Sequence: Synthetic oligonucleotide
  Target: ATXN1; (-) strand; PAM type: NRG; PAM sequence: TGG
gactccggcctgtccaccct

SEQ ID NO: 38092 - DNA, 20 bp, Artificial Sequence
  Description of Artificial Sequence: Synthetic oligonucleotide
  Target: ATXN1; (-) strand; PAM type: NRG; PAM sequence: CGG
gatgccagttactttgactc

SEQ ID NO: 38093 - DNA, 20 bp, Artificial Sequence
  Description of Artificial Sequence: Synthetic oligonucleotide
  Target: ATXN1; (-) strand; PAM type: NRG; PAM sequence: CAG
aagctagaggtgagggatgc

SEQ ID NO: 38094 - DNA, 20 bp, Artificial Sequence
  Description of Artificial Sequence: Synthetic oligonucleotide
  Target: ATXN1; (-) strand; PAM type: NRG; PAM sequence: GGG
caaccaaaagctagaggtga

SEQ ID NO: 38095 - DNA, 20 bp, Artificial Sequence
  Description of Artificial Sequence: Synthetic oligonucleotide
  Target: ATXN1; (-) strand; PAM type: NRG; PAM sequence: AGG
gcaaccaaaagctagaggtg

SEQ ID NO: 38096 - DNA, 20 bp, Artificial Sequence
  Description of Artificial Sequence: Synthetic oligonucleotide
  Target: ATXN1; (-) strand; PAM type: NRG; PAM sequence: GAG
agcaaccaaaagctagaggt

SEQ ID NO: 38097 - DNA, 20 bp, Artificial Sequence
  Description of Artificial Sequence: Synthetic oligonucleotide
  Target: ATXN1; (-) strand; PAM type: NRG; PAM sequence: AGG
ttgcagcaaccaaaagctag

SEQ ID NO: 38098 - DNA, 20 bp, Artificial Sequence
  Description of Artificial Sequence: Synthetic oligonucleotide
  Target: ATXN1; (-) strand; PAM type: NRG; PAM sequence: GAG
tttgcagcaaccaaaagcta

SEQ ID NO: 38099 - DNA, 20 bp, Artificial Sequence
  Description of Artificial Sequence: Synthetic oligonucleotide
  Target: ATXN1; (-) strand; PAM type: NRG; PAM sequence: TAG
cttttgcagcaaccaaaagc

SEQ ID NO: 38100 - DNA, 20 bp, Artificial Sequence
  Description of Artificial Sequence: Synthetic oligonucleotide
  Target: ATXN1; (-) strand; PAM type: NRG; PAM sequence: AAG
tgttcttttgcagcaaccaa

SEQ ID NO: 38101 - DNA, 20 bp, Artificial Sequence
  Description of Artificial Sequence: Synthetic oligonucleotide
  Target: ATXN1; (-) strand; PAM type: NRG; PAM sequence: CAG
taattgcttttgttcttttg

SEQ ID NO: 38102 - DNA, 20 bp, Artificial Sequence
  Description of Artificial Sequence: Synthetic oligonucleotide
  Target: ATXN1; (-) strand; PAM type: NRG; PAM sequence: CAG
acaattcatgttcatctgtc

SEQ ID NO: 38103 - DNA, 20 bp, Artificial Sequence
  Description of Artificial Sequence: Synthetic oligonucleotide
  Target: ATXN1; (-) strand; PAM type: NRG; PAM sequence: GGG
caactttgtgagtatcagct

SEQ ID NO: 38104 - DNA, 20 bp, Artificial Sequence
  Description of Artificial Sequence: Synthetic oligonucleotide
  Target: ATXN1; (-) strand; PAM type: NRG; PAM sequence: TGG
tcaactttgtgagtatcagc

SEQ ID NO: 38105 - DNA, 20 bp, Artificial Sequence
  Description of Artificial Sequence: Synthetic oligonucleotide
  Target: ATXN1; (-) strand; PAM type: NRG; PAM sequence: CAG
tggctcaactttgtgagtat

SEQ ID NO: 38106 - DNA, 20 bp, Artificial Sequence
  Description of Artificial Sequence: Synthetic oligonucleotide
  Target: ATXN1; (-) strand; PAM type: NRG; PAM sequence: GAG
acacattggctcaactttgt

SEQ ID NO: 38107 - DNA, 20 bp, Artificial Sequence
  Description of Artificial Sequence: Synthetic oligonucleotide
  Target: ATXN1; (-) strand; PAM type: NRG; PAM sequence: TGG
gaaactcggggaaaacacat

SEQ ID NO: 38108 - DNA, 20 bp, Artificial Sequence
  Description of Artificial Sequence: Synthetic oligonucleotide
  Target: ATXN1; (-) strand; PAM type: NRG; PAM sequence: GGG
agcacatgtaatgaaactcg

SEQ ID NO: 38109 - DNA, 20 bp, Artificial Sequence
  Description of Artificial Sequence: Synthetic oligonucleotide
  Target: ATXN1; (-) strand; PAM type: NRG; PAM sequence: GGG
aagcacatgtaatgaaactc

SEQ ID NO: 38110 - DNA, 20 bp, Artificial Sequence
  Description of Artificial Sequence: Synthetic oligonucleotide
  Target: ATXN1; (-) strand; PAM type: NRG; PAM sequence: CGG
aaagcacatgtaatgaaact

SEQ ID NO: 38111 - DNA, 20 bp, Artificial Sequence
  Description of Artificial Sequence: Synthetic oligonucleotide
  Target: ATXN1; (-) strand; PAM type: NRG; PAM sequence: AAG
acagatgacttgtccctgaa

SEQ ID NO: 38112 - DNA, 20 bp, Artificial Sequence
  Description of Artificial Sequence: Synthetic oligonucleotide
  Target: ATXN1; (-) strand; PAM type: NRG; PAM sequence: CAG
caacagcaaactggtagcga

SEQ ID NO: 38113 - DNA, 20 bp, Artificial Sequence
  Description of Artificial Sequence: Synthetic oligonucleotide
  Target: ATXN1; (-) strand; PAM type: NRG; PAM sequence: TAG
tagaggcaacagcaaactgg

SEQ ID NO: 38114 - DNA, 20 bp, Artificial Sequence
  Description of Artificial Sequence: Synthetic oligonucleotide
  Target: ATXN1; (-) strand; PAM type: NRG; PAM sequence: TGG
tcctagaggcaacagcaaac

SEQ ID NO: 38115 - DNA, 20 bp, Artificial Sequence
  Description of Artificial Sequence: Synthetic oligonucleotide
  Target: ATXN1; (-) strand; PAM type: NRG; PAM sequence: CAG
ggacagcttcctagaggcaa

SEQ ID NO: 38116 - DNA, 20 bp, Artificial Sequence
  Description of Artificial Sequence: Synthetic oligonucleotide
  Target: ATXN1; (-) strand; PAM type: NRG; PAM sequence: AGG
ggacagggacagcttcctag

SEQ ID NO: 38117 - DNA, 20 bp, Artificial Sequence
  Description of Artificial Sequence: Synthetic oligonucleotide
  Target: ATXN1; (-) strand; PAM type: NRG; PAM sequence: GAG
aggacagggacagcttccta

SEQ ID NO: 38118 - DNA, 20 bp, Artificial Sequence
  Description of Artificial Sequence: Synthetic oligonucleotide
  Target: ATXN1; (-) strand; PAM type: NRG; PAM sequence: TAG
ccaggacagggacagcttcc

SEQ ID NO: 38119 - DNA, 20 bp, Artificial Sequence
  Description of Artificial Sequence: Synthetic oligonucleotide
  Target: ATXN1; (-) strand; PAM type: NRG; PAM sequence: CAG
atgagaagccaggacaggga

SEQ ID NO: 38120 - DNA, 20 bp, Artificial Sequence
  Description of Artificial Sequence: Synthetic oligonucleotide
  Target: ATXN1; (-) strand; PAM type: NRG; PAM sequence: GGG
cgaaatgagaagccaggaca

SEQ ID NO: 38121 - DNA, 20 bp, Artificial Sequence
  Description of Artificial Sequence: Synthetic oligonucleotide
  Target: ATXN1; (-) strand; PAM type: NRG; PAM sequence: AGG
acgaaatgagaagccaggac

SEQ ID NO: 38122 - DNA, 20 bp, Artificial Sequence
  Description of Artificial Sequence: Synthetic oligonucleotide
  Target: ATXN1; (-) strand; PAM type: NRG; PAM sequence: CAG
aacgaaatgagaagccagga

SEQ ID NO: 38123 - DNA, 20 bp, Artificial Sequence
  Description of Artificial Sequence: Synthetic oligonucleotide
  Target: ATXN1; (-) strand; PAM type: NRG; PAM sequence: AGG
acaaaacgaaatgagaagcc

SEQ ID NO: 38124 - DNA, 20 bp, Artificial Sequence
  Description of Artificial Sequence: Synthetic oligonucleotide
  Target: ATXN1; (-) strand; PAM type: NRG; PAM sequence: CAG
aacaaaacgaaatgagaagc

SEQ ID NO: 38125 - DNA, 20 bp, Artificial Sequence
  Description of Artificial Sequence: Synthetic oligonucleotide
  Target: ATXN1; (-) strand; PAM type: NRG; PAM sequence: AAG
ggaaaacaaaacgaaatgag

SEQ ID NO: 38126 - DNA, 20 bp, Artificial Sequence
  Description of Artificial Sequence: Synthetic oligonucleotide
  Target: ATXN1; (-) strand; PAM type: NRG; PAM sequence: GAG
ggaggaaaacaaaacgaaat

SEQ ID NO: 38127 - DNA, 20 bp, Artificial Sequence
  Description of Artificial Sequence: Synthetic oligonucleotide
  Target: ATXN1; (-) strand; PAM type: NRG; PAM sequence: AGG
aagggggaaaaaaaagatgg

SEQ ID NO: 38128 - DNA, 20 bp, Artificial Sequence
  Description of Artificial Sequence: Synthetic oligonucleotide
  Target: ATXN1; (-) strand; PAM type: NRG; PAM sequence: GAG
gaagggggaaaaaaaagatg

SEQ ID NO: 38129 - DNA, 20 bp, Artificial Sequence
  Description of Artificial Sequence: Synthetic oligonucleotide
  Target: ATXN1; (-) strand; PAM type: NRG; PAM sequence: TGG
gagaagggggaaaaaaaaga

SEQ ID NO: 38130 - DNA, 20 bp, Artificial Sequence
  Description of Artificial Sequence: Synthetic oligonucleotide
  Target: ATXN1; (-) strand; PAM type: NRG; PAM sequence: AAG
gactgagaagggggaaaaaa

SEQ ID NO: 38131 - DNA, 20 bp, Artificial Sequence
  Description of Artificial Sequence: Synthetic oligonucleotide
  Target: ATXN1; (-) strand; PAM type: NRG; PAM sequence: GGG
acaagttgggactgagaagg

SEQ ID NO: 38132 - DNA, 20 bp, Artificial Sequence
  Description of Artificial Sequence: Synthetic oligonucleotide
  Target: ATXN1; (-) strand; PAM type: NRG; PAM sequence: GGG
gacaagttgggactgagaag

SEQ ID NO: 38133 - DNA, 20 bp, Artificial Sequence
  Description of Artificial Sequence: Synthetic oligonucleotide
  Target: ATXN1; (-) strand; PAM type: NRG; PAM sequence: GGG
agacaagttgggactgagaa

SEQ ID NO: 38134 - DNA, 20 bp, Artificial Sequence
  Description of Artificial Sequence: Synthetic oligonucleotide
  Target: ATXN1; (-) strand; PAM type: NRG; PAM sequence: AGG
aagacaagttgggactgaga

SEQ ID NO: 38135 - DNA, 20 bp, Artificial Sequence
  Description of Artificial Sequence: Synthetic oligonucleotide
  Target: ATXN1; (-) strand; PAM type: NRG; PAM sequence: AAG
taagacaagttgggactgag

SEQ ID NO: 38136 - DNA, 20 bp, Artificial Sequence
  Description of Artificial Sequence: Synthetic oligonucleotide
  Target: ATXN1; (-) strand; PAM type: NRG; PAM sequence: GAG
aattaagacaagttgggact

SEQ ID NO: 38137 - DNA, 20 bp, Artificial Sequence
  Description of Artificial Sequence: Synthetic oligonucleotide
  Target: ATXN1; (-) strand; PAM type: NRG; PAM sequence: GGG
atttcaaattaagacaagtt

SEQ ID NO: 38138 - DNA, 20 bp, Artificial Sequence
  Description of Artificial Sequence: Synthetic oligonucleotide
  Target: ATXN1; (-) strand; PAM type: NRG; PAM sequence: TGG
aatttcaaattaagacaagt

SEQ ID NO: 38139 - DNA, 20 bp, Artificial Sequence
  Description of Artificial Sequence: Synthetic oligonucleotide
  Target: ATXN1; (-) strand; PAM type: NRG; PAM sequence: AAG
gtggaatttcaaattaagac

SEQ ID NO: 38140 - DNA, 20 bp, Artificial Sequence
  Description of Artificial Sequence: Synthetic oligonucleotide
  Target: ATXN1; (-) strand; PAM type: NRG; PAM sequence: AAG
atcctgtggaatttcaaatt

SEQ ID NO: 38141 - DNA, 20 bp, Artificial Sequence
  Description of Artificial Sequence: Synthetic oligonucleotide
  Target: ATXN1; (-) strand; PAM type: NRG; PAM sequence: TGG
ccttcccataaaacatcctg

SEQ ID NO: 38142 - DNA, 20 bp, Artificial Sequence
  Description of Artificial Sequence: Synthetic oligonucleotide
  Target: ATXN1; (-) strand; PAM type: NRG; PAM sequence: GAG
tccacctgctaatttcttgg

SEQ ID NO: 38143 - DNA, 20 bp, Artificial Sequence
  Description of Artificial Sequence: Synthetic oligonucleotide
  Target: ATXN1; (-) strand; PAM type: NRG; PAM sequence: GGG
actccacctgctaatttctt

SEQ ID NO: 38144 - DNA, 20 bp, Artificial Sequence
  Description of Artificial Sequence: Synthetic oligonucleotide
  Target: ATXN1; (-) strand; PAM type: NRG; PAM sequence: TGG
gactccacctgctaatttct

SEQ ID NO: 38145 - DNA, 20 bp, Artificial Sequence
  Description of Artificial Sequence: Synthetic oligonucleotide
  Target: ATXN1; (-) strand; PAM type: NRG; PAM sequence: CAG
tcaaagctttggctcttttt

SEQ ID NO: 38146 - DNA, 20 bp, Artificial Sequence
  Description of Artificial Sequence: Synthetic oligonucleotide
  Target: ATXN1; (-) strand; PAM type: NRG; PAM sequence: TGG
gatgccactgatcaaagctt

SEQ ID NO: 38147 - DNA, 20 bp, Artificial Sequence
  Description of Artificial Sequence: Synthetic oligonucleotide
  Target: ATXN1; (-) strand; PAM type: NRG; PAM sequence: AAG
ttttaggatgccactgatca

SEQ ID NO: 38148 - DNA, 20 bp, Artificial Sequence
  Description of Artificial Sequence: Synthetic oligonucleotide
  Target: ATXN1; (-) strand; PAM type: NRG; PAM sequence: AGG
gtctcaaaccaatgcctttt

SEQ ID NO: 38149 - DNA, 20 bp, Artificial Sequence
  Description of Artificial Sequence: Synthetic oligonucleotide
  Target: ATXN1; (-) strand; PAM type: NRG; PAM sequence: TAG
tgtctcaaaccaatgccttt

SEQ ID NO: 38150 - DNA, 20 bp, Artificial Sequence
  Description of Artificial Sequence: Synthetic oligonucleotide
  Target: ATXN1; (-) strand; PAM type: NRG; PAM sequence: TGG
tcactggcacactgagggaa

SEQ ID NO: 38151 - DNA, 20 bp, Artificial Sequence
  Description of Artificial Sequence: Synthetic oligonucleotide
  Target: ATXN1; (-) strand; PAM type: NRG; PAM sequence: GGG
aggattcactggcacactga

SEQ ID NO: 38152 - DNA, 20 bp, Artificial Sequence
  Description of Artificial Sequence: Synthetic oligonucleotide
  Target: ATXN1; (-) strand; PAM type: NRG; PAM sequence: AGG
aaggattcactggcacactg

SEQ ID NO: 38153 - DNA, 20 bp, Artificial Sequence
  Description of Artificial Sequence: Synthetic oligonucleotide
  Target: ATXN1; (-) strand; PAM type: NRG; PAM sequence: GAG
aaaggattcactggcacact

SEQ ID NO: 38154 - DNA, 20 bp, Artificial Sequence
  Description of Artificial Sequence: Synthetic oligonucleotide
  Target: ATXN1; (-) strand; PAM type: NRG; PAM sequence: TGG
ccttccgagaaaggattcac

SEQ ID NO: 38155 - DNA, 20 bp, Artificial Sequence
  Description of Artificial Sequence: Synthetic oligonucleotide
  Target: ATXN1; (-) strand; PAM type: NRG; PAM sequence: AGG
ccatgtggtccttccgagaa

SEQ ID NO: 38156 - DNA, 20 bp, Artificial Sequence
  Description of Artificial Sequence: Synthetic oligonucleotide
  Target: ATXN1; (-) strand; PAM type: NRG; PAM sequence: AAG
gccatgtggtccttccgaga

SEQ ID NO: 38157 - DNA, 20 bp, Artificial Sequence
  Description of Artificial Sequence: Synthetic oligonucleotide
  Target: ATXN1; (-) strand; PAM type: NRG; PAM sequence: GAG
tagtgccatgtggtccttcc

SEQ ID NO: 38158 - DNA, 20 bp, Artificial Sequence
  Description of Artificial Sequence: Synthetic oligonucleotide
  Target: ATXN1; (-) strand; PAM type: NRG; PAM sequence: TGG
ccttatacagtagtgccatg

SEQ ID NO: 38159 - DNA, 20 bp, Artificial Sequence
  Description of Artificial Sequence: Synthetic oligonucleotide
  Target: ATXN1; (-) strand; PAM type: NRG; PAM sequence: TAG
gttaactgacccttatacag

SEQ ID NO: 38160 - DNA, 20 bp, Artificial Sequence
  Description of Artificial Sequence: Synthetic oligonucleotide
  Target: ATXN1; (-) strand; PAM type: NRG; PAM sequence: CAG
cccgttaactgacccttata

SEQ ID NO: 38161 - DNA, 20 bp, Artificial Sequence
  Description of Artificial Sequence: Synthetic oligonucleotide
  Target: ATXN1; (-) strand; PAM type: NRG; PAM sequence: AAG
gctgcagaggccaattctcc

SEQ ID NO: 38162 - DNA, 20 bp, Artificial Sequence
  Description of Artificial Sequence: Synthetic oligonucleotide
  Target: ATXN1; (-) strand; PAM type: NRG; PAM sequence: AGG
ctgctgcaggtcagctgcag

SEQ ID NO: 38163 - DNA, 20 bp, Artificial Sequence
  Description of Artificial Sequence: Synthetic oligonucleotide
  Target: ATXN1; (-) strand; PAM type: NRG; PAM sequence: GAG
actgctgcaggtcagctgca

SEQ ID NO: 38164 - DNA, 20 bp, Artificial Sequence
  Description of Artificial Sequence: Synthetic oligonucleotide
  Target: ATXN1; (-) strand; PAM type: NRG; PAM sequence: CAG
ggactgctgcaggtcagctg

SEQ ID NO: 38165 - DNA, 20 bp, Artificial Sequence
  Description of Artificial Sequence: Synthetic oligonucleotide
  Target: ATXN1; (-) strand; PAM type: NRG; PAM sequence: CAG
cctggtggactgctgcaggt

SEQ ID NO: 38166 - DNA, 20 bp, Artificial Sequence
  Description of Artificial Sequence: Synthetic oligonucleotide
  Target: ATXN1; (-) strand; PAM type: NRG; PAM sequence: AGG
gcatcctggtggactgctgc

SEQ ID NO: 38167 - DNA, 20 bp, Artificial Sequence
  Description of Artificial Sequence: Synthetic oligonucleotide
  Target: ATXN1; (-) strand; PAM type: NRG; PAM sequence: CAG
agcatcctggtggactgctg

SEQ ID NO: 38168 - DNA, 20 bp, Artificial Sequence
  Description of Artificial Sequence: Synthetic oligonucleotide
  Target: ATXN1; (-) strand; PAM type: NRG; PAM sequence: TGG
tgtttaaacaagcatcctgg

SEQ ID NO: 38169 - DNA, 20 bp, Artificial Sequence
  Description of Artificial Sequence: Synthetic oligonucleotide
  Target: ATXN1; (-) strand; PAM type: NRG; PAM sequence: TGG
cactgtttaaacaagcatcc

SEQ ID NO: 38170 - DNA, 20 bp, Artificial Sequence
  Description of Artificial Sequence: Synthetic oligonucleotide
  Target: ATXN1; (-) strand; PAM type: NRG; PAM sequence: AAG
tctgcgttcactgtttaaac

SEQ ID NO: 38171 - DNA, 20 bp, Artificial Sequence
  Description of Artificial Sequence: Synthetic oligonucleotide
  Target: ATXN1; (-) strand; PAM type: NRG; PAM sequence: CGG
atacttcaaagtttagcggc

SEQ ID NO: 38172 - DNA, 20 bp, Artificial Sequence
  Description of Artificial Sequence: Synthetic oligonucleotide
  Target: ATXN1; (-) strand; PAM type: NRG; PAM sequence: CGG
ctcaatacttcaaagtttag

SEQ ID NO: 38173 - DNA, 20 bp, Artificial Sequence
  Description of Artificial Sequence: Synthetic oligonucleotide
  Target: ATXN1; (-) strand; PAM type: NRG; PAM sequence: TAG
gaactcaatacttcaaagtt

SEQ ID NO: 38174 - DNA, 20 bp, Artificial Sequence
  Description of Artificial Sequence: Synthetic oligonucleotide
  Target: ATXN1; (-) strand; PAM type: NRG; PAM sequence: AAG
gcctggaactcaatacttca

SEQ ID NO: 38175 - DNA, 20 bp, Artificial Sequence
  Description of Artificial Sequence: Synthetic oligonucleotide
  Target: ATXN1; (-) strand; PAM type: NRG; PAM sequence: TGG
ctgcatacgctttccaggcc

SEQ ID NO: 38176 - DNA, 20 bp, Artificial Sequence
  Description of Artificial Sequence: Synthetic oligonucleotide
  Target: ATXN1; (-) strand; PAM type: NRG; PAM sequence: AGG
ctgatctgcatacgctttcc

SEQ ID NO: 38177 - DNA, 20 bp, Artificial Sequence
  Description of Artificial Sequence: Synthetic oligonucleotide
  Target: ATXN1; (-) strand; PAM type: NRG; PAM sequence: CAG
cctgatctgcatacgctttc

SEQ ID NO: 38178 - DNA, 20 bp, Artificial Sequence
  Description of Artificial Sequence: Synthetic oligonucleotide
  Target: ATXN1; (-) strand; PAM type: NRG; PAM sequence: AAG
ttcagccttattaaaaagca

SEQ ID NO: 38179 - DNA, 20 bp, Artificial Sequence
  Description of Artificial Sequence: Synthetic oligonucleotide
  Target: ATXN1; (-) strand; PAM type: NRG; PAM sequence: AAG
tgctcttcagccttattaaa

SEQ ID NO: 38180 - DNA, 20 bp, Artificial Sequence
  Description of Artificial Sequence: Synthetic oligonucleotide
  Target: ATXN1; (-) strand; PAM type: NRG; PAM sequence: CAG
tgacttgtgtatctgctctt

SEQ ID NO: 38181 - DNA, 20 bp, Artificial Sequence
  Description of Artificial Sequence: Synthetic oligonucleotide
  Target: ATXN1; (-) strand; PAM type: NRG; PAM sequence: AAG
ggtcattgcttgcctttcca

SEQ ID NO: 38182 - DNA, 20 bp, Artificial Sequence
  Description of Artificial Sequence: Synthetic oligonucleotide
  Target: ATXN1; (-) strand; PAM type: NRG; PAM sequence: GGG
tgtggatcttctctactcca

SEQ ID NO: 38183 - DNA, 20 bp, Artificial Sequence
  Description of Artificial Sequence: Synthetic oligonucleotide
  Target: ATXN1; (-) strand; PAM type: NRG; PAM sequence: AGG
ctgtggatcttctctactcc

SEQ ID NO: 38184 - DNA, 20 bp, Artificial Sequence
  Description of Artificial Sequence: Synthetic oligonucleotide
  Target: ATXN1; (-) strand; PAM type: NRG; PAM sequence: CAG
cctgtggatcttctctactc

SEQ ID NO: 38185 - DNA, 20 bp, Artificial Sequence
  Description of Artificial Sequence: Synthetic oligonucleotide
  Target: ATXN1; (-) strand; PAM type: NRG; PAM sequence: TGG
cctggcacagcagcaccctg

SEQ ID NO: 38186 - DNA, 20 bp, Artificial Sequence
  Description of Artificial Sequence: Synthetic oligonucleotide
  Target: ATXN1; (-) strand; PAM type: NRG; PAM sequence: CAG
attcattcaccctggcacag

SEQ ID NO: 38187 - DNA, 20 bp, Artificial Sequence
  Description of Artificial Sequence: Synthetic oligonucleotide
  Target: ATXN1; (-) strand; PAM type: NRG; PAM sequence: CAG
gccattcattcaccctggca

SEQ ID NO: 38188 - DNA, 20 bp, Artificial Sequence
  Description of Artificial Sequence: Synthetic oligonucleotide
  Target: ATXN1; (-) strand; PAM type: NRG; PAM sequence: TGG
atcaggccattcattcaccc

SEQ ID NO: 38189 - DNA, 20 bp, Artificial Sequence
  Description of Artificial Sequence: Synthetic oligonucleotide
  Target: ATXN1; (-) strand; PAM type: NRG; PAM sequence: AGG
atcggtcactgtggacaatc

SEQ ID NO: 38190 - DNA, 20 bp, Artificial Sequence
  Description of Artificial Sequence: Synthetic oligonucleotide
  Target: ATXN1; (-) strand; PAM type: NRG; PAM sequence: CAG
catcggtcactgtggacaat

SEQ ID NO: 38191 - DNA, 20 bp, Artificial Sequence
  Description of Artificial Sequence: Synthetic oligonucleotide
  Target: ATXN1; (-) strand; PAM type: NRG; PAM sequence: TGG
tctcatgccatcggtcactg

SEQ ID NO: 38192 - DNA, 20 bp, Artificial Sequence
  Description of Artificial Sequence: Synthetic oligonucleotide
  Target: ATXN1; (-) strand; PAM type: NRG; PAM sequence: CGG
ttggacccttctcatgccat

SEQ ID NO: 38193 - DNA, 20 bp, Artificial Sequence
  Description of Artificial Sequence: Synthetic oligonucleotide
  Target: ATXN1; (-) strand; PAM type: NRG; PAM sequence: TGG
cagagtgtgacagctctggt

SEQ ID NO: 38194 - DNA, 20 bp, Artificial Sequence
  Description of Artificial Sequence: Synthetic oligonucleotide
  Target: ATXN1; (-) strand; PAM type: NRG; PAM sequence: TGG
atcccagagtgtgacagctc

SEQ ID NO: 38195 - DNA, 20 bp, Artificial Sequence
  Description of Artificial Sequence: Synthetic oligonucleotide
  Target: ATXN1; (-) strand; PAM type: NRG; PAM sequence: CAG
tgtattatcccagagtgtga

SEQ ID NO: 38196 - DNA, 20 bp, Artificial Sequence
  Description of Artificial Sequence: Synthetic oligonucleotide
  Target: ATXN1; (-) strand; PAM type: NRG; PAM sequence: GAG
agtgggcctgtattatccca

SEQ ID NO: 38197 - DNA, 20 bp, Artificial Sequence
  Description of Artificial Sequence: Synthetic oligonucleotide
  Target: ATXN1; (-) strand; PAM type: NRG; PAM sequence: CAG
acagtgggcctgtattatcc

SEQ ID NO: 38198 - DNA, 20 bp, Artificial Sequence
  Description of Artificial Sequence: Synthetic oligonucleotide
  Target: ATXN1; (-) strand; PAM type: NRG; PAM sequence: GGG
aatcttaaaggaccaacagt

SEQ ID NO: 38199 - DNA, 20 bp, Artificial Sequence
  Description of Artificial Sequence: Synthetic oligonucleotide
  Target: ATXN1; (-) strand; PAM type: NRG; PAM sequence: TGG
taatcttaaaggaccaacag

SEQ ID NO: 38200 - DNA, 20 bp, Artificial Sequence
  Description of Artificial Sequence: Synthetic oligonucleotide
  Target: ATXN1; (-) strand; PAM type: NRG; PAM sequence: CAG
acataatcttaaaggaccaa

SEQ ID NO: 38201 - DNA, 20 bp, Artificial Sequence
  Description of Artificial Sequence: Synthetic oligonucleotide
  Target: ATXN1; (-) strand; PAM type: NRG; PAM sequence: AGG
atctctaaacataatcttaa

SEQ ID NO: 38202 - DNA, 20 bp, Artificial Sequence
  Description of Artificial Sequence: Synthetic oligonucleotide
  Target: ATXN1; (-) strand; PAM type: NRG; PAM sequence: AAG
gatctctaaacataatctta

SEQ ID NO: 38203 - DNA, 20 bp, Artificial Sequence
  Description of Artificial Sequence: Synthetic oligonucleotide
  Target: ATXN1; (-) strand; PAM type: NRG; PAM sequence: TGG
atggagacaatgctgctggc

SEQ ID NO: 38204 - DNA, 20 bp, Artificial Sequence
  Description of Artificial Sequence: Synthetic oligonucleotide
  Target: ATXN1; (-) strand; PAM type: NRG; PAM sequence: TGG
tacaatggagacaatgctgc

SEQ ID NO: 38205 - DNA, 20 bp, Artificial Sequence
  Description of Artificial Sequence: Synthetic oligonucleotide
  Target: ATXN1; (-) strand; PAM type: NRG; PAM sequence: GAG
taggggaaagtattacaatg

SEQ ID NO: 38206 - DNA, 20 bp, Artificial Sequence
  Description of Artificial Sequence: Synthetic oligonucleotide
  Target: ATXN1; (-) strand; PAM type: NRG; PAM sequence: TGG
agtaggggaaagtattacaa

SEQ ID NO: 38207 - DNA, 20 bp, Artificial Sequence
  Description of Artificial Sequence: Synthetic oligonucleotide
  Target: ATXN1; (-) strand; PAM type: NRG; PAM sequence: AAG
ttaatggatttagtagggga

SEQ ID NO: 38208 - DNA, 20 bp, Artificial Sequence
  Description of Artificial Sequence: Synthetic oligonucleotide
  Target: ATXN1; (-) strand; PAM type: NRG; PAM sequence: GGG
actcttaatggatttagtag

SEQ ID NO: 38209 - DNA, 20 bp, Artificial Sequence
  Description of Artificial Sequence: Synthetic oligonucleotide
  Target: ATXN1; (-) strand; PAM type: NRG; PAM sequence: GGG
aactcttaatggatttagta

SEQ ID NO: 38210 - DNA, 20 bp, Artificial Sequence
  Description of Artificial Sequence: Synthetic oligonucleotide
  Target: ATXN1; (-) strand; PAM type: NRG; PAM sequence: AGG
aaactcttaatggatttagt

SEQ ID NO: 38211 - DNA, 20 bp, Artificial Sequence
  Description of Artificial Sequence: Synthetic oligonucleotide
  Target: ATXN1; (-) strand; PAM type: NRG; PAM sequence: TAG
aaaactcttaatggatttag

SEQ ID NO: 38212 - DNA, 20 bp, Artificial Sequence
  Description of Artificial Sequence: Synthetic oligonucleotide
  Target: ATXN1; (-) strand; PAM type: NRG; PAM sequence: TAG
aaaaaaactcttaatggatt

SEQ ID NO: 38213 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaaaaaactcttaa

SEQ ID NO: 38214 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcaaca

SEQ ID NO: 38215 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcaa

SEQ ID NO: 38216 - DNA, 20 bp, Artificial Sequence
  Description of Artificial Sequence: Synthetic oligonucleotide
  Target: ATXN1; (-) strand; PAM type: NRG; PAM sequence: GGG
ctgccactgcactccagcct

SEQ ID NO: 38217 - DNA, 20 bp, Artificial Sequence
  Description of Artificial Sequence: Synthetic oligonucleotide
  Target: ATXN1; (-) strand; PAM type: NRG; PAM sequence: TGG
cctgccactgcactccagcc

SEQ ID NO: 38218 - DNA, 20 bp, Artificial Sequence
  Description of Artificial Sequence: Synthetic oligonucleotide
  Target: ATXN1; (-) strand; PAM type: NRG; PAM sequence: CAG
gtgatcctgccactgcactc

SEQ ID NO: 38219 - DNA, 20 bp, Artificial Sequence
  Description of Artificial Sequence: Synthetic oligonucleotide
  Target: ATXN1; (-) strand; PAM type: NRG; PAM sequence: GAG
cgggaggtcaaggctgtggt

SEQ ID NO: 38220 - DNA, 20 bp, Artificial Sequence
  Description of Artificial Sequence: Synthetic oligonucleotide
  Target: ATXN1; (-) strand; PAM type: NRG; PAM sequence: TGG
agcccgggaggtcaaggctg

SEQ ID NO: 38221 - DNA, 20 bp, Artificial Sequence
  Description of Artificial Sequence: Synthetic oligonucleotide
  Target: ATXN1; (-) strand; PAM type: NRG; PAM sequence: AGG
cacctgagcccgggaggtca

SEQ ID NO: 38222 - DNA, 20 bp, Artificial Sequence
  Description of Artificial Sequence: Synthetic oligonucleotide
  Target: ATXN1; (-) strand; PAM type: NRG; PAM sequence: AAG
tcacctgagcccgggaggtc

SEQ ID NO: 38223 - DNA, 20 bp, Artificial Sequence
  Description of Artificial Sequence: Synthetic oligonucleotide
  Target: ATXN1; (-) strand; PAM type: NRG; PAM sequence: AGG
gaggatcacctgagcccggg

SEQ ID NO: 38224 - DNA, 20 bp, Artificial Sequence
  Description of Artificial Sequence: Synthetic oligonucleotide
  Target: ATXN1; (-) strand; PAM type: NRG; PAM sequence: GAG
agaggatcacctgagcccgg

SEQ ID NO: 38225 - DNA, 20 bp, Artificial Sequence
  Description of Artificial Sequence: Synthetic oligonucleotide
  Target: ATXN1; (-) strand; PAM type: NRG; PAM sequence: GGG
tcagaggatcacctgagccc

SEQ ID NO: 38226 - DNA, 20 bp, Artificial Sequence
  Description of Artificial Sequence: Synthetic oligonucleotide
  Target: ATXN1; (-) strand; PAM type: NRG; PAM sequence: CGG
gtcagaggatcacctgagcc

SEQ ID NO: 38227 - DNA, 20 bp, Artificial Sequence
  Description of Artificial Sequence: Synthetic oligonucleotide
  Target: ATXN1; (-) strand; PAM type: NRG; PAM sequence: GAG
ctgaggtcagaggatcacct

SEQ ID NO: 38228 - DNA, 20 bp, Artificial Sequence
  Description of Artificial Sequence: Synthetic oligonucleotide
  Target: ATXN1; (-) strand; PAM type: NRG; PAM sequence: AGG
acttgggagactgaggtcag

SEQ ID NO: 38229 - DNA, 20 bp, Artificial Sequence
  Description of Artificial Sequence: Synthetic oligonucleotide
  Target: ATXN1; (-) strand; PAM type: NRG; PAM sequence: GAG
tacttgggagactgaggtca

SEQ ID NO: 38230 - DNA, 20 bp, Artificial Sequence
  Description of Artificial Sequence: Synthetic oligonucleotide
  Target: ATXN1; (-) strand; PAM type: NRG; PAM sequence: CAG
gctacttgggagactgaggt

SEQ ID NO: 38231 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggagactg

SEQ ID NO: 38232 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggagact

SEQ ID NO: 38233 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctacttgg

SEQ ID NO: 38234 - DNA, 20 bp, Artificial Sequence
  Description of Artificial Sequence: Synthetic oligonucleotide
  Target: ATXN1; (-) strand; PAM type: NRG; PAM sequence: GGG
gtctgtagtcccagctactt

SEQ ID NO: 38235 - DNA, 20 bp, Artificial Sequence
  Description of Artificial Sequence: Synthetic oligonucleotide
  Target: ATXN1; (-) strand; PAM type: NRG; PAM sequence: TGG
tgtctgtagtcccagctact

SEQ ID NO: 38236 - DNA, 20 bp, Artificial Sequence
  Description of Artificial Sequence: Synthetic oligonucleotide
  Target: ATXN1; (-) strand; PAM type: NRG; PAM sequence: CAG
gtagcaggtgtctgtagtcc

SEQ ID NO: 38237 - DNA, 20 bp, Artificial Sequence
  Description of Artificial Sequence: Synthetic oligonucleotide
  Target: ATXN1; (-) strand; PAM type: NRG; PAM sequence: TAG
ggcgtggtagcaggtgtctg

SEQ ID NO: 38238 - DNA, 20 bp, Artificial Sequence
  Description of Artificial Sequence: Synthetic oligonucleotide
  Target: ATXN1; (-) strand; PAM type: NRG; PAM sequence: AGG
aattagctgggcgtggtagc

SEQ ID NO: 38239 - DNA, 20 bp, Artificial Sequence
  Description of Artificial Sequence: Synthetic oligonucleotide
  Target: ATXN1; (-) strand; PAM type: NRG; PAM sequence: CAG
aaattagctgggcgtggtag

SEQ ID NO: 38240 - DNA, 20 bp, Artificial Sequence
  Description of Artificial Sequence: Synthetic oligonucleotide
  Target: ATXN1; (-) strand; PAM type: NRG; PAM sequence: TAG
caaaaattagctgggcgtgg

SEQ ID NO: 38241 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagctgggcg

SEQ ID NO: 38242 - DNA, 20 bp, Artificial Sequence
  Description of Artificial Sequence: Synthetic oligonucleotide
  Target: ATXN1; (-) strand; PAM type: NRG; PAM sequence: GGG
aaaaaatacaaaaattagct

SEQ ID NO: 38243 - DNA, 20 bp, Artificial Sequence
  Description of Artificial Sequence: Synthetic oligonucleotide
  Target: ATXN1; (-) strand; PAM type: NRG; PAM sequence: TGG
taaaaaatacaaaaattagc

SEQ ID NO: 38244 - DNA, 20 bp, Artificial Sequence
  Description of Artificial Sequence: Synthetic oligonucleotide
  Target: ATXN1; (-) strand; PAM type: NRG; PAM sequence: TAG
tctataaaaaatacaaaaat

SEQ ID NO: 38245 - DNA, 20 bp, Artificial Sequence
  Description of Artificial Sequence: Synthetic oligonucleotide
  Target: ATXN1; (-) strand; PAM type: NRG; PAM sequence: GAG
accagtctgggcaacatggt

SEQ ID NO: 38246 - DNA, 20 bp, Artificial Sequence
  Description of Artificial Sequence: Synthetic oligonucleotide
  Target: ATXN1; (-) strand; PAM type: NRG; PAM sequence: TGG
tgagaccagtctgggcaaca

SEQ ID NO: 38247 - DNA, 20 bp, Artificial Sequence
  Description of Artificial Sequence: Synthetic oligonucleotide
  Target: ATXN1; (-) strand; PAM type: NRG; PAM sequence: GGG
ctggagtttgagaccagtct

SEQ ID NO: 38248 - DNA, 20 bp, Artificial Sequence
  Description of Artificial Sequence: Synthetic oligonucleotide
  Target: ATXN1; (-) strand; PAM type: NRG; PAM sequence: TGG
cctggagtttgagaccagtc

SEQ ID NO: 38249 - DNA, 20 bp, Artificial Sequence
  Description of Artificial Sequence: Synthetic oligonucleotide
  Target: ATXN1; (-) strand; PAM type: NRG; PAM sequence: CAG
tgagccctggagtttgagac

SEQ ID NO: 38250 - DNA, 20 bp, Artificial Sequence
  Description of Artificial Sequence: Synthetic oligonucleotide
  Target: ATXN1; (-) strand; PAM type: NRG; PAM sequence: GAG
tggcttgagccctggagttt

SEQ ID NO: 38251 - DNA, 20 bp, Artificial Sequence
  Description of Artificial Sequence: Synthetic oligonucleotide
  Target: ATXN1; (-) strand; PAM type: NRG; PAM sequence: GAG
ggtggatggcttgagccctg

SEQ ID NO: 38252 - DNA, 20 bp, Artificial Sequence
  Description of Artificial Sequence: Synthetic oligonucleotide
  Target: ATXN1; (-) strand; PAM type: NRG; PAM sequence: TGG
caggtggatggcttgagccc

SEQ ID NO: 38253 - DNA, 20 bp, Artificial Sequence
  Description of Artificial Sequence: Synthetic oligonucleotide
  Target: ATXN1; (-) strand; PAM type: NRG; PAM sequence: GAG
ttgacgcaggtggatggctt

SEQ ID NO: 38254 - DNA, 20 bp, Artificial Sequence
  Description of Artificial Sequence: Synthetic oligonucleotide
  Target: ATXN1; (-) strand; PAM type: NRG; PAM sequence: TGG
gggaggttgacgcaggtgga

SEQ ID NO: 38255 - DNA, 20 bp, Artificial Sequence
  Description of Artificial Sequence: Synthetic oligonucleotide
  Target: ATXN1; (-) strand; PAM type: NRG; PAM sequence: TGG
tttggggaggttgacgcagg

SEQ ID NO: 38256 - DNA, 20 bp, Artificial Sequence
  Description of Artificial Sequence: Synthetic oligonucleotide
  Target: ATXN1; (-) strand; PAM type: NRG; PAM sequence: AGG
cactttggggaggttgacgc

SEQ ID NO: 38257 - DNA, 20 bp, Artificial Sequence
  Description of Artificial Sequence: Synthetic oligonucleotide
  Target: ATXN1; (-) strand; PAM type: NRG; PAM sequence: CAG
gcactttggggaggttgacg

SEQ ID NO: 38258 - DNA, 20 bp, Artificial Sequence
  Description of Artificial Sequence: Synthetic oligonucleotide
  Target: ATXN1; (-) strand; PAM type: NRG; PAM sequence: AGG
gtaatcctagcactttgggg

SEQ ID NO: 38259 - DNA, 20 bp, Artificial Sequence
  Description of Artificial Sequence: Synthetic oligonucleotide
  Target: ATXN1; (-) strand; PAM type: NRG; PAM sequence: GAG
tgtaatcctagcactttggg

SEQ ID NO: 38260 - DNA, 20 bp, Artificial Sequence
  Description of Artificial Sequence: Synthetic oligonucleotide
  Target: ATXN1; (-) strand; PAM type: NRG; PAM sequence: GGG
cctgtaatcctagcactttg

SEQ ID NO: 38261 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcctagcacttt

SEQ ID NO: 38262 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcctagcactt

SEQ ID NO: 38263 - DNA, 20 bp, Artificial Sequence
  Description of Artificial Sequence: Synthetic oligonucleotide
  Target: ATXN1; (-) strand; PAM type: NRG; PAM sequence: TAG
gtggctcacacctgtaatcc

SEQ ID NO: 38264 - DNA, 20 bp, Artificial Sequence
  Description of Artificial Sequence: Synthetic oligonucleotide
  Target: ATXN1; (-) strand; PAM type: NRG; PAM sequence: TGG
tcttaatgggccgggcacag

SEQ ID NO: 38265 - DNA, 20 bp, Artificial Sequence
  Description of Artificial Sequence: Synthetic oligonucleotide
  Target: ATXN1; (-) strand; PAM type: NRG; PAM sequence: CAG
tattcttaatgggccgggca

SEQ ID NO: 38266 - DNA, 20 bp, Artificial Sequence
  Description of Artificial Sequence: Synthetic oligonucleotide
  Target: ATXN1; (-) strand; PAM type: NRG; PAM sequence: GGG
agagttattcttaatgggcc

SEQ ID NO: 38267 - DNA, 20 bp, Artificial Sequence
  Description of Artificial Sequence: Synthetic oligonucleotide
  Target: ATXN1; (-) strand; PAM type: NRG; PAM sequence: CGG
aagagttattcttaatgggc

SEQ ID NO: 38268 - DNA, 20 bp, Artificial Sequence
  Description of Artificial Sequence: Synthetic oligonucleotide
  Target: ATXN1; (-) strand; PAM type: NRG; PAM sequence: GGG
gtgcaagagttattcttaat

SEQ ID NO: 38269 - DNA, 20 bp, Artificial Sequence
  Description of Artificial Sequence: Synthetic oligonucleotide
  Target: ATXN1; (-) strand; PAM type: NRG; PAM sequence: TGG
ggtgcaagagttattcttaa

SEQ ID NO: 38270 - DNA, 20 bp, Artificial Sequence
  Description of Artificial Sequence: Synthetic oligonucleotide
  Target: ATXN1; (-) strand; PAM type: NRG; PAM sequence: GAG
ttgtgtttctacaggtgcaa

SEQ ID NO: 38271 - DNA, 20 bp, Artificial Sequence
  Description of Artificial Sequence: Synthetic oligonucleotide
  Target: ATXN1; (-) strand; PAM type: NRG; PAM sequence: AAG
ccttgtgtttctacaggtgc

SEQ ID NO: 38272 - DNA, 20 bp, Artificial Sequence
  Description of Artificial Sequence: Synthetic oligonucleotide
  Target: ATXN1; (-) strand; PAM type: NRG; PAM sequence: AGG
tgcagcccttgtgtttctac

SEQ ID NO: 38273 - DNA, 20 bp, Artificial Sequence
  Description of Artificial Sequence: Synthetic oligonucleotide
  Target: ATXN1; (-) strand; PAM type: NRG; PAM sequence: CAG
gtgcagcccttgtgtttcta

SEQ ID NO: 38274 - DNA, 20 bp, Artificial Sequence
  Description of Artificial Sequence: Synthetic oligonucleotide
  Target: ATXN1; (-) strand; PAM type: NRG; PAM sequence: CAG
gccctcccgtctccaaagtg

SEQ ID NO: 38275 - DNA, 20 bp, Artificial Sequence
  Description of Artificial Sequence: Synthetic oligonucleotide
  Target: ATXN1; (-) strand; PAM type: NRG; PAM sequence: AAG
tcttggccctcccgtctcca

SEQ ID NO: 38276 - DNA, 20 bp, Artificial Sequence
  Description of Artificial Sequence: Synthetic oligonucleotide
  Target: ATXN1; (-) strand; PAM type: NRG; PAM sequence: TGG
ctccacgttaaatcgcctct

SEQ ID NO: 38277 - DNA, 20 bp, Artificial Sequence
  Description of Artificial Sequence: Synthetic oligonucleotide
  Target: ATXN1; (-) strand; PAM type: NRG; PAM sequence: AAG
aaggcggggagcctgcagcc

SEQ ID NO: 38278 - DNA, 20 bp, Artificial Sequence
  Description of Artificial Sequence: Synthetic oligonucleotide
  Target: ATXN1; (-) strand; PAM type: NRG; PAM sequence: CAG
agagcaaggcggggagcctg

SEQ ID NO: 38279 - DNA, 20 bp, Artificial Sequence
  Description of Artificial Sequence: Synthetic oligonucleotide
  Target: ATXN1; (-) strand; PAM type: NRG; PAM sequence: GAG
accacagagagcaaggcggg

SEQ ID NO: 38280 - DNA, 20 bp, Artificial Sequence
  Description of Artificial Sequence: Synthetic oligonucleotide
  Target: ATXN1; (-) strand; PAM type: NRG; PAM sequence: GGG
agaccacagagagcaaggcg

SEQ ID NO: 38281 - DNA, 20 bp, Artificial Sequence
  Description of Artificial Sequence: Synthetic oligonucleotide
  Target: ATXN1; (-) strand; PAM type: NRG; PAM sequence: GGG
aagaccacagagagcaaggc

SEQ ID NO: 38282 - DNA, 20 bp, Artificial Sequence
  Description of Artificial Sequence: Synthetic oligonucleotide
  Target: ATXN1; (-) strand; PAM type: NRG; PAM sequence: CGG
gaagaccacagagagcaagg

SEQ ID NO: 38283 - DNA, 20 bp, Artificial Sequence
  Description of Artificial Sequence: Synthetic oligonucleotide
  Target: ATXN1; (-) strand; PAM type: NRG; PAM sequence: AGG
ctggaagaccacagagagca

SEQ ID NO: 38284 - DNA, 20 bp, Artificial Sequence
  Description of Artificial Sequence: Synthetic oligonucleotide
  Target: ATXN1; (-) strand; PAM type: NRG; PAM sequence: AAG
gctggaagaccacagagagc

SEQ ID NO: 38285 - DNA, 20 bp, Artificial Sequence
  Description of Artificial Sequence: Synthetic oligonucleotide
  Target: ATXN1; (-) strand; PAM type: NRG; PAM sequence: GAG
agcagctggaagaccacaga

SEQ ID NO: 38286 - DNA, 20 bp, Artificial Sequence
  Description of Artificial Sequence: Synthetic oligonucleotide
  Target: ATXN1; (-) strand; PAM type: NRG; PAM sequence: GAG
caagcagctggaagaccaca

SEQ ID NO: 38287 - DNA, 20 bp, Artificial Sequence
  Description of Artificial Sequence: Synthetic oligonucleotide
  Target: ATXN1; (-) strand; PAM type: NRG; PAM sequence: CAG
tacaagcagctggaagacca

SEQ ID NO: 38288 - DNA, 20 bp, Artificial Sequence
  Description of Artificial Sequence: Synthetic oligonucleotide
  Target: ATXN1; (-) strand; PAM type: NRG; PAM sequence: AAG
actcagttacaagcagctgg

SEQ ID NO: 38289 - DNA, 20 bp, Artificial Sequence
  Description of Artificial Sequence: Synthetic oligonucleotide
  Target: ATXN1; (-) strand; PAM type: NRG; PAM sequence: TGG
actactcagttacaagcagc

SEQ ID NO: 38290 - DNA, 20 bp, Artificial Sequence
  Description of Artificial Sequence: Synthetic oligonucleotide
  Target: ATXN1; (-) strand; PAM type: NRG; PAM sequence: CAG
tgtaactactcagttacaag

SEQ ID NO: 38291 - DNA, 20 bp, Artificial Sequence
  Description of Artificial Sequence: Synthetic oligonucleotide
  Target: ATXN1; (-) strand; PAM type: NRG; PAM sequence: AAG
ttttgtaactactcagttac

SEQ ID NO: 38292 - DNA, 20 bp, Artificial Sequence
  Description of Artificial Sequence: Synthetic oligonucleotide
  Target: ATXN1; (-) strand; PAM type: NRG; PAM sequence: CAG
tttttgattttgtaactact

SEQ ID NO: 38293 - DNA, 20 bp, Artificial Sequence
  Description of Artificial Sequence: Synthetic oligonucleotide
  Target: ATXN1; (-) strand; PAM type: NRG; PAM sequence: GAG
tgcttcaaaatggtcctaac

SEQ ID NO: 38294 - DNA, 20 bp, Artificial Sequence
  Description of Artificial Sequence: Synthetic oligonucleotide
  Target: ATXN1; (-) strand; PAM type: NRG; PAM sequence: TGG
ctgaaggctctgcttcaaaa

SEQ ID NO: 38295 - DNA, 20 bp, Artificial Sequence
  Description of Artificial Sequence: Synthetic oligonucleotide
  Target: ATXN1; (-) strand; PAM type: NRG; PAM sequence: AGG
aaaagacattctctttctga

SEQ ID NO: 38296 - DNA, 20 bp, Artificial Sequence
  Description of Artificial Sequence: Synthetic oligonucleotide
  Target: ATXN1; (-) strand; PAM type: NRG; PAM sequence: AAG
aaaaagacattctctttctg

SEQ ID NO: 38297 - DNA, 20 bp, Artificial Sequence
  Description of Artificial Sequence: Synthetic oligonucleotide
  Target: ATXN1; (-) strand; PAM type: NRG; PAM sequence: AAG
caggaaaaaaaaaaaaaaaa

SEQ ID NO: 38298 - DNA, 20 bp, Artificial Sequence
  Description of Artificial Sequence: Synthetic oligonucleotide
  Target: ATXN1; (-) strand; PAM type: NRG; PAM sequence: AGG
acagagcaagacttggtctc

SEQ ID NO: 38299 - DNA, 20 bp, Artificial Sequence
  Description of Artificial Sequence: Synthetic oligonucleotide
  Target: ATXN1; (-) strand; PAM type: NRG; PAM sequence: CAG
gacagagcaagacttggtct

SEQ ID NO: 38300 - DNA, 20 bp, Artificial Sequence
  Description of Artificial Sequence: Synthetic oligonucleotide
  Target: ATXN1; (-) strand; PAM type: NRG; PAM sequence: TGG
ctgggtgacagagcaagact

SEQ ID NO: 38301 - DNA, 20 bp, Artificial Sequence
  Description of Artificial Sequence: Synthetic oligonucleotide
  Target: ATXN1; (-) strand; PAM type: NRG; PAM sequence: AAG
ctctgcctgggtgacagagc

SEQ ID NO: 38302 - DNA, 20 bp, Artificial Sequence
  Description of Artificial Sequence: Synthetic oligonucleotide
  Target: ATXN1; (-) strand; PAM type: NRG; PAM sequence: GAG
tgcactctgcctgggtgaca

SEQ ID NO: 38303 - DNA, 20 bp, Artificial Sequence
  Description of Artificial Sequence: Synthetic oligonucleotide
  Target: ATXN1; (-) strand; PAM type: NRG; PAM sequence: CAG
actgcactctgcctgggtga

SEQ ID NO: 38304 - DNA, 20 bp, Artificial Sequence
  Description of Artificial Sequence: Synthetic oligonucleotide
  Target: ATXN1; (-) strand; PAM type: NRG; PAM sequence: GGG
tgtgccactgcactctgcct

SEQ ID NO: 38305 - DNA, 20 bp, Artificial Sequence
  Description of Artificial Sequence: Synthetic oligonucleotide
  Target: ATXN1; (-) strand; PAM type: NRG; PAM sequence: TGG
ttgtgccactgcactctgcc

SEQ ID NO: 38306 - DNA, 20 bp, Artificial Sequence
  Description of Artificial Sequence: Synthetic oligonucleotide
  Target: ATXN1; (-) strand; PAM type: NRG; PAM sequence: GAG
ggcggaggttgcagtgagcc

SEQ ID NO: 38307 - DNA, 20 bp, Artificial Sequence
  Description of Artificial Sequence: Synthetic oligonucleotide
  Target: ATXN1; (-) strand; PAM type: NRG; PAM sequence: GAG
tgggaggcggaggttgcagt

SEQ ID NO: 38308 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggcggaggttg

SEQ ID NO: 38309 - DNA, 20 bp, Artificial Sequence
  Description of Artificial Sequence: Synthetic oligonucleotide
  Target: ATXN1; (-) strand; PAM type: NRG; PAM sequence: AGG
cacttgaacctgggaggcgg

SEQ ID NO: 38310 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacctgggaggcg

SEQ ID NO: 38311 - DNA, 20 bp, Artificial Sequence
  Description of Artificial Sequence: Synthetic oligonucleotide
  Target: ATXN1; (-) strand; PAM type: NRG; PAM sequence: CGG
aatcacttgaacctgggagg

SEQ ID NO: 38312 - DNA, 20 bp, Artificial Sequence
  Description of Artificial Sequence: Synthetic oligonucleotide
  Target: ATXN1; (-) strand; PAM type: NRG; PAM sequence: AGG
gagaatcacttgaacctggg

SEQ ID NO: 38313 - DNA, 20 bp, Artificial Sequence
  Description of Artificial Sequence: Synthetic oligonucleotide
  Target: ATXN1; (-) strand; PAM type: NRG; PAM sequence: GAG
cgagaatcacttgaacctgg

SEQ ID NO: 38314 - DNA, 20 bp, Artificial Sequence
  Description of Artificial Sequence: Synthetic oligonucleotide
  Target: ATXN1; (-) strand; PAM type: NRG; PAM sequence: GGG
cacgagaatcacttgaacct

SEQ ID NO: 38315 - DNA, 20 bp, Artificial Sequence
  Description of Artificial Sequence: Synthetic oligonucleotide
  Target: ATXN1; (-) strand; PAM type: NRG; PAM sequence: TGG
gcacgagaatcacttgaacc

SEQ ID NO: 38316 - DNA, 20 bp, Artificial Sequence
  Description of Artificial Sequence: Synthetic oligonucleotide
  Target: ATXN1; (-) strand; PAM type: NRG; PAM sequence: GAG
tactctgaaggctgaggcac

SEQ ID NO: 38317 - DNA, 20 bp, Artificial Sequence
  Description of Artificial Sequence: Synthetic oligonucleotide
  Target: ATXN1; (-) strand; PAM type: NRG; PAM sequence: AGG
cccggctactctgaaggctg

SEQ ID NO: 38318 - DNA, 20 bp, Artificial Sequence
  Description of Artificial Sequence: Synthetic oligonucleotide
  Target: ATXN1; (-) strand; PAM type: NRG; PAM sequence: GAG
tcccggctactctgaaggct

SEQ ID NO: 38319 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccggctactctga

SEQ ID NO: 38320 - DNA, 20 bp, Artificial Sequence
  Description of Artificial Sequence: Synthetic oligonucleotide
  Target: ATXN1; (-) strand; PAM type: NRG; PAM sequence: AAG
ctgtaatcccggctactctg

SEQ ID NO: 38321 - DNA, 20 bp, Artificial Sequence
  Description of Artificial Sequence: Synthetic oligonucleotide
  Target: ATXN1; (-) strand; PAM type: NRG; PAM sequence: CGG
gtggcgggcacctgtaatcc

SEQ ID NO: 38322 - DNA, 20 bp, Artificial Sequence
  Description of Artificial Sequence: Synthetic oligonucleotide
  Target: ATXN1; (-) strand; PAM type: NRG; PAM sequence: GGG
aaacattagccagacgtggc

SEQ ID NO: 38323 - DNA, 20 bp, Artificial Sequence
  Description of Artificial Sequence: Synthetic oligonucleotide
  Target: ATXN1; (-) strand; PAM type: NRG; PAM sequence: CGG
taaacattagccagacgtgg

SEQ ID NO: 38324 - DNA, 20 bp, Artificial Sequence
  Description of Artificial Sequence: Synthetic oligonucleotide
  Target: ATXN1; (-) strand; PAM type: NRG; PAM sequence: TGG
acataaacattagccagacg

SEQ ID NO: 38325 - DNA, 20 bp, Artificial Sequence
  Description of Artificial Sequence: Synthetic oligonucleotide
  Target: ATXN1; (-) strand; PAM type: NRG; PAM sequence: CAG
ctaaaaacataaacattagc

SEQ ID NO: 38326 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaacataaacat

SEQ ID NO: 38327 - DNA, 20 bp, Artificial Sequence
  Description of Artificial Sequence: Synthetic oligonucleotide
  Target: ATXN1; (-) strand; PAM type: NRG; PAM sequence: TGG
tgagaccagcctgggtaaca

SEQ ID NO: 38328 - DNA, 20 bp, Artificial Sequence
  Description of Artificial Sequence: Synthetic oligonucleotide
  Target: ATXN1; (-) strand; PAM type: NRG; PAM sequence: GGG
caggagtttgagaccagcct

SEQ ID NO: 38329 - DNA, 20 bp, Artificial Sequence
  Description of Artificial Sequence: Synthetic oligonucleotide
  Target: ATXN1; (-) strand; PAM type: NRG; PAM sequence: TGG
ccaggagtttgagaccagcc

SEQ ID NO: 38330 - DNA, 20 bp, Artificial Sequence
  Description of Artificial Sequence: Synthetic oligonucleotide
  Target: ATXN1; (-) strand; PAM type: NRG; PAM sequence: CAG
cgagcccaggagtttgagac

SEQ ID NO: 38331 - DNA, 20 bp, Artificial Sequence
  Description of Artificial Sequence: Synthetic oligonucleotide
  Target: ATXN1; (-) strand; PAM type: NRG; PAM sequence: GAG
tcacccgagcccaggagttt

SEQ ID NO: 38332 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacccgagcccag

SEQ ID NO: 38333 - DNA, 20 bp, Artificial Sequence
  Description of Artificial Sequence: Synthetic oligonucleotide
  Target: ATXN1; (-) strand; PAM type: NRG; PAM sequence: AGG
tgggtggatcacccgagccc

SEQ ID NO: 38334 - DNA, 20 bp, Artificial Sequence
  Description of Artificial Sequence: Synthetic oligonucleotide
  Target: ATXN1; (-) strand; PAM type: NRG; PAM sequence: CAG
gtgggtggatcacccgagcc

SEQ ID NO: 38335 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggtggatcaccc

SEQ ID NO: 38336 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggctgaggtggg

SEQ ID NO: 38337 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggctgaggt

SEQ ID NO: 38338 - DNA, 20 bp, Artificial Sequence
  Description of Artificial Sequence: Synthetic oligonucleotide
  Target: ATXN1; (-) strand; PAM type: NRG; PAM sequence: TGG
agcactttgggaggctgagg

SEQ ID NO: 38339 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggctg

SEQ ID NO: 38340 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggct

SEQ ID NO: 38341 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 38342 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 38343 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagcacttt

SEQ ID NO: 38344 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagcactt

SEQ ID NO: 38345 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatcc

SEQ ID NO: 38346 - DNA, 20 bp, Artificial Sequence
  Description of Artificial Sequence: Synthetic oligonucleotide
  Target: ATXN1; (-) strand; PAM type: NRG; PAM sequence: TGG
tctttatgggccaggcgcgg

SEQ ID NO: 38347 - DNA, 20 bp, Artificial Sequence
  Description of Artificial Sequence: Synthetic oligonucleotide
  Target: ATXN1; (-) strand; PAM type: NRG; PAM sequence: CGG
ttctctttatgggccaggcg

SEQ ID NO: 38348 - DNA, 20 bp, Artificial Sequence
  Description of Artificial Sequence: Synthetic oligonucleotide
  Target: ATXN1; (-) strand; PAM type: NRG; PAM sequence: AGG
acaagttctctttatgggcc

SEQ ID NO: 38349 - DNA, 20 bp, Artificial Sequence
  Description of Artificial Sequence: Synthetic oligonucleotide
  Target: ATXN1; (-) strand; PAM type: NRG; PAM sequence: CAG
tacaagttctctttatgggc

SEQ ID NO: 38350 - DNA, 20 bp, Artificial Sequence
  Description of Artificial Sequence: Synthetic oligonucleotide
  Target: ATXN1; (-) strand; PAM type: NRG; PAM sequence: GGG
gccttacaagttctctttat

SEQ ID NO: 38351 - DNA, 20 bp, Artificial Sequence
  Description of Artificial Sequence: Synthetic oligonucleotide
  Target: ATXN1; (-) strand; PAM type: NRG; PAM sequence: TGG
agccttacaagttctcttta

SEQ ID NO: 38352 - DNA, 20 bp, Artificial Sequence
  Description of Artificial Sequence: Synthetic oligonucleotide
  Target: ATXN1; (-) strand; PAM type: NRG; PAM sequence: AAG
aaacggtgacggagccttac

SEQ ID NO: 38353 - DNA, 20 bp, Artificial Sequence
  Description of Artificial Sequence: Synthetic oligonucleotide
  Target: ATXN1; (-) strand; PAM type: NRG; PAM sequence: GAG
tgctaaggcaaacggtgacg

SEQ ID NO: 38354 - DNA, 20 bp, Artificial Sequence
  Description of Artificial Sequence: Synthetic oligonucleotide
  Target: ATXN1; (-) strand; PAM type: NRG; PAM sequence: CGG
cctgctaaggcaaacggtga

SEQ ID NO: 38355 - DNA, 20 bp, Artificial Sequence
  Description of Artificial Sequence: Synthetic oligonucleotide
  Target: ATXN1; (-) strand; PAM type: NRG; PAM sequence: CGG
gatgaacctgctaaggcaaa

SEQ ID NO: 38356 - DNA, 20 bp, Artificial Sequence
  Description of Artificial Sequence: Synthetic oligonucleotide
  Target: ATXN1; (-) strand; PAM type: NRG; PAM sequence: AGG
aggcagagatgaacctgcta

SEQ ID NO: 38357 - DNA, 20 bp, Artificial Sequence
  Description of Artificial Sequence: Synthetic oligonucleotide
  Target: ATXN1; (-) strand; PAM type: NRG; PAM sequence: AAG
gaggcagagatgaacctgct

SEQ ID NO: 38358 - DNA, 20 bp, Artificial Sequence
  Description of Artificial Sequence: Synthetic oligonucleotide
  Target: ATXN1; (-) strand; PAM type: NRG; PAM sequence: GAG
ccccactcctatcagaggca

SEQ ID NO: 38359 - DNA, 20 bp, Artificial Sequence
  Description of Artificial Sequence: Synthetic oligonucleotide
  Target: ATXN1; (-) strand; PAM type: NRG; PAM sequence: CAG
agccccactcctatcagagg

SEQ ID NO: 38360 - DNA, 20 bp, Artificial Sequence
  Description of Artificial Sequence: Synthetic oligonucleotide
  Target: ATXN1; (-) strand; PAM type: NRG; PAM sequence: AGG
cccagccccactcctatcag

SEQ ID NO: 38361 - DNA, 20 bp, Artificial Sequence
  Description of Artificial Sequence: Synthetic oligonucleotide
  Target: ATXN1; (-) strand; PAM type: NRG; PAM sequence: GAG
ccccagccccactcctatca

SEQ ID NO: 38362 - DNA, 20 bp, Artificial Sequence
  Description of Artificial Sequence: Synthetic oligonucleotide
  Target: ATXN1; (-) strand; PAM type: NRG; PAM sequence: CAG
tcccccagccccactcctat

SEQ ID NO: 38363 - DNA, 20 bp, Artificial Sequence
  Description of Artificial Sequence: Synthetic oligonucleotide
  Target: ATXN1; (-) strand; PAM type: NRG; PAM sequence: CAG
cactctggtgtgggctcccc

SEQ ID NO: 38364 - DNA, 20 bp, Artificial Sequence
  Description of Artificial Sequence: Synthetic oligonucleotide
  Target: ATXN1; (-) strand; PAM type: NRG; PAM sequence: GGG
tccaagggacactctggtgt

SEQ ID NO: 38365 - DNA, 20 bp, Artificial Sequence
  Description of Artificial Sequence: Synthetic oligonucleotide
  Target: ATXN1; (-) strand; PAM type: NRG; PAM sequence: TGG
gtccaagggacactctggtg

SEQ ID NO: 38366 - DNA, 20 bp, Artificial Sequence
  Description of Artificial Sequence: Synthetic oligonucleotide
  Target: ATXN1; (-) strand; PAM type: NRG; PAM sequence: TGG
acccggtccaagggacactc

SEQ ID NO: 38367 - DNA, 20 bp, Artificial Sequence
  Description of Artificial Sequence: Synthetic oligonucleotide
  Target: ATXN1; (-) strand; PAM type: NRG; PAM sequence: GGG
ctgtgggacacccggtccaa

SEQ ID NO: 38368 - DNA, 20 bp, Artificial Sequence
  Description of Artificial Sequence: Synthetic oligonucleotide
  Target: ATXN1; (-) strand; PAM type: NRG; PAM sequence: AGG
cctgtgggacacccggtcca

SEQ ID NO: 38369 - DNA, 20 bp, Artificial Sequence
  Description of Artificial Sequence: Synthetic oligonucleotide
  Target: ATXN1; (-) strand; PAM type: NRG; PAM sequence: AAG
tcctgtgggacacccggtcc

SEQ ID NO: 38370 - DNA, 20 bp, Artificial Sequence
  Description of Artificial Sequence: Synthetic oligonucleotide
  Target: ATXN1; (-) strand; PAM type: NRG; PAM sequence: CGG
tccaggtcctgtgggacacc

SEQ ID NO: 38371 - DNA, 20 bp, Artificial Sequence
  Description of Artificial Sequence: Synthetic oligonucleotide
  Target: ATXN1; (-) strand; PAM type: NRG; PAM sequence: GGG
gcttcatctccaggtcctgt

SEQ ID NO: 38372 - DNA, 20 bp, Artificial Sequence
  Description of Artificial Sequence: Synthetic oligonucleotide
  Target: ATXN1; (-) strand; PAM type: NRG; PAM sequence: TGG
tgcttcatctccaggtcctg

SEQ ID NO: 38373 - DNA, 20 bp, Artificial Sequence
  Description of Artificial Sequence: Synthetic oligonucleotide
  Target: ATXN1; (-) strand; PAM type: NRG; PAM sequence: AGG
aagctgcatgcttcatctcc

SEQ ID NO: 38374 - DNA, 20 bp, Artificial Sequence
  Description of Artificial Sequence: Synthetic oligonucleotide
  Target: ATXN1; (-) strand; PAM type: NRG; PAM sequence: CAG
aaagctgcatgcttcatctc

SEQ ID NO: 38375 - DNA, 20 bp, Artificial Sequence
  Description of Artificial Sequence: Synthetic oligonucleotide
  Target: ATXN1; (-) strand; PAM type: NRG; PAM sequence: AAG
agcccagtgggtcagcagca

SEQ ID NO: 38376 - DNA, 20 bp, Artificial Sequence
  Description of Artificial Sequence: Synthetic oligonucleotide
  Target: ATXN1; (-) strand; PAM type: NRG; PAM sequence: CAG
caggaagcccagtgggtcag

SEQ ID NO: 38377 - DNA, 20 bp, Artificial Sequence
  Description of Artificial Sequence: Synthetic oligonucleotide
  Target: ATXN1; (-) strand; PAM type: NRG; PAM sequence: CAG
gcacaggaagcccagtgggt

SEQ ID NO: 38378 - DNA, 20 bp, Artificial Sequence
  Description of Artificial Sequence: Synthetic oligonucleotide
  Target: ATXN1; (-) strand; PAM type: NRG; PAM sequence: GGG
tctggcacaggaagcccagt

SEQ ID NO: 38379 - DNA, 20 bp, Artificial Sequence
  Description of Artificial Sequence: Synthetic oligonucleotide
  Target: ATXN1; (-) strand; PAM type: NRG; PAM sequence: TGG
ctctggcacaggaagcccag

SEQ ID NO: 38380 - DNA, 20 bp, Artificial Sequence
  Description of Artificial Sequence: Synthetic oligonucleotide
  Target: ATXN1; (-) strand; PAM type: NRG; PAM sequence: CAG
cagctctggcacaggaagcc

SEQ ID NO: 38381 - DNA, 20 bp, Artificial Sequence
  Description of Artificial Sequence: Synthetic oligonucleotide
  Target: ATXN1; (-) strand; PAM type: NRG; PAM sequence: AAG
tcccccagctctggcacagg

SEQ ID NO: 38382 - DNA, 20 bp, Artificial Sequence
  Description of Artificial Sequence: Synthetic oligonucleotide
  Target: ATXN1; (-) strand; PAM type: NRG; PAM sequence: AGG
tcctcccccagctctggcac

SEQ ID NO: 38383 - DNA, 20 bp, Artificial Sequence
  Description of Artificial Sequence: Synthetic oligonucleotide
  Target: ATXN1; (-) strand; PAM type: NRG; PAM sequence: CAG
ctcctcccccagctctggca

SEQ ID NO: 38384 - DNA, 20 bp, Artificial Sequence
  Description of Artificial Sequence: Synthetic oligonucleotide
  Target: ATXN1; (-) strand; PAM type: NRG; PAM sequence: TGG
tcctcctcctcccccagctc

SEQ ID NO: 38385 - DNA, 20 bp, Artificial Sequence
  Description of Artificial Sequence: Synthetic oligonucleotide
  Target: ATXN1; (-) strand; PAM type: NRG; PAM sequence: CAG
tggctgtcctcctcctcccc

SEQ ID NO: 38386 - DNA, 20 bp, Artificial Sequence
  Description of Artificial Sequence: Synthetic oligonucleotide
  Target: ATXN1; (-) strand; PAM type: NRG; PAM sequence: TGG
gcaaatggcgtcgagttcac

SEQ ID NO: 38387 - DNA, 20 bp, Artificial Sequence
  Description of Artificial Sequence: Synthetic oligonucleotide
  Target: ATXN1; (-) strand; PAM type: NRG; PAM sequence: GAG
ggcccaaggcaaatggcgtc

SEQ ID NO: 38388 - DNA, 20 bp, Artificial Sequence
  Description of Artificial Sequence: Synthetic oligonucleotide
  Target: ATXN1; (-) strand; PAM type: NRG; PAM sequence: TGG
ccagagtggcccaaggcaaa

SEQ ID NO: 38389 - DNA, 20 bp, Artificial Sequence
  Description of Artificial Sequence: Synthetic oligonucleotide
  Target: ATXN1; (-) strand; PAM type: NRG; PAM sequence: AGG
ggaacggccagagtggccca

SEQ ID NO: 38390 - DNA, 20 bp, Artificial Sequence
  Description of Artificial Sequence: Synthetic oligonucleotide
  Target: ATXN1; (-) strand; PAM type: NRG; PAM sequence: AAG
tggaacggccagagtggccc

SEQ ID NO: 38391 - DNA, 20 bp, Artificial Sequence
  Description of Artificial Sequence: Synthetic oligonucleotide
  Target: ATXN1; (-) strand; PAM type: NRG; PAM sequence: TGG
ctcagatggaacggccagag

SEQ ID NO: 38392 - DNA, 20 bp, Artificial Sequence
  Description of Artificial Sequence: Synthetic oligonucleotide
  Target: ATXN1; (-) strand; PAM type: NRG; PAM sequence: GAG
gccctcagatggaacggcca

SEQ ID NO: 38393 - DNA, 20 bp, Artificial Sequence
  Description of Artificial Sequence: Synthetic oligonucleotide
  Target: ATXN1; (-) strand; PAM type: NRG; PAM sequence: CAG
gagccctcagatggaacggc

SEQ ID NO: 38394 - DNA, 20 bp, Artificial Sequence
  Description of Artificial Sequence: Synthetic oligonucleotide
  Target: ATXN1; (-) strand; PAM type: NRG; PAM sequence: CGG
gccagagccctcagatggaa

SEQ ID NO: 38395 - DNA, 20 bp, Artificial Sequence
  Description of Artificial Sequence: Synthetic oligonucleotide
  Target: ATXN1; (-) strand; PAM type: NRG; PAM sequence: TGG
gcactgccagagccctcaga

SEQ ID NO: 38396 - DNA, 20 bp, Artificial Sequence
  Description of Artificial Sequence: Synthetic oligonucleotide
  Target: ATXN1; (-) strand; PAM type: NRG; PAM sequence: CAG
aaaagcactgccagagccct

SEQ ID NO: 38397 - DNA, 20 bp, Artificial Sequence
  Description of Artificial Sequence: Synthetic oligonucleotide
  Target: ATXN1; (-) strand; PAM type: NRG; PAM sequence: GAG
aaccatcaaaagcactgcca

SEQ ID NO: 38398 - DNA, 20 bp, Artificial Sequence
  Description of Artificial Sequence: Synthetic oligonucleotide
  Target: ATXN1; (-) strand; PAM type: NRG; PAM sequence: CAG
gaaaccatcaaaagcactgc

SEQ ID NO: 38399 - DNA, 20 bp, Artificial Sequence
  Description of Artificial Sequence: Synthetic oligonucleotide
  Target: ATXN1; (-) strand; PAM type: NRG; PAM sequence: AAG
gcaggacttgaaaccatcaa

SEQ ID NO: 38400 - DNA, 20 bp, Artificial Sequence
  Description of Artificial Sequence: Synthetic oligonucleotide
  Target: ATXN1; (-) strand; PAM type: NRG; PAM sequence: AGG
ttcaggtgctgcagcggggc

SEQ ID NO: 38401 - DNA, 20 bp, Artificial Sequence
  Description of Artificial Sequence: Synthetic oligonucleotide
  Target: ATXN1; (-) strand; PAM type: NRG; PAM sequence: CAG
cttcaggtgctgcagcgggg

SEQ ID NO: 38402 - DNA, 20 bp, Artificial Sequence
  Description of Artificial Sequence: Synthetic oligonucleotide
  Target: ATXN1; (-) strand; PAM type: NRG; PAM sequence: GGG
taccttcaggtgctgcagcg

SEQ ID NO: 38403 - DNA, 20 bp, Artificial Sequence
  Description of Artificial Sequence: Synthetic oligonucleotide
  Target: ATXN1; (-) strand; PAM type: NRG; PAM sequence: GGG
ataccttcaggtgctgcagc

SEQ ID NO: 38404 - DNA, 20 bp, Artificial Sequence
  Description of Artificial Sequence: Synthetic oligonucleotide
  Target: ATXN1; (-) strand; PAM type: NRG; PAM sequence: CGG
cataccttcaggtgctgcag

SEQ ID NO: 38405 - DNA, 20 bp, Artificial Sequence
  Description of Artificial Sequence: Synthetic oligonucleotide
  Target: ATXN1; (-) strand; PAM type: NRG; PAM sequence: CAG
aaccataccttcaggtgctg

SEQ ID NO: 38406 - DNA, 20 bp, Artificial Sequence
  Description of Artificial Sequence: Synthetic oligonucleotide
  Target: ATXN1; (-) strand; PAM type: NRG; PAM sequence: AGG
ttagggggaaccataccttc

SEQ ID NO: 38407 - DNA, 20 bp, Artificial Sequence
  Description of Artificial Sequence: Synthetic oligonucleotide
  Target: ATXN1; (-) strand; PAM type: NRG; PAM sequence: CAG
attagggggaaccatacctt

SEQ ID NO: 38408 - DNA, 20 bp, Artificial Sequence
  Description of Artificial Sequence: Synthetic oligonucleotide
  Target: ATXN1; (-) strand; PAM type: NRG; PAM sequence: GGG
agctggtgaaatcaattagg

SEQ ID NO: 38409 - DNA, 20 bp, Artificial Sequence
  Description of Artificial Sequence: Synthetic oligonucleotide
  Target: ATXN1; (-) strand; PAM type: NRG; PAM sequence: GGG
cagctggtgaaatcaattag

SEQ ID NO: 38410 - DNA, 20 bp, Artificial Sequence
  Description of Artificial Sequence: Synthetic oligonucleotide
  Target: ATXN1; (-) strand; PAM type: NRG; PAM sequence: GGG
tcagctggtgaaatcaatta

SEQ ID NO: 38411 - DNA, 20 bp, Artificial Sequence
  Description of Artificial Sequence: Synthetic oligonucleotide
  Target: ATXN1; (-) strand; PAM type: NRG; PAM sequence: AGG
ctcagctggtgaaatcaatt

SEQ ID NO: 38412 - DNA, 20 bp, Artificial Sequence
  Description of Artificial Sequence: Synthetic oligonucleotide
  Target: ATXN1; (-) strand; PAM type: NRG; PAM sequence: TAG
cctcagctggtgaaatcaat

SEQ ID NO: 38413 - DNA, 20 bp, Artificial Sequence
  Description of Artificial Sequence: Synthetic oligonucleotide
  Target: ATXN1; (-) strand; PAM type: NRG; PAM sequence: TGG
gctgtgttacttacctcagc

SEQ ID NO: 38414 - DNA, 20 bp, Artificial Sequence
  Description of Artificial Sequence: Synthetic oligonucleotide
  Target: ATXN1; (-) strand; PAM type: NRG; PAM sequence: CAG
agtggctgtgttacttacct

SEQ ID NO: 38415 - DNA, 20 bp, Artificial Sequence
  Description of Artificial Sequence: Synthetic oligonucleotide
  Target: ATXN1; (-) strand; PAM type: NRG; PAM sequence: TGG
ctgacaagtttggggtccag

SEQ ID NO: 38416 - DNA, 20 bp, Artificial Sequence
  Description of Artificial Sequence: Synthetic oligonucleotide
  Target: ATXN1; (-) strand; PAM type: NRG; PAM sequence: CAG
gttctgacaagtttggggtc

SEQ ID NO: 38417 - DNA, 20 bp, Artificial Sequence
  Description of Artificial Sequence: Synthetic oligonucleotide
  Target: ATXN1; (-) strand; PAM type: NRG; PAM sequence: GGG
tgattgttctgacaagtttg

SEQ ID NO: 38418 - DNA, 20 bp, Artificial Sequence
  Description of Artificial Sequence: Synthetic oligonucleotide
  Target: ATXN1; (-) strand; PAM type: NRG; PAM sequence: GGG
ctgattgttctgacaagttt

SEQ ID NO: 38419 - DNA, 20 bp, Artificial Sequence
  Description of Artificial Sequence: Synthetic oligonucleotide
  Target: ATXN1; (-) strand; PAM type: NRG; PAM sequence: TGG
actgattgttctgacaagtt

SEQ ID NO: 38420 - DNA, 20 bp, Artificial Sequence
  Description of Artificial Sequence: Synthetic oligonucleotide
  Target: ATXN1; (-) strand; PAM type: NRG; PAM sequence: AAG
gagatactgattgttctgac

SEQ ID NO: 38421 - DNA, 20 bp, Artificial Sequence
  Description of Artificial Sequence: Synthetic oligonucleotide
  Target: ATXN1; (-) strand; PAM type: NRG; PAM sequence: GAG
ccttccctttttgtttgtgt

SEQ ID NO: 38422 - DNA, 20 bp, Artificial Sequence
  Description of Artificial Sequence: Synthetic oligonucleotide
  Target: ATXN1; (-) strand; PAM type: NRG; PAM sequence: CAG
tgtgggcaaactcggcaaag

SEQ ID NO: 38423 - DNA, 20 bp, Artificial Sequence
  Description of Artificial Sequence: Synthetic oligonucleotide
  Target: ATXN1; (-) strand; PAM type: NRG; PAM sequence: AAG
tgctgtgggcaaactcggca

SEQ ID NO: 38424 - DNA, 20 bp, Artificial Sequence
  Description of Artificial Sequence: Synthetic oligonucleotide
  Target: ATXN1; (-) strand; PAM type: NRG; PAM sequence: CGG
ctgtgtgctgtgggcaaact

SEQ ID NO: 38425 - DNA, 20 bp, Artificial Sequence
  Description of Artificial Sequence: Synthetic oligonucleotide
  Target: ATXN1; (-) strand; PAM type: NRG; PAM sequence: GGG
caaatgtgcctgtgtgctgt

SEQ ID NO: 38426 - DNA, 20 bp, Artificial Sequence
  Description of Artificial Sequence: Synthetic oligonucleotide
  Target: ATXN1; (-) strand; PAM type: NRG; PAM sequence: TGG
gcaaatgtgcctgtgtgctg

SEQ ID NO: 38427 - DNA, 20 bp, Artificial Sequence
  Description of Artificial Sequence: Synthetic oligonucleotide
  Target: ATXN1; (-) strand; PAM type: NRG; PAM sequence: GGG
caggtcctgtggagtagccc

SEQ ID NO: 38428 - DNA, 20 bp, Artificial Sequence
  Description of Artificial Sequence: Synthetic oligonucleotide
  Target: ATXN1; (-) strand; PAM type: NRG; PAM sequence: CGG
ccaggtcctgtggagtagcc

SEQ ID NO: 38429 - DNA, 20 bp, Artificial Sequence
  Description of Artificial Sequence: Synthetic oligonucleotide
  Target: ATXN1; (-) strand; PAM type: NRG; PAM sequence: TAG
ctgccccaggtcctgtggag

SEQ ID NO: 38430 - DNA, 20 bp, Artificial Sequence
  Description of Artificial Sequence: Synthetic oligonucleotide
  Target: ATXN1; (-) strand; PAM type: NRG; PAM sequence: GAG
gggctgccccaggtcctgtg

SEQ ID NO: 38431 - DNA, 20 bp, Artificial Sequence
  Description of Artificial Sequence: Synthetic oligonucleotide
  Target: ATXN1; (-) strand; PAM type: NRG; PAM sequence: TGG
aagggctgccccaggtcctg

SEQ ID NO: 38432 - DNA, 20 bp, Artificial Sequence
  Description of Artificial Sequence: Synthetic oligonucleotide
  Target: ATXN1; (-) strand; PAM type: NRG; PAM sequence: AGG
caggctacaagggctgcccc

SEQ ID NO: 38433 - DNA, 20 bp, Artificial Sequence
  Description of Artificial Sequence: Synthetic oligonucleotide
  Target: ATXN1; (-) strand; PAM type: NRG; PAM sequence: CAG
tcaggctacaagggctgccc

SEQ ID NO: 38434 - DNA, 20 bp, Artificial Sequence
  Description of Artificial Sequence: Synthetic oligonucleotide
  Target: ATXN1; (-) strand; PAM type: NRG; PAM sequence: GGG
aggtgcaactcaggctacaa

SEQ ID NO: 38435 - DNA, 20 bp, Artificial Sequence
  Description of Artificial Sequence: Synthetic oligonucleotide
  Target: ATXN1; (-) strand; PAM type: NRG; PAM sequence: AGG
taggtgcaactcaggctaca

SEQ ID NO: 38436 - DNA, 20 bp, Artificial Sequence
  Description of Artificial Sequence: Synthetic oligonucleotide
  Target: ATXN1; (-) strand; PAM type: NRG; PAM sequence: AAG
gtaggtgcaactcaggctac

SEQ ID NO: 38437 - DNA, 20 bp, Artificial Sequence
  Description of Artificial Sequence: Synthetic oligonucleotide
  Target: ATXN1; (-) strand; PAM type: NRG; PAM sequence: AGG
gagctgtgtaggtgcaactc

SEQ ID NO: 38438 - DNA, 20 bp, Artificial Sequence
  Description of Artificial Sequence: Synthetic oligonucleotide
  Target: ATXN1; (-) strand; PAM type: NRG; PAM sequence: CAG
agagctgtgtaggtgcaact

SEQ ID NO: 38439 - DNA, 20 bp, Artificial Sequence
  Description of Artificial Sequence: Synthetic oligonucleotide
  Target: ATXN1; (-) strand; PAM type: NRG; PAM sequence: AGG
acagcaaaccagagctgtgt

SEQ ID NO: 38440 - DNA, 20 bp, Artificial Sequence
  Description of Artificial Sequence: Synthetic oligonucleotide
  Target: ATXN1; (-) strand; PAM type: NRG; PAM sequence: TAG
cacagcaaaccagagctgtg

SEQ ID NO: 38441 - DNA, 20 bp, Artificial Sequence
  Description of Artificial Sequence: Synthetic oligonucleotide
  Target: ATXN1; (-) strand; PAM type: NRG; PAM sequence: GAG
aaaggacacacagcaaacca

SEQ ID NO: 38442 - DNA, 20 bp, Artificial Sequence
  Description of Artificial Sequence: Synthetic oligonucleotide
  Target: ATXN1; (-) strand; PAM type: NRG; PAM sequence: CAG
tgaaaggacacacagcaaac

SEQ ID NO: 38443 - DNA, 20 bp, Artificial Sequence
  Description of Artificial Sequence: Synthetic oligonucleotide
  Target: ATXN1; (-) strand; PAM type: NRG; PAM sequence: CAG
taaatatgtgaaaggacaca

SEQ ID NO: 38444 - DNA, 20 bp, Artificial Sequence
  Description of Artificial Sequence: Synthetic oligonucleotide
  Target: ATXN1; (-) strand; PAM type: NRG; PAM sequence: AGG
ttatataataaatatgtgaa

SEQ ID NO: 38445 - DNA, 20 bp, Artificial Sequence
  Description of Artificial Sequence: Synthetic oligonucleotide
  Target: ATXN1; (-) strand; PAM type: NRG; PAM sequence: AAG
attatataataaatatgtga

SEQ ID NO: 38446 - DNA, 20 bp, Artificial Sequence
  Description of Artificial Sequence: Synthetic oligonucleotide
  Target: ATXN1; (-) strand; PAM type: NRG; PAM sequence: AGG
ctcctctgattatttagttg

SEQ ID NO: 38447 - DNA, 20 bp, Artificial Sequence
  Description of Artificial Sequence: Synthetic oligonucleotide
  Target: ATXN1; (-) strand; PAM type: NRG; PAM sequence: GAG
tctcctctgattatttagtt

SEQ ID NO: 38448 - DNA, 20 bp, Artificial Sequence
  Description of Artificial Sequence: Synthetic oligonucleotide
  Target: ATXN1; (-) strand; PAM type: NRG; PAM sequence: TAG
tggactctcctctgattatt

SEQ ID NO: 38449 - DNA, 20 bp, Artificial Sequence
  Description of Artificial Sequence: Synthetic oligonucleotide
  Target: ATXN1; (-) strand; PAM type: NRG; PAM sequence: TGG
atcttcttgggaaggtgttt

SEQ ID NO: 38450 - DNA, 20 bp, Artificial Sequence
  Description of Artificial Sequence: Synthetic oligonucleotide
  Target: ATXN1; (-) strand; PAM type: NRG; PAM sequence: AGG
gaggaactatcttcttggga

SEQ ID NO: 38451 - DNA, 20 bp, Artificial Sequence
  Description of Artificial Sequence: Synthetic oligonucleotide
  Target: ATXN1; (-) strand; PAM type: NRG; PAM sequence: AAG
ggaggaactatcttcttggg

SEQ ID NO: 38452 - DNA, 20 bp, Artificial Sequence
  Description of Artificial Sequence: Synthetic oligonucleotide
  Target: ATXN1; (-) strand; PAM type: NRG; PAM sequence: GGG
caaggaggaactatcttctt

SEQ ID NO: 38453 - DNA, 20 bp, Artificial Sequence
  Description of Artificial Sequence: Synthetic oligonucleotide
  Target: ATXN1; (-) strand; PAM type: NRG; PAM sequence: TGG
ccaaggaggaactatcttct

SEQ ID NO: 38454 - DNA, 20 bp, Artificial Sequence
  Description of Artificial Sequence: Synthetic oligonucleotide
  Target: ATXN1; (-) strand; PAM type: NRG; PAM sequence: AGG
tcattttcacttagccaagg

SEQ ID NO: 38455 - DNA, 20 bp, Artificial Sequence
  Description of Artificial Sequence: Synthetic oligonucleotide
  Target: ATXN1; (-) strand; PAM type: NRG; PAM sequence: GAG
ttcattttcacttagccaag

SEQ ID NO: 38456 - DNA, 20 bp, Artificial Sequence
  Description of Artificial Sequence: Synthetic oligonucleotide
  Target: ATXN1; (-) strand; PAM type: NRG; PAM sequence: AGG
aattcattttcacttagcca

SEQ ID NO: 38457 - DNA, 20 bp, Artificial Sequence
  Description of Artificial Sequence: Synthetic oligonucleotide
  Target: ATXN1; (-) strand; PAM type: NRG; PAM sequence: AAG
aaattcattttcacttagcc

SEQ ID NO: 38458 - DNA, 20 bp, Artificial Sequence
  Description of Artificial Sequence: Synthetic oligonucleotide
  Target: ATXN1; (-) strand; PAM type: NRG; PAM sequence: TAG
gggttaaattcattttcact

SEQ ID NO: 38459 - DNA, 20 bp, Artificial Sequence
  Description of Artificial Sequence: Synthetic oligonucleotide
  Target: ATXN1; (-) strand; PAM type: NRG; PAM sequence: GGG
cagaggtgggagaacgcttg

SEQ ID NO: 38460 - DNA, 20 bp, Artificial Sequence
  Description of Artificial Sequence: Synthetic oligonucleotide
  Target: ATXN1; (-) strand; PAM type: NRG; PAM sequence: GGG
acagaggtgggagaacgctt

SEQ ID NO: 38461 - DNA, 20 bp, Artificial Sequence
  Description of Artificial Sequence: Synthetic oligonucleotide
  Target: ATXN1; (-) strand; PAM type: NRG; PAM sequence: TGG
cacagaggtgggagaacgct

SEQ ID NO: 38462 - DNA, 20 bp, Artificial Sequence
  Description of Artificial Sequence: Synthetic oligonucleotide
  Target: ATXN1; (-) strand; PAM type: NRG; PAM sequence: GAG
tcaaggttacacagaggtgg

SEQ ID NO: 38463 - DNA, 20 bp, Artificial Sequence
  Description of Artificial Sequence: Synthetic oligonucleotide
  Target: ATXN1; (-) strand; PAM type: NRG; PAM sequence: GGG
cctcaaggttacacagaggt

SEQ ID NO: 38464 - DNA, 20 bp, Artificial Sequence
  Description of Artificial Sequence: Synthetic oligonucleotide
  Target: ATXN1; (-) strand; PAM type: NRG; PAM sequence: TGG
gcctcaaggttacacagagg

SEQ ID NO: 38465 - DNA, 20 bp, Artificial Sequence
  Description of Artificial Sequence: Synthetic oligonucleotide
  Target: ATXN1; (-) strand; PAM type: NRG; PAM sequence: AGG
ccagcctcaaggttacacag

SEQ ID NO: 38466 - DNA, 20 bp, Artificial Sequence
  Description of Artificial Sequence: Synthetic oligonucleotide
  Target: ATXN1; (-) strand; PAM type: NRG; PAM sequence: GAG
tccagcctcaaggttacaca

SEQ ID NO: 38467 - DNA, 20 bp, Artificial Sequence
  Description of Artificial Sequence: Synthetic oligonucleotide
  Target: ATXN1; (-) strand; PAM type: NRG; PAM sequence: CAG
cttccagcctcaaggttaca

SEQ ID NO: 38468 - DNA, 20 bp, Artificial Sequence
  Description of Artificial Sequence: Synthetic oligonucleotide
  Target: ATXN1; (-) strand; PAM type: NRG; PAM sequence: AGG
ctcaagaccttccagcctca

SEQ ID NO: 38469 - DNA, 20 bp, Artificial Sequence
  Description of Artificial Sequence: Synthetic oligonucleotide
  Target: ATXN1; (-) strand; PAM type: NRG; PAM sequence: AAG
cctcaagaccttccagcctc

SEQ ID NO: 38470 - DNA, 20 bp, Artificial Sequence
  Description of Artificial Sequence: Synthetic oligonucleotide
  Target: ATXN1; (-) strand; PAM type: NRG; PAM sequence: CAG
caacccacctcaagaccttc

SEQ ID NO: 38471 - DNA, 20 bp, Artificial Sequence
  Description of Artificial Sequence: Synthetic oligonucleotide
  Target: ATXN1; (-) strand; PAM type: NRG; PAM sequence: AAG
aacccacctcaacccacctc

SEQ ID NO: 38472 - DNA, 20 bp, Artificial Sequence
  Description of Artificial Sequence: Synthetic oligonucleotide
  Target: ATXN1; (-) strand; PAM type: NRG; PAM sequence: TGG
aagaacccatagcttccagg

SEQ ID NO: 38473 - DNA, 20 bp, Artificial Sequence
  Description of Artificial Sequence: Synthetic oligonucleotide
  Target: ATXN1; (-) strand; PAM type: NRG; PAM sequence: AGG
ctcaagaacccatagcttcc

SEQ ID NO: 38474 - DNA, 20 bp, Artificial Sequence
  Description of Artificial Sequence: Synthetic oligonucleotide
  Target: ATXN1; (-) strand; PAM type: NRG; PAM sequence: CAG
cctcaagaacccatagcttc

SEQ ID NO: 38475 - DNA, 20 bp, Artificial Sequence
  Description of Artificial Sequence: Synthetic oligonucleotide
  Target: ATXN1; (-) strand; PAM type: NRG; PAM sequence: TAG
agtaattcctcaagaaccca

SEQ ID NO: 38476 - DNA, 20 bp, Artificial Sequence
  Description of Artificial Sequence: Synthetic oligonucleotide
  Target: ATXN1; (-) strand; PAM type: NRG; PAM sequence: AAG
gccagaaaaagtaattcctc

SEQ ID NO: 38477 - DNA, 20 bp, Artificial Sequence
  Description of Artificial Sequence: Synthetic oligonucleotide
  Target: ATXN1; (-) strand; PAM type: NRG; PAM sequence: AAG
cttagcagttgtgccagaaa

SEQ ID NO: 38478 - DNA, 20 bp, Artificial Sequence
  Description of Artificial Sequence: Synthetic oligonucleotide
  Target: ATXN1; (-) strand; PAM type: NRG; PAM sequence: CAG
atatggcttagcagttgtgc

SEQ ID NO: 38479 - DNA, 20 bp, Artificial Sequence
  Description of Artificial Sequence: Synthetic oligonucleotide
  Target: ATXN1; (-) strand; PAM type: NRG; PAM sequence: CAG
cttggaaagatatggcttag

SEQ ID NO: 38480 - DNA, 20 bp, Artificial Sequence
  Description of Artificial Sequence: Synthetic oligonucleotide
  Target: ATXN1; (-) strand; PAM type: NRG; PAM sequence: TAG
agtcttggaaagatatggct

SEQ ID NO: 38481 - DNA, 20 bp, Artificial Sequence
  Description of Artificial Sequence: Synthetic oligonucleotide
  Target: ATXN1; (-) strand; PAM type: NRG; PAM sequence: TGG
ggcccagtcttggaaagata

SEQ ID NO: 38482 - DNA, 20 bp, Artificial Sequence
  Description of Artificial Sequence: Synthetic oligonucleotide
  Target: ATXN1; (-) strand; PAM type: NRG; PAM sequence: AAG
gcactgggcccagtcttgga

SEQ ID NO: 38483 - DNA, 20 bp, Artificial Sequence
  Description of Artificial Sequence: Synthetic oligonucleotide
  Target: ATXN1; (-) strand; PAM type: NRG; PAM sequence: TGG
ctttgcactgggcccagtct

SEQ ID NO: 38484 - DNA, 20 bp, Artificial Sequence
  Description of Artificial Sequence: Synthetic oligonucleotide
  Target: ATXN1; (-) strand; PAM type: NRG; PAM sequence: CAG
ttacagctttgcactgggcc

SEQ ID NO: 38485 - DNA, 20 bp, Artificial Sequence
  Description of Artificial Sequence: Synthetic oligonucleotide
  Target: ATXN1; (-) strand; PAM type: NRG; PAM sequence: GGG
ccacattacagctttgcact

SEQ ID NO: 38486 - DNA, 20 bp, Artificial Sequence
  Description of Artificial Sequence: Synthetic oligonucleotide
  Target: ATXN1; (-) strand; PAM type: NRG; PAM sequence: TGG
accacattacagctttgcac

SEQ ID NO: 38487 - DNA, 20 bp, Artificial Sequence
  Description of Artificial Sequence: Synthetic oligonucleotide
  Target: ATXN1; (-) strand; PAM type: NRG; PAM sequence: CAG
acctcaagagtaccacatta

SEQ ID NO: 38488 - DNA, 20 bp, Artificial Sequence
  Description of Artificial Sequence: Synthetic oligonucleotide
  Target: ATXN1; (-) strand; PAM type: NRG; PAM sequence: GAG
gaactccccgtttacctcaa

SEQ ID NO: 38489 - DNA, 20 bp, Artificial Sequence
  Description of Artificial Sequence: Synthetic oligonucleotide
  Target: ATXN1; (-) strand; PAM type: NRG; PAM sequence: AAG
aggaactccccgtttacctc

SEQ ID NO: 38490 - DNA, 20 bp, Artificial Sequence
  Description of Artificial Sequence: Synthetic oligonucleotide
  Target: ATXN1; (-) strand; PAM type: NRG; PAM sequence: AGG
gcaggtctctcagcatgtgg

SEQ ID NO: 38491 - DNA, 20 bp, Artificial Sequence
  Description of Artificial Sequence: Synthetic oligonucleotide
  Target: ATXN1; (-) strand; PAM type: NRG; PAM sequence: GAG
agcaggtctctcagcatgtg

SEQ ID NO: 38492 - DNA, 20 bp, Artificial Sequence
  Description of Artificial Sequence: Synthetic oligonucleotide
  Target: ATXN1; (-) strand; PAM type: NRG; PAM sequence: TGG
cgagcaggtctctcagcatg

SEQ ID NO: 38493 - DNA, 20 bp, Artificial Sequence
  Description of Artificial Sequence: Synthetic oligonucleotide
  Target: ATXN1; (-) strand; PAM type: NRG; PAM sequence: CAG
aactcctcgagcaggtctct

SEQ ID NO: 38494 - DNA, 20 bp, Artificial Sequence
  Description of Artificial Sequence: Synthetic oligonucleotide
  Target: ATXN1; (-) strand; PAM type: NRG; PAM sequence: AGG
aaaaacccaactcctcgagc

SEQ ID NO: 38495 - DNA, 20 bp, Artificial Sequence
  Description of Artificial Sequence: Synthetic oligonucleotide
  Target: ATXN1; (-) strand; PAM type: NRG; PAM sequence: CAG
aaaaaacccaactcctcgag

SEQ ID NO: 38496 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaacccaactcctc

SEQ ID NO: 38497 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcgaca

SEQ ID NO: 38498 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcga

SEQ ID NO: 38499 - DNA, 20 bp, Artificial Sequence
  Description of Artificial Sequence: Synthetic oligonucleotide
  Target: ATXN1; (-) strand; PAM type: NRG; PAM sequence: GGG
ataccgctgcactccagcct

SEQ ID NO: 38500 - DNA, 20 bp, Artificial Sequence
  Description of Artificial Sequence: Synthetic oligonucleotide
  Target: ATXN1; (-) strand; PAM type: NRG; PAM sequence: TGG
cataccgctgcactccagcc

SEQ ID NO: 38501 - DNA, 20 bp, Artificial Sequence
  Description of Artificial Sequence: Synthetic oligonucleotide
  Target: ATXN1; (-) strand; PAM type: NRG; PAM sequence: CAG
ataatcataccgctgcactc

SEQ ID NO: 38502 - DNA, 20 bp, Artificial Sequence
  Description of Artificial Sequence: Synthetic oligonucleotide
  Target: ATXN1; (-) strand; PAM type: NRG; PAM sequence: GAG
caggaggtcgaggctgcagt

SEQ ID NO: 38503 - DNA, 20 bp, Artificial Sequence
  Description of Artificial Sequence: Synthetic oligonucleotide
  Target: ATXN1; (-) strand; PAM type: NRG; PAM sequence: CAG
gggccaggaggtcgaggctg

SEQ ID NO: 38504 - DNA, 20 bp, Artificial Sequence
  Description of Artificial Sequence: Synthetic oligonucleotide
  Target: ATXN1; (-) strand; PAM type: NRG; PAM sequence: AGG
cgcctggggccaggaggtcg

SEQ ID NO: 38505 - DNA, 20 bp, Artificial Sequence
  Description of Artificial Sequence: Synthetic oligonucleotide
  Target: ATXN1; (-) strand; PAM type: NRG; PAM sequence: GAG
tcgcctggggccaggaggtc

SEQ ID NO: 38506 - DNA, 20 bp, Artificial Sequence
  Description of Artificial Sequence: Synthetic oligonucleotide
  Target: ATXN1; (-) strand; PAM type: NRG; PAM sequence: AGG
gaggatcgcctggggccagg

SEQ ID NO: 38507 - DNA, 20 bp, Artificial Sequence
  Description of Artificial Sequence: Synthetic oligonucleotide
  Target: ATXN1; (-) strand; PAM type: NRG; PAM sequence: GAG
ggaggatcgcctggggccag

SEQ ID NO: 38508 - DNA, 20 bp, Artificial Sequence
  Description of Artificial Sequence: Synthetic oligonucleotide
  Target: ATXN1; (-) strand; PAM type: NRG; PAM sequence: AGG
tgggaggatcgcctggggcc

SEQ ID NO: 38509 - DNA, 20 bp, Artificial Sequence
  Description of Artificial Sequence: Synthetic oligonucleotide
  Target: ATXN1; (-) strand; PAM type: NRG; PAM sequence: CAG
gtgggaggatcgcctggggc

SEQ ID NO: 38510 - DNA, 20 bp, Artificial Sequence
  Description of Artificial Sequence: Synthetic oligonucleotide
  Target: ATXN1; (-) strand; PAM type: NRG; PAM sequence: GGG
tgaggtgggaggatcgcctg

SEQ ID NO: 38511 - DNA, 20 bp, Artificial Sequence
  Description of Artificial Sequence: Synthetic oligonucleotide
  Target: ATXN1; (-) strand; PAM type: NRG; PAM sequence: GGG
ctgaggtgggaggatcgcct

SEQ ID NO: 38512 - DNA, 20 bp, Artificial Sequence
  Description of Artificial Sequence: Synthetic oligonucleotide
  Target: ATXN1; (-) strand; PAM type: NRG; PAM sequence: TGG
actgaggtgggaggatcgcc

SEQ ID NO: 38513 - DNA, 20 bp, Artificial Sequence
  Description of Artificial Sequence: Synthetic oligonucleotide
  Target: ATXN1; (-) strand; PAM type: NRG; PAM sequence: AGG
acttaggggactgaggtggg

SEQ ID NO: 38514 - DNA, 20 bp, Artificial Sequence
  Description of Artificial Sequence: Synthetic oligonucleotide
  Target: ATXN1; (-) strand; PAM type: NRG; PAM sequence: GAG
tacttaggggactgaggtgg

SEQ ID NO: 38515 - DNA, 20 bp, Artificial Sequence
  Description of Artificial Sequence: Synthetic oligonucleotide
  Target: ATXN1; (-) strand; PAM type: NRG; PAM sequence: GGG
gctacttaggggactgaggt

SEQ ID NO: 38516 - DNA, 20 bp, Artificial Sequence
  Description of Artificial Sequence: Synthetic oligonucleotide
  Target: ATXN1; (-) strand; PAM type: NRG; PAM sequence: TGG
agctacttaggggactgagg

SEQ ID NO: 38517 - DNA, 20 bp, Artificial Sequence
  Description of Artificial Sequence: Synthetic oligonucleotide
  Target: ATXN1; (-) strand; PAM type: NRG; PAM sequence: AGG
cccagctacttaggggactg

SEQ ID NO: 38518 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttaggggact

SEQ ID NO: 38519 - DNA, 20 bp, Artificial Sequence
  Description of Artificial Sequence: Synthetic oligonucleotide
  Target: ATXN1; (-) strand; PAM type: NRG; PAM sequence: GGG
ctatggtcccagctacttag

SEQ ID NO: 38520 - DNA, 20 bp, Artificial Sequence
  Description of Artificial Sequence: Synthetic oligonucleotide
  Target: ATXN1; (-) strand; PAM type: NRG; PAM sequence: GGG
cctatggtcccagctactta

SEQ ID NO: 38521 - DNA, 20 bp, Artificial Sequence
  Description of Artificial Sequence: Synthetic oligonucleotide
  Target: ATXN1; (-) strand; PAM type: NRG; PAM sequence: AGG
acctatggtcccagctactt

SEQ ID NO: 38522 - DNA, 20 bp, Artificial Sequence
  Description of Artificial Sequence: Synthetic oligonucleotide
  Target: ATXN1; (-) strand; PAM type: NRG; PAM sequence: TAG
tacctatggtcccagctact

SEQ ID NO: 38523 - DNA, 20 bp, Artificial Sequence
  Description of Artificial Sequence: Synthetic oligonucleotide
  Target: ATXN1; (-) strand; PAM type: NRG; PAM sequence: CAG
gtggcacatacctatggtcc

SEQ ID NO: 38524 - DNA, 20 bp, Artificial Sequence
  Description of Artificial Sequence: Synthetic oligonucleotide
  Target: ATXN1; (-) strand; PAM type: NRG; PAM sequence: TGG
ggtgtggtggcacataccta

SEQ ID NO: 38525 - DNA, 20 bp, Artificial Sequence
  Description of Artificial Sequence: Synthetic oligonucleotide
  Target: ATXN1; (-) strand; PAM type: NRG; PAM sequence: TGG
atgaaattagccgggtgtgg

SEQ ID NO: 38526 - DNA, 20 bp, Artificial Sequence
  Description of Artificial Sequence: Synthetic oligonucleotide
  Target: ATXN1; (-) strand; PAM type: NRG; PAM sequence: TGG
aaaatgaaattagccgggtg

SEQ ID NO: 38527 - DNA, 20 bp, Artificial Sequence
  Description of Artificial Sequence: Synthetic oligonucleotide
  Target: ATXN1; (-) strand; PAM type: NRG; PAM sequence: GGG
tacaaaaaatgaaattagcc

SEQ ID NO: 38528 - DNA, 20 bp, Artificial Sequence
  Description of Artificial Sequence: Synthetic oligonucleotide
  Target: ATXN1; (-) strand; PAM type: NRG; PAM sequence: CGG
ctacaaaaaatgaaattagc

SEQ ID NO: 38529 - DNA, 20 bp, Artificial Sequence
  Description of Artificial Sequence: Synthetic oligonucleotide
  Target: ATXN1; (-) strand; PAM type: NRG; PAM sequence: TAG
atctctacaaaaaatgaaat

SEQ ID NO: 38530 - DNA, 20 bp, Artificial Sequence
  Description of Artificial Sequence: Synthetic oligonucleotide
  Target: ATXN1; (-) strand; PAM type: NRG; PAM sequence: AAG
accagcctagtcaacatagt

SEQ ID NO: 38531 - DNA, 20 bp, Artificial Sequence
  Description of Artificial Sequence: Synthetic oligonucleotide
  Target: ATXN1; (-) strand; PAM type: NRG; PAM sequence: TAG
cgagaccagcctagtcaaca

SEQ ID NO: 38532 - DNA, 20 bp, Artificial Sequence
  Description of Artificial Sequence: Synthetic oligonucleotide
  Target: ATXN1; (-) strand; PAM type: NRG; PAM sequence: TAG
ccaggagttcgagaccagcc

SEQ ID NO: 38533 - DNA, 20 bp, Artificial Sequence
  Description of Artificial Sequence: Synthetic oligonucleotide
  Target: ATXN1; (-) strand; PAM type: NRG; PAM sequence: CAG
tgagcccaggagttcgagac

SEQ ID NO: 38534 - DNA, 20 bp, Artificial Sequence
  Description of Artificial Sequence: Synthetic oligonucleotide
  Target: ATXN1; (-) strand; PAM type: NRG; PAM sequence: GAG
ctgcttgagcccaggagttc

SEQ ID NO: 38535 - DNA, 20 bp, Artificial Sequence
  Description of Artificial Sequence: Synthetic oligonucleotide
  Target: ATXN1; (-) strand; PAM type: NRG; PAM sequence: GAG
caaggcctgcttgagcccag

SEQ ID NO: 38536 - DNA, 20 bp, Artificial Sequence
  Description of Artificial Sequence: Synthetic oligonucleotide
  Target: ATXN1; (-) strand; PAM type: NRG; PAM sequence: AGG
cacaaggcctgcttgagccc

SEQ ID NO: 38537 - DNA, 20 bp, Artificial Sequence
  Description of Artificial Sequence: Synthetic oligonucleotide
  Target: ATXN1; (-) strand; PAM type: NRG; PAM sequence: CAG
gcacaaggcctgcttgagcc

SEQ ID NO: 38538 - DNA, 20 bp, Artificial Sequence
  Description of Artificial Sequence: Synthetic oligonucleotide
  Target: ATXN1; (-) strand; PAM type: NRG; PAM sequence: GAG
ccgaggcacaaggcctgctt

SEQ ID NO: 38539 - DNA, 20 bp, Artificial Sequence
  Description of Artificial Sequence: Synthetic oligonucleotide
  Target: ATXN1; (-) strand; PAM type: NRG; PAM sequence: AGG
gttggggaggccgaggcaca

SEQ ID NO: 38540 - DNA, 20 bp, Artificial Sequence
  Description of Artificial Sequence: Synthetic oligonucleotide
  Target: ATXN1; (-) strand; PAM type: NRG; PAM sequence: AAG
agttggggaggccgaggcac

SEQ ID NO: 38541 - DNA, 20 bp, Artificial Sequence
  Description of Artificial Sequence: Synthetic oligonucleotide
  Target: ATXN1; (-) strand; PAM type: NRG; PAM sequence: AGG
cccaacagttggggaggccg

SEQ ID NO: 38542 - DNA, 20 bp, Artificial Sequence
  Description of Artificial Sequence: Synthetic oligonucleotide
  Target: ATXN1; (-) strand; PAM type: NRG; PAM sequence: GAG
tcccaacagttggggaggcc

SEQ ID NO: 38543 - DNA, 20 bp, Artificial Sequence
  Description of Artificial Sequence: Synthetic oligonucleotide
  Target: ATXN1; (-) strand; PAM type: NRG; PAM sequence: AGG
cataatcccaacagttgggg

SEQ ID NO: 38544 - DNA, 20 bp, Artificial Sequence
  Description of Artificial Sequence: Synthetic oligonucleotide
  Target: ATXN1; (-) strand; PAM type: NRG; PAM sequence: GAG
ccataatcccaacagttggg

SEQ ID NO: 38545 - DNA, 20 bp, Artificial Sequence
  Description of Artificial Sequence: Synthetic oligonucleotide
  Target: ATXN1; (-) strand; PAM type: NRG; PAM sequence: GGG
gcccataatcccaacagttg

SEQ ID NO: 38546 - DNA, 20 bp, Artificial Sequence
  Description of Artificial Sequence: Synthetic oligonucleotide
  Target: ATXN1; (-) strand; PAM type: NRG; PAM sequence: GGG
cgcccataatcccaacagtt

SEQ ID NO: 38547 - DNA, 20 bp, Artificial Sequence
  Description of Artificial Sequence: Synthetic oligonucleotide
  Target: ATXN1; (-) strand; PAM type: NRG; PAM sequence: TGG
acgcccataatcccaacagt

SEQ ID NO: 38548 - DNA, 20 bp, Artificial Sequence
  Description of Artificial Sequence: Synthetic oligonucleotide
  Target: ATXN1; (-) strand; PAM type: NRG; PAM sequence: CAG
gctcacgcccataatcccaa

SEQ ID NO: 38549 - DNA, 20 bp, Artificial Sequence
  Description of Artificial Sequence: Synthetic oligonucleotide
  Target: ATXN1; (-) strand; PAM type: NRG; PAM sequence: TGG
agcgagcagaccgggcacag

SEQ ID NO: 38550 - DNA, 20 bp, Artificial Sequence
  Description of Artificial Sequence: Synthetic oligonucleotide
  Target: ATXN1; (-) strand; PAM type: NRG; PAM sequence: CAG
ttcagcgagcagaccgggca

SEQ ID NO: 38551 - DNA, 20 bp, Artificial Sequence
  Description of Artificial Sequence: Synthetic oligonucleotide
  Target: ATXN1; (-) strand; PAM type: NRG; PAM sequence: GGG
agaaattcagcgagcagacc

SEQ ID NO: 38552 - DNA, 20 bp, Artificial Sequence
  Description of Artificial Sequence: Synthetic oligonucleotide
  Target: ATXN1; (-) strand; PAM type: NRG; PAM sequence: CGG
tagaaattcagcgagcagac

SEQ ID NO: 38553 - DNA, 20 bp, Artificial Sequence
  Description of Artificial Sequence: Synthetic oligonucleotide
  Target: ATXN1; (-) strand; PAM type: NRG; PAM sequence: CAG
ctcattagaaattcagcgag

SEQ ID NO: 38554 - DNA, 20 bp, Artificial Sequence
  Description of Artificial Sequence: Synthetic oligonucleotide
  Target: ATXN1; (-) strand; PAM type: NRG; PAM sequence: GAG
aagctcattagaaattcagc

SEQ ID NO: 38555 - DNA, 20 bp, Artificial Sequence
  Description of Artificial Sequence: Synthetic oligonucleotide
  Target: ATXN1; (-) strand; PAM type: NRG; PAM sequence: CAG
attcaagctcattagaaatt

SEQ ID NO: 38556 - DNA, 20 bp, Artificial Sequence
  Description of Artificial Sequence: Synthetic oligonucleotide
  Target: ATXN1; (-) strand; PAM type: NRG; PAM sequence: TAG
ttcctgtaattcaagctcat

SEQ ID NO: 38557 - DNA, 20 bp, Artificial Sequence
  Description of Artificial Sequence: Synthetic oligonucleotide
  Target: ATXN1; (-) strand; PAM type: NRG; PAM sequence: AAG
atttttacttcctgtaattc

SEQ ID NO: 38558 - DNA, 20 bp, Artificial Sequence
  Description of Artificial Sequence: Synthetic oligonucleotide
  Target: ATXN1; (-) strand; PAM type: NRG; PAM sequence: TGG
actggttagtggtctgtaag

SEQ ID NO: 38559 - DNA, 20 bp, Artificial Sequence
  Description of Artificial Sequence: Synthetic oligonucleotide
  Target: ATXN1; (-) strand; PAM type: NRG; PAM sequence: AAG
taaactggttagtggtctgt

SEQ ID NO: 38560 - DNA, 20 bp, Artificial Sequence
  Description of Artificial Sequence: Synthetic oligonucleotide
  Target: ATXN1; (-) strand; PAM type: NRG; PAM sequence: TGG
atttgctctaaactggttag

SEQ ID NO: 38561 - DNA, 20 bp, Artificial Sequence
  Description of Artificial Sequence: Synthetic oligonucleotide
  Target: ATXN1; (-) strand; PAM type: NRG; PAM sequence: TAG
cagatttgctctaaactggt

SEQ ID NO: 38562 - DNA, 20 bp, Artificial Sequence
  Description of Artificial Sequence: Synthetic oligonucleotide
  Target: ATXN1; (-) strand; PAM type: NRG; PAM sequence: TGG
cttacagatttgctctaaac

SEQ ID NO: 38563 - DNA, 20 bp, Artificial Sequence
  Description of Artificial Sequence: Synthetic oligonucleotide
  Target: ATXN1; (-) strand; PAM type: NRG; PAM sequence: CAG
cataatctatacactcctta

SEQ ID NO: 38564 - DNA, 20 bp, Artificial Sequence
  Description of Artificial Sequence: Synthetic oligonucleotide
  Target: ATXN1; (-) strand; PAM type: NRG; PAM sequence: TGG
ggtagcttcatgcgctcgtg

SEQ ID NO: 38565 - DNA, 20 bp, Artificial Sequence
  Description of Artificial Sequence: Synthetic oligonucleotide
  Target: ATXN1; (-) strand; PAM type: NRG; PAM sequence: TAG
acttgtctttaaacatgtgg

SEQ ID NO: 38566 - DNA, 20 bp, Artificial Sequence
  Description of Artificial Sequence: Synthetic oligonucleotide
  Target: ATXN1; (-) strand; PAM type: NRG; PAM sequence: TGG
tatacttgtctttaaacatg

SEQ ID NO: 38567 - DNA, 20 bp, Artificial Sequence
  Description of Artificial Sequence: Synthetic oligonucleotide
  Target: ATXN1; (-) strand; PAM type: NRG; PAM sequence: AGG
tgaacactgctgttcacaag

SEQ ID NO: 38568 - DNA, 20 bp, Artificial Sequence
  Description of Artificial Sequence: Synthetic oligonucleotide
  Target: ATXN1; (-) strand; PAM type: NRG; PAM sequence: GAG
ctgaacactgctgttcacaa

SEQ ID NO: 38569 - DNA, 20 bp, Artificial Sequence
  Description of Artificial Sequence: Synthetic oligonucleotide
  Target: ATXN1; (-) strand; PAM type: NRG; PAM sequence: AAG
agctgaacactgctgttcac

SEQ ID NO: 38570 - DNA, 20 bp, Artificial Sequence
  Description of Artificial Sequence: Synthetic oligonucleotide
  Target: ATXN1; (-) strand; PAM type: NRG; PAM sequence: TAG
cagttcatgtttatgcctcc

SEQ ID NO: 38571 - DNA, 20 bp, Artificial Sequence
  Description of Artificial Sequence: Synthetic oligonucleotide
  Target: ATXN1; (-) strand; PAM type: NRG; PAM sequence: CAG
acctgatgtcttggtttctt

SEQ ID NO: 38572 - DNA, 20 bp, Artificial Sequence
  Description of Artificial Sequence: Synthetic oligonucleotide
  Target: ATXN1; (-) strand; PAM type: NRG; PAM sequence: TGG
cacagccacacctgatgtct

SEQ ID NO: 38573 - DNA, 20 bp, Artificial Sequence
  Description of Artificial Sequence: Synthetic oligonucleotide
  Target: ATXN1; (-) strand; PAM type: NRG; PAM sequence: CAG
gttctaagataaaaggcaca

SEQ ID NO: 38574 - DNA, 20 bp, Artificial Sequence
  Description of Artificial Sequence: Synthetic oligonucleotide
  Target: ATXN1; (-) strand; PAM type: NRG; PAM sequence: AGG
agatgaggttctaagataaa

SEQ ID NO: 38575 - DNA, 20 bp, Artificial Sequence
  Description of Artificial Sequence: Synthetic oligonucleotide
  Target: ATXN1; (-) strand; PAM type: NRG; PAM sequence: AAG
gagatgaggttctaagataa

SEQ ID NO: 38576 - DNA, 20 bp, Artificial Sequence
  Description of Artificial Sequence: Synthetic oligonucleotide
  Target: ATXN1; (-) strand; PAM type: NRG; PAM sequence: AAG
tacgtgtgagatgaggttct

SEQ ID NO: 38577 - DNA, 20 bp, Artificial Sequence
  Description of Artificial Sequence: Synthetic oligonucleotide
  Target: ATXN1; (-) strand; PAM type: NRG; PAM sequence: AGG
ggaagagtacgtgtgagatg

SEQ ID NO: 38578 - DNA, 20 bp, Artificial Sequence
  Description of Artificial Sequence: Synthetic oligonucleotide
  Target: ATXN1; (-) strand; PAM type: NRG; PAM sequence: GAG
gggaagagtacgtgtgagat

SEQ ID NO: 38579 - DNA, 20 bp, Artificial Sequence
  Description of Artificial Sequence: Synthetic oligonucleotide
  Target: ATXN1; (-) strand; PAM type: NRG; PAM sequence: GAG
ttggggggaagagtacgtgt

SEQ ID NO: 38580 - DNA, 20 bp, Artificial Sequence
  Description of Artificial Sequence: Synthetic oligonucleotide
  Target: ATXN1; (-) strand; PAM type: NRG; PAM sequence: GAG
tgctaatgttttggggggaa

SEQ ID NO: 38581 - DNA, 20 bp, Artificial Sequence
  Description of Artificial Sequence: Synthetic oligonucleotide
  Target: ATXN1; (-) strand; PAM type: NRG; PAM sequence: AAG
gctgctaatgttttgggggg

SEQ ID NO: 38582 - DNA, 20 bp, Artificial Sequence
  Description of Artificial Sequence: Synthetic oligonucleotide
  Target: ATXN1; (-) strand; PAM type: NRG; PAM sequence: GGG
ttcgctgctaatgttttggg

SEQ ID NO: 38583 - DNA, 20 bp, Artificial Sequence
  Description of Artificial Sequence: Synthetic oligonucleotide
  Target: ATXN1; (-) strand; PAM type: NRG; PAM sequence: GGG
cttcgctgctaatgttttgg

SEQ ID NO: 38584 - DNA, 20 bp, Artificial Sequence
  Description of Artificial Sequence: Synthetic oligonucleotide
  Target: ATXN1; (-) strand; PAM type: NRG; PAM sequence: GGG
ccttcgctgctaatgttttg

SEQ ID NO: 38585 - DNA, 20 bp, Artificial Sequence
  Description of Artificial Sequence: Synthetic oligonucleotide
  Target: ATXN1; (-) strand; PAM type: NRG; PAM sequence: GGG
gccttcgctgctaatgtttt

SEQ ID NO: 38586 - DNA, 20 bp, Artificial Sequence
  Description of Artificial Sequence: Synthetic oligonucleotide
  Target: ATXN1; (-) strand; PAM type: NRG; PAM sequence: TGG
tgccttcgctgctaatgttt

SEQ ID NO: 38587 - DNA, 20 bp, Artificial Sequence
  Description of Artificial Sequence: Synthetic oligonucleotide
  Target: ATXN1; (-) strand; PAM type: NRG; PAM sequence: AGG
aggtagggaggtgtgacatg

SEQ ID NO: 38588 - DNA, 20 bp, Artificial Sequence
  Description of Artificial Sequence: Synthetic oligonucleotide
  Target: ATXN1; (-) strand; PAM type: NRG; PAM sequence: GAG
gaggtagggaggtgtgacat

SEQ ID NO: 38589 - DNA, 20 bp, Artificial Sequence
  Description of Artificial Sequence: Synthetic oligonucleotide
  Target: ATXN1; (-) strand; PAM type: NRG; PAM sequence: AGG
tgggtaggtcggaggtaggg

SEQ ID NO: 38590 - DNA, 20 bp, Artificial Sequence
  Description of Artificial Sequence: Synthetic oligonucleotide
  Target: ATXN1; (-) strand; PAM type: NRG; PAM sequence: GAG
ctgggtaggtcggaggtagg

SEQ ID NO: 38591 - DNA, 20 bp, Artificial Sequence
  Description of Artificial Sequence: Synthetic oligonucleotide
  Target: ATXN1; (-) strand; PAM type: NRG; PAM sequence: GGG
ccctgggtaggtcggaggta

SEQ ID NO: 38592 - DNA, 20 bp, Artificial Sequence
  Description of Artificial Sequence: Synthetic oligonucleotide
  Target: ATXN1; (-) strand; PAM type: NRG; PAM sequence: AGG
tccctgggtaggtcggaggt

SEQ ID NO: 38593 - DNA, 20 bp, Artificial Sequence
  Description of Artificial Sequence: Synthetic oligonucleotide
  Target: ATXN1; (-) strand; PAM type: NRG; PAM sequence: TAG
ctccctgggtaggtcggagg

SEQ ID NO: 38594 - DNA, 20 bp, Artificial Sequence
  Description of Artificial Sequence: Synthetic oligonucleotide
  Target: ATXN1; (-) strand; PAM type: NRG; PAM sequence: AGG
gttctccctgggtaggtcgg

SEQ ID NO: 38595 - DNA, 20 bp, Artificial Sequence
  Description of Artificial Sequence: Synthetic oligonucleotide
  Target: ATXN1; (-) strand; PAM type: NRG; PAM sequence: GAG
agttctccctgggtaggtcg

SEQ ID NO: 38596 - DNA, 20 bp, Artificial Sequence
  Description of Artificial Sequence: Synthetic oligonucleotide
  Target: ATXN1; (-) strand; PAM type: NRG; PAM sequence: CGG
cgagttctccctgggtaggt

SEQ ID NO: 38597 - DNA, 20 bp, Artificial Sequence
  Description of Artificial Sequence: Synthetic oligonucleotide
  Target: ATXN1; (-) strand; PAM type: NRG; PAM sequence: AGG
ctcacgagttctccctgggt

SEQ ID NO: 38598 - DNA, 20 bp, Artificial Sequence
  Description of Artificial Sequence: Synthetic oligonucleotide
  Target: ATXN1; (-) strand; PAM type: NRG; PAM sequence: TAG
gctcacgagttctccctggg

SEQ ID NO: 38599 - DNA, 20 bp, Artificial Sequence
  Description of Artificial Sequence: Synthetic oligonucleotide
  Target: ATXN1; (-) strand; PAM type: NRG; PAM sequence: GGG
cccgctcacgagttctccct

SEQ ID NO: 38600 - DNA, 20 bp, Artificial Sequence
  Description of Artificial Sequence: Synthetic oligonucleotide
  Target: ATXN1; (-) strand; PAM type: NRG; PAM sequence: TGG
ccccgctcacgagttctccc

SEQ ID NO: 38601 - DNA, 20 bp, Artificial Sequence
  Description of Artificial Sequence: Synthetic oligonucleotide
  Target: ATXN1; (-) strand; PAM type: NRG; PAM sequence: GAG
ccttattgacccccgctcac

SEQ ID NO: 38602 - DNA, 20 bp, Artificial Sequence
  Description of Artificial Sequence: Synthetic oligonucleotide
  Target: ATXN1; (-) strand; PAM type: NRG; PAM sequence: GAG
caaggaagaggccaggaaaa

SEQ ID NO: 38603 - DNA, 20 bp, Artificial Sequence
  Description of Artificial Sequence: Synthetic oligonucleotide
  Target: ATXN1; (-) strand; PAM type: NRG; PAM sequence: AAG
ctcaaggaagaggccaggaa

SEQ ID NO: 38604 - DNA, 20 bp, Artificial Sequence
  Description of Artificial Sequence: Synthetic oligonucleotide
  Target: ATXN1; (-) strand; PAM type: NRG; PAM sequence: AGG
gggtcctcaaggaagaggcc

SEQ ID NO: 38605 - DNA, 20 bp, Artificial Sequence
  Description of Artificial Sequence: Synthetic oligonucleotide
  Target: ATXN1; (-) strand; PAM type: NRG; PAM sequence: CAG
tgggtcctcaaggaagaggc

SEQ ID NO: 38606 - DNA, 20 bp, Artificial Sequence
  Description of Artificial Sequence: Synthetic oligonucleotide
  Target: ATXN1; (-) strand; PAM type: NRG; PAM sequence: AGG
ctgttgggtcctcaaggaag

SEQ ID NO: 38607 - DNA, 20 bp, Artificial Sequence
  Description of Artificial Sequence: Synthetic oligonucleotide
  Target: ATXN1; (-) strand; PAM type: NRG; PAM sequence: GAG
tctgttgggtcctcaaggaa

SEQ ID NO: 38608 - DNA, 20 bp, Artificial Sequence
  Description of Artificial Sequence: Synthetic oligonucleotide
  Target: ATXN1; (-) strand; PAM type: NRG; PAM sequence: AAG
cttctgttgggtcctcaagg

SEQ ID NO: 38609 - DNA, 20 bp, Artificial Sequence
  Description of Artificial Sequence: Synthetic oligonucleotide
  Target: ATXN1; (-) strand; PAM type: NRG; PAM sequence: AGG
tgccttctgttgggtcctca

SEQ ID NO: 38610 - DNA, 20 bp, Artificial Sequence
  Description of Artificial Sequence: Synthetic oligonucleotide
  Target: ATXN1; (-) strand; PAM type: NRG; PAM sequence: AAG
ttgccttctgttgggtcctc

SEQ ID NO: 38611 - DNA, 20 bp, Artificial Sequence
  Description of Artificial Sequence: Synthetic oligonucleotide
  Target: ATXN1; (-) strand; PAM type: NRG; PAM sequence: GGG
gtgtgtctttgccttctgtt

SEQ ID NO: 38612 - DNA, 20 bp, Artificial Sequence
  Description of Artificial Sequence: Synthetic oligonucleotide
  Target: ATXN1; (-) strand; PAM type: NRG; PAM sequence: TGG
tgtgtgtctttgccttctgt

SEQ ID NO: 38613 - DNA, 20 bp, Artificial Sequence
  Description of Artificial Sequence: Synthetic oligonucleotide
  Target: ATXN1; (-) strand; PAM type: NRG; PAM sequence: CAG
taaaataacagtgccaattg

SEQ ID NO: 38614 - DNA, 20 bp, Artificial Sequence
  Description of Artificial Sequence: Synthetic oligonucleotide
  Target: ATXN1; (-) strand; PAM type: NRG; PAM sequence: CAG
tactcgtactaataaaataa

SEQ ID NO: 38615 - DNA, 20 bp, Artificial Sequence
  Description of Artificial Sequence: Synthetic oligonucleotide
  Target: ATXN1; (-) strand; PAM type: NRG; PAM sequence: CAG
ccagtacaagtttattgttt

SEQ ID NO: 38616 - DNA, 20 bp, Artificial Sequence
  Description of Artificial Sequence: Synthetic oligonucleotide
  Target: ATXN1; (-) strand; PAM type: NRG; PAM sequence: AAG
aattgtctgtataccagtac

SEQ ID NO: 38617 - DNA, 20 bp, Artificial Sequence
  Description of Artificial Sequence: Synthetic oligonucleotide
  Target: ATXN1; (-) strand; PAM type: NRG; PAM sequence: CAG
taaataaattgtctgtatac

SEQ ID NO: 38618 - DNA, 20 bp, Artificial Sequence
  Description of Artificial Sequence: Synthetic oligonucleotide
  Target: ATXN1; (-) strand; PAM type: NRG; PAM sequence: TAG
gtgcttgcaggttttctagg

SEQ ID NO: 38619 - DNA, 20 bp, Artificial Sequence
  Description of Artificial Sequence: Synthetic oligonucleotide
  Target: ATXN1; (-) strand; PAM type: NRG; PAM sequence: AGG
atggtgcttgcaggttttct

SEQ ID NO: 38620 - DNA, 20 bp, Artificial Sequence
  Description of Artificial Sequence: Synthetic oligonucleotide
  Target: ATXN1; (-) strand; PAM type: NRG; PAM sequence: TAG
gatggtgcttgcaggttttc

SEQ ID NO: 38621 - DNA, 20 bp, Artificial Sequence
  Description of Artificial Sequence: Synthetic oligonucleotide
  Target: ATXN1; (-) strand; PAM type: NRG; PAM sequence: AGG
ctttctttgatggtgcttgc

SEQ ID NO: 38622 - DNA, 20 bp, Artificial Sequence
  Description of Artificial Sequence: Synthetic oligonucleotide
  Target: ATXN1; (-) strand; PAM type: NRG; PAM sequence: CAG
cctttctttgatggtgcttg

SEQ ID NO: 38623 - DNA, 20 bp, Artificial Sequence
  Description of Artificial Sequence: Synthetic oligonucleotide
  Target: ATXN1; (-) strand; PAM type: NRG; PAM sequence: TGG
tttatggtccctttctttga

SEQ ID NO: 38624 - DNA, 20 bp, Artificial Sequence
  Description of Artificial Sequence: Synthetic oligonucleotide
  Target: ATXN1; (-) strand; PAM type: NRG; PAM sequence: TGG
agtctgtttattgaatttta

SEQ ID NO: 38625 - DNA, 20 bp, Artificial Sequence
  Description of Artificial Sequence: Synthetic oligonucleotide
  Target: ATXN1; (-) strand; PAM type: NRG; PAM sequence: GAG
tctatttgtaggatacactc

SEQ ID NO: 38626 - DNA, 20 bp, Artificial Sequence
  Description of Artificial Sequence: Synthetic oligonucleotide
  Target: ATXN1; (-) strand; PAM type: NRG; PAM sequence: AGG
atcgtggtgtgtctatttgt

SEQ ID NO: 38627 - DNA, 20 bp, Artificial Sequence
  Description of Artificial Sequence: Synthetic oligonucleotide
  Target: ATXN1; (-) strand; PAM type: NRG; PAM sequence: TAG
aatcgtggtgtgtctatttg

SEQ ID NO: 38628 - DNA, 20 bp, Artificial Sequence
  Description of Artificial Sequence: Synthetic oligonucleotide
  Target: ATXN1; (-) strand; PAM type: NRG; PAM sequence: TGG
catattctattttctaatcg

SEQ ID NO: 38629 - DNA, 20 bp, Artificial Sequence
  Description of Artificial Sequence: Synthetic oligonucleotide
  Target: ATXN1; (-) strand; PAM type: NRG; PAM sequence: AAG
aaacaaatattaaaaaatgg

SEQ ID NO: 38630 - DNA, 20 bp, Artificial Sequence
  Description of Artificial Sequence: Synthetic oligonucleotide
  Target: ATXN1; (-) strand; PAM type: NRG; PAM sequence: TGG
tttaaacaaatattaaaaaa

SEQ ID NO: 38631 - DNA, 20 bp, Artificial Sequence
  Description of Artificial Sequence: Synthetic oligonucleotide
  Target: ATXN1; (-) strand; PAM type: NRG; PAM sequence: TAG
gtaaaatattgtacttgcac

SEQ ID NO: 38632 - DNA, 20 bp, Artificial Sequence
  Description of Artificial Sequence: Synthetic oligonucleotide
  Target: ATXN1; (-) strand; PAM type: NRG; PAM sequence: CAG
gtgcatactctctgtaattc

SEQ ID NO: 38633 - DNA, 20 bp, Artificial Sequence
  Description of Artificial Sequence: Synthetic oligonucleotide
  Target: ATXN1; (-) strand; PAM type: NRG; PAM sequence: GAG
aagagcttttattgtgacag

SEQ ID NO: 38634 - DNA, 20 bp, Artificial Sequence
  Description of Artificial Sequence: Synthetic oligonucleotide
  Target: ATXN1; (-) strand; PAM type: NRG; PAM sequence: AGG
ttaagagcttttattgtgac

SEQ ID NO: 38635 - DNA, 20 bp, Artificial Sequence
  Description of Artificial Sequence: Synthetic oligonucleotide
  Target: ATXN1; (-) strand; PAM type: NRG; PAM sequence: CAG
gttaagagcttttattgtga

SEQ ID NO: 38636 - DNA, 20 bp, Artificial Sequence
  Description of Artificial Sequence: Synthetic oligonucleotide
  Target: ATXN1; (-) strand; PAM type: NRG; PAM sequence: GAG
agtgcatacataatagttaa

SEQ ID NO: 38637 - DNA, 20 bp, Artificial Sequence
  Description of Artificial Sequence: Synthetic oligonucleotide
  Target: ATXN1; (-) strand; PAM type: NRG; PAM sequence: AAG
taagtgcatacataatagtt

SEQ ID NO: 38638 - DNA, 20 bp, Artificial Sequence
  Description of Artificial Sequence: Synthetic oligonucleotide
  Target: ATXN1; (-) strand; PAM type: NRG; PAM sequence: TAG
aattttaagtgcatacataa

SEQ ID NO: 38639 - DNA, 20 bp, Artificial Sequence
  Description of Artificial Sequence: Synthetic oligonucleotide
  Target: ATXN1; (-) strand; PAM type: NRG; PAM sequence: AAG
cttattgaaaagaaaatttt

SEQ ID NO: 38640 - DNA, 20 bp, Artificial Sequence
  Description of Artificial Sequence: Synthetic oligonucleotide
  Target: ATXN1; (-) strand; PAM type: NRG; PAM sequence: AAG
atgttttgcaccttattgaa

SEQ ID NO: 38641 - DNA, 20 bp, Artificial Sequence
  Description of Artificial Sequence: Synthetic oligonucleotide
  Target: ATXN1; (-) strand; PAM type: NRG; PAM sequence: AGG
gtacagaggagaactaggga

SEQ ID NO: 38642 - DNA, 20 bp, Artificial Sequence
  Description of Artificial Sequence: Synthetic oligonucleotide
  Target: ATXN1; (-) strand; PAM type: NRG; PAM sequence: AAG
agtacagaggagaactaggg

SEQ ID NO: 38643 - DNA, 20 bp, Artificial Sequence
  Description of Artificial Sequence: Synthetic oligonucleotide
  Target: ATXN1; (-) strand; PAM type: NRG; PAM sequence: GGG
gccagtacagaggagaacta

SEQ ID NO: 38644 - DNA, 20 bp, Artificial Sequence
  Description of Artificial Sequence: Synthetic oligonucleotide
  Target: ATXN1; (-) strand; PAM type: NRG; PAM sequence: AGG
ggccagtacagaggagaact

SEQ ID NO: 38645 - DNA, 20 bp, Artificial Sequence
  Description of Artificial Sequence: Synthetic oligonucleotide
  Target: ATXN1; (-) strand; PAM type: NRG; PAM sequence: TAG
tggccagtacagaggagaac

SEQ ID NO: 38646 - DNA, 20 bp, Artificial Sequence
  Description of Artificial Sequence: Synthetic oligonucleotide
  Target: ATXN1; (-) strand; PAM type: NRG; PAM sequence: GAG
ctgacatggccagtacagag

SEQ ID NO: 38647 - DNA, 20 bp, Artificial Sequence
  Description of Artificial Sequence: Synthetic oligonucleotide
  Target: ATXN1; (-) strand; PAM type: NRG; PAM sequence: AGG
gactgacatggccagtacag

SEQ ID NO: 38648 - DNA, 20 bp, Artificial Sequence
  Description of Artificial Sequence: Synthetic oligonucleotide
  Target: ATXN1; (-) strand; PAM type: NRG; PAM sequence: GAG
agactgacatggccagtaca

SEQ ID NO: 38649 - DNA, 20 bp, Artificial Sequence
  Description of Artificial Sequence: Synthetic oligonucleotide
  Target: ATXN1; (-) strand; PAM type: NRG; PAM sequence: CAG
ccagactgacatggccagta

SEQ ID NO: 38650 - DNA, 20 bp, Artificial Sequence
  Description of Artificial Sequence: Synthetic oligonucleotide
  Target: ATXN1; (-) strand; PAM type: NRG; PAM sequence: CAG
cactaccagactgacatggc

SEQ ID NO: 38651 - DNA, 20 bp, Artificial Sequence
  Description of Artificial Sequence: Synthetic oligonucleotide
  Target: ATXN1; (-) strand; PAM type: NRG; PAM sequence: TGG
agggcactaccagactgaca

SEQ ID NO: 38652 - DNA, 20 bp, Artificial Sequence
  Description of Artificial Sequence: Synthetic oligonucleotide
  Target: ATXN1; (-) strand; PAM type: NRG; PAM sequence: CAG
acttgggttgagggcactac

SEQ ID NO: 38653 - DNA, 20 bp, Artificial Sequence
  Description of Artificial Sequence: Synthetic oligonucleotide
  Target: ATXN1; (-) strand; PAM type: NRG; PAM sequence: GGG
gacaccagaacttgggttga

SEQ ID NO: 38654 - DNA, 20 bp, Artificial Sequence
  Description of Artificial Sequence: Synthetic oligonucleotide
  Target: ATXN1; (-) strand; PAM type: NRG; PAM sequence: AGG
agacaccagaacttgggttg

SEQ ID NO: 38655 - DNA, 20 bp, Artificial Sequence
  Description of Artificial Sequence: Synthetic oligonucleotide
  Target: ATXN1; (-) strand; PAM type: NRG; PAM sequence: GAG
cagacaccagaacttgggtt

SEQ ID NO: 38656 - DNA, 20 bp, Artificial Sequence
  Description of Artificial Sequence: Synthetic oligonucleotide
  Target: ATXN1; (-) strand; PAM type: NRG; PAM sequence: GGG
gaaaacagacaccagaactt

SEQ ID NO: 38657 - DNA, 20 bp, Artificial Sequence
  Description of Artificial Sequence: Synthetic oligonucleotide
  Target: ATXN1; (-) strand; PAM type: NRG; PAM sequence: TGG
ggaaaacagacaccagaact

SEQ ID NO: 38658 - DNA, 20 bp, Artificial Sequence
  Description of Artificial Sequence: Synthetic oligonucleotide
  Target: ATXN1; (-) strand; PAM type: NRG; PAM sequence: CAG
ggccaagggaaaacagacac

SEQ ID NO: 38659 - DNA, 20 bp, Artificial Sequence
  Description of Artificial Sequence: Synthetic oligonucleotide
  Target: ATXN1; (-) strand; PAM type: NRG; PAM sequence: CAG
tcccacaggccaagggaaaa

SEQ ID NO: 38660 - DNA, 20 bp, Artificial Sequence
  Description of Artificial Sequence: Synthetic oligonucleotide
  Target: ATXN1; (-) strand; PAM type: NRG; PAM sequence: GGG
atatgcctcccacaggccaa

SEQ ID NO: 38661 - DNA, 20 bp, Artificial Sequence
  Description of Artificial Sequence: Synthetic oligonucleotide
  Target: ATXN1; (-) strand; PAM type: NRG; PAM sequence: AGG
catatgcctcccacaggcca

SEQ ID NO: 38662 - DNA, 20 bp, Artificial Sequence
  Description of Artificial Sequence: Synthetic oligonucleotide
  Target: ATXN1; (-) strand; PAM type: NRG; PAM sequence: AAG
ccatatgcctcccacaggcc

SEQ ID NO: 38663 - DNA, 20 bp, Artificial Sequence
  Description of Artificial Sequence: Synthetic oligonucleotide
  Target: ATXN1; (-) strand; PAM type: NRG; PAM sequence: AGG
acccaccatatgcctcccac

SEQ ID NO: 38664 - DNA, 20 bp, Artificial Sequence
  Description of Artificial Sequence: Synthetic oligonucleotide
  Target: ATXN1; (-) strand; PAM type: NRG; PAM sequence: CAG
tacccaccatatgcctccca

SEQ ID NO: 38665 - DNA, 20 bp, Artificial Sequence
  Description of Artificial Sequence: Synthetic oligonucleotide
  Target: ATXN1; (-) strand; PAM type: NRG; PAM sequence: CAG
actactggatgttttaatat

SEQ ID NO: 38666 - DNA, 20 bp, Artificial Sequence
  Description of Artificial Sequence: Synthetic oligonucleotide
  Target: ATXN1; (-) strand; PAM type: NRG; PAM sequence: TGG
atctctgagactcgtactac

SEQ ID NO: 38667 - DNA, 20 bp, Artificial Sequence
  Description of Artificial Sequence: Synthetic oligonucleotide
  Target: ATXN1; (-) strand; PAM type: NRG; PAM sequence: GAG
ctggctccagagccatctct

SEQ ID NO: 38668 - DNA, 20 bp, Artificial Sequence
  Description of Artificial Sequence: Synthetic oligonucleotide
  Target: ATXN1; (-) strand; PAM type: NRG; PAM sequence: GAG
ccagtggagtcctggctcca

SEQ ID NO: 38669 - DNA, 20 bp, Artificial Sequence
  Description of Artificial Sequence: Synthetic oligonucleotide
  Target: ATXN1; (-) strand; PAM type: NRG; PAM sequence: CAG
agccagtggagtcctggctc

SEQ ID NO: 38670 - DNA, 20 bp, Artificial Sequence
  Description of Artificial Sequence: Synthetic oligonucleotide
  Target: ATXN1; (-) strand; PAM type: NRG; PAM sequence: TGG
atttccagccagtggagtcc

SEQ ID NO: 38671 - DNA, 20 bp, Artificial Sequence
  Description of Artificial Sequence: Synthetic oligonucleotide
  Target: ATXN1; (-) strand; PAM type: NRG; PAM sequence: GAG
gtcttcatttccagccagtg

SEQ ID NO: 38672 - DNA, 20 bp, Artificial Sequence
  Description of Artificial Sequence: Synthetic oligonucleotide
  Target: ATXN1; (-) strand; PAM type: NRG; PAM sequence: TGG
cagtcttcatttccagccag

SEQ ID NO: 38673 - DNA, 20 bp, Artificial Sequence
  Description of Artificial Sequence: Synthetic oligonucleotide
  Target: ATXN1; (-) strand; PAM type: NRG; PAM sequence: CAG
agacagtcttcatttccagc

SEQ ID NO: 38674 - DNA, 20 bp, Artificial Sequence
  Description of Artificial Sequence: Synthetic oligonucleotide
  Target: ATXN1; (-) strand; PAM type: NRG; PAM sequence: CAG
gattagacagtcttcatttc

SEQ ID NO: 38675 - DNA, 20 bp, Artificial Sequence
  Description of Artificial Sequence: Synthetic oligonucleotide
  Target: ATXN1; (-) strand; PAM type: NRG; PAM sequence: CAG
gtggtgaccttcagattaga

SEQ ID NO: 38676 - DNA, 20 bp, Artificial Sequence
  Description of Artificial Sequence: Synthetic oligonucleotide
  Target: ATXN1; (-) strand; PAM type: NRG; PAM sequence: TAG
atttgtggtgaccttcagat

SEQ ID NO: 38677 - DNA, 20 bp, Artificial Sequence
  Description of Artificial Sequence: Synthetic oligonucleotide
  Target: ATXN1; (-) strand; PAM type: NRG; PAM sequence: CAG
tcagtatttgtggtgacctt

SEQ ID NO: 38678 - DNA, 20 bp, Artificial Sequence
  Description of Artificial Sequence: Synthetic oligonucleotide
  Target: ATXN1; (-) strand; PAM type: NRG; PAM sequence: TGG
gatagtcctgtcagtatttg

SEQ ID NO: 38679 - DNA, 20 bp, Artificial Sequence
  Description of Artificial Sequence: Synthetic oligonucleotide
  Target: ATXN1; (-) strand; PAM type: NRG; PAM sequence: CAG
aggtttcaagatagtcctgt

SEQ ID NO: 38680 - DNA, 20 bp, Artificial Sequence
  Description of Artificial Sequence: Synthetic oligonucleotide
  Target: ATXN1; (-) strand; PAM type: NRG; PAM sequence: TAG
gccgaaaggaggtttcaaga

SEQ ID NO: 38681 - DNA, 20 bp, Artificial Sequence
  Description of Artificial Sequence: Synthetic oligonucleotide
  Target: ATXN1; (-) strand; PAM type: NRG; PAM sequence: AAG
gtcagccgaaaggaggtttc

SEQ ID NO: 38682 - DNA, 20 bp, Artificial Sequence
  Description of Artificial Sequence: Synthetic oligonucleotide
  Target: ATXN1; (-) strand; PAM type: NRG; PAM sequence: AGG
aattagtgtcagccgaaagg

SEQ ID NO: 38683 - DNA, 20 bp, Artificial Sequence
  Description of Artificial Sequence: Synthetic oligonucleotide
  Target: ATXN1; (-) strand; PAM type: NRG; PAM sequence: GAG
aaattagtgtcagccgaaag

SEQ ID NO: 38684 - DNA, 20 bp, Artificial Sequence
  Description of Artificial Sequence: Synthetic oligonucleotide
  Target: ATXN1; (-) strand; PAM type: NRG; PAM sequence: AGG
ccaaattagtgtcagccgaa

SEQ ID NO: 38685 - DNA, 20 bp, Artificial Sequence
  Description of Artificial Sequence: Synthetic oligonucleotide
  Target: ATXN1; (-) strand; PAM type: NRG; PAM sequence: AAG
cccaaattagtgtcagccga

SEQ ID NO: 38686 - DNA, 20 bp, Artificial Sequence
  Description of Artificial Sequence: Synthetic oligonucleotide
  Target: ATXN1; (-) strand; PAM type: NRG; PAM sequence: CAG
ctctaaacccaaattagtgt

SEQ ID NO: 38687 - DNA, 20 bp, Artificial Sequence
  Description of Artificial Sequence: Synthetic oligonucleotide
  Target: ATXN1; (-) strand; PAM type: NRG; PAM sequence: TAG
gctcaactctaaacccaaat

SEQ ID NO: 38688 - DNA, 20 bp, Artificial Sequence
  Description of Artificial Sequence: Synthetic oligonucleotide
  Target: ATXN1; (-) strand; PAM type: NRG; PAM sequence: CAG
gcggggtttcctcatctccc

SEQ ID NO: 38689 - DNA, 20 bp, Artificial Sequence
  Description of Artificial Sequence: Synthetic oligonucleotide
  Target: ATXN1; (-) strand; PAM type: NRG; PAM sequence: GGG
gaatactgccctttttggcg

SEQ ID NO: 38690 - DNA, 20 bp, Artificial Sequence
  Description of Artificial Sequence: Synthetic oligonucleotide
  Target: ATXN1; (-) strand; PAM type: NRG; PAM sequence: GGG
tgaatactgccctttttggc

SEQ ID NO: 38691 - DNA, 20 bp, Artificial Sequence
  Description of Artificial Sequence: Synthetic oligonucleotide
  Target: ATXN1; (-) strand; PAM type: NRG; PAM sequence: CGG
gtgaatactgccctttttgg

SEQ ID NO: 38692 - DNA, 20 bp, Artificial Sequence
  Description of Artificial Sequence: Synthetic oligonucleotide
  Target: ATXN1; (-) strand; PAM type: NRG; PAM sequence: TGG
tctgtgaatactgccctttt

SEQ ID NO: 38693 - DNA, 20 bp, Artificial Sequence
  Description of Artificial Sequence: Synthetic oligonucleotide
  Target: ATXN1; (-) strand; PAM type: NRG; PAM sequence: CAG
gaacttgatacctgtgcatt

SEQ ID NO: 38694 - DNA, 20 bp, Artificial Sequence
  Description of Artificial Sequence: Synthetic oligonucleotide
  Target: ATXN1; (-) strand; PAM type: NRG; PAM sequence: TAG
agtggggtaaatcctttagt

SEQ ID NO: 38695 - DNA, 20 bp, Artificial Sequence
  Description of Artificial Sequence: Synthetic oligonucleotide
  Target: ATXN1; (-) strand; PAM type: NRG; PAM sequence: TAG
caggagtggggtaaatcctt

SEQ ID NO: 38696 - DNA, 20 bp, Artificial Sequence
  Description of Artificial Sequence: Synthetic oligonucleotide
  Target: ATXN1; (-) strand; PAM type: NRG; PAM sequence: GGG
agttttctggcccaggagtg

SEQ ID NO: 38697 - DNA, 20 bp, Artificial Sequence
  Description of Artificial Sequence: Synthetic oligonucleotide
  Target: ATXN1; (-) strand; PAM type: NRG; PAM sequence: GGG
cagttttctggcccaggagt

SEQ ID NO: 38698 - DNA, 20 bp, Artificial Sequence
  Description of Artificial Sequence: Synthetic oligonucleotide
  Target: ATXN1; (-) strand; PAM type: NRG; PAM sequence: TGG
tcagttttctggcccaggag

SEQ ID NO: 38699 - DNA, 20 bp, Artificial Sequence
  Description of Artificial Sequence: Synthetic oligonucleotide
  Target: ATXN1; (-) strand; PAM type: NRG; PAM sequence: GAG
ctttcagttttctggcccag

SEQ ID NO: 38700 - DNA, 20 bp, Artificial Sequence
  Description of Artificial Sequence: Synthetic oligonucleotide
  Target: ATXN1; (-) strand; PAM type: NRG; PAM sequence: AGG
ctctttcagttttctggccc

SEQ ID NO: 38701 - DNA, 20 bp, Artificial Sequence
  Description of Artificial Sequence: Synthetic oligonucleotide
  Target: ATXN1; (-) strand; PAM type: NRG; PAM sequence: CAG
actctttcagttttctggcc

SEQ ID NO: 38702 - DNA, 20 bp, Artificial Sequence
  Description of Artificial Sequence: Synthetic oligonucleotide
  Target: ATXN1; (-) strand; PAM type: NRG; PAM sequence: TGG
cacctactctttcagttttc

SEQ ID NO: 38703 - DNA, 20 bp, Artificial Sequence
  Description of Artificial Sequence: Synthetic oligonucleotide
  Target: ATXN1; (-) strand; PAM type: NRG; PAM sequence: CAG
acaggaaccacctactcttt

SEQ ID NO: 38704 - DNA, 20 bp, Artificial Sequence
  Description of Artificial Sequence: Synthetic oligonucleotide
  Target: ATXN1; (-) strand; PAM type: NRG; PAM sequence: AGG
aggttttctctggttcttac

SEQ ID NO: 38705 - DNA, 20 bp, Artificial Sequence
  Description of Artificial Sequence: Synthetic oligonucleotide
  Target: ATXN1; (-) strand; PAM type: NRG; PAM sequence: CAG
caggttttctctggttctta

SEQ ID NO: 38706 - DNA, 20 bp, Artificial Sequence
  Description of Artificial Sequence: Synthetic oligonucleotide
  Target: ATXN1; (-) strand; PAM type: NRG; PAM sequence: TGG
ctcggtgcacaggttttctc

SEQ ID NO: 38707 - DNA, 20 bp, Artificial Sequence
  Description of Artificial Sequence: Synthetic oligonucleotide
  Target: ATXN1; (-) strand; PAM type: NRG; PAM sequence: AGG
taccaagaagctcggtgcac

SEQ ID NO: 38708 - DNA, 20 bp, Artificial Sequence
  Description of Artificial Sequence: Synthetic oligonucleotide
  Target: ATXN1; (-) strand; PAM type: NRG; PAM sequence: CAG
ttaccaagaagctcggtgca

SEQ ID NO: 38709 - DNA, 20 bp, Artificial Sequence
  Description of Artificial Sequence: Synthetic oligonucleotide
  Target: ATXN1; (-) strand; PAM type: NRG; PAM sequence: CGG
agagcagttaccaagaagct

SEQ ID NO: 38710 - DNA, 20 bp, Artificial Sequence
  Description of Artificial Sequence: Synthetic oligonucleotide
  Target: ATXN1; (-) strand; PAM type: NRG; PAM sequence: AAG
tcttcagagcagttaccaag

SEQ ID NO: 38711 - DNA, 20 bp, Artificial Sequence
  Description of Artificial Sequence: Synthetic oligonucleotide
  Target: ATXN1; (-) strand; PAM type: NRG; PAM sequence: AAG
ttgtcttcagagcagttacc

SEQ ID NO: 38712 - DNA, 20 bp, Artificial Sequence
  Description of Artificial Sequence: Synthetic oligonucleotide
  Target: ATXN1; (-) strand; PAM type: NRG; PAM sequence: CAG
tcaagctgttgtcttcagag

SEQ ID NO: 38713 - DNA, 20 bp, Artificial Sequence
  Description of Artificial Sequence: Synthetic oligonucleotide
  Target: ATXN1; (-) strand; PAM type: NRG; PAM sequence: GAG
agctcaagctgttgtcttca

SEQ ID NO: 38714 - DNA, 20 bp, Artificial Sequence
  Description of Artificial Sequence: Synthetic oligonucleotide
  Target: ATXN1; (-) strand; PAM type: NRG; PAM sequence: CAG
ctagctcaagctgttgtctt

SEQ ID NO: 38715 - DNA, 20 bp, Artificial Sequence
  Description of Artificial Sequence: Synthetic oligonucleotide
  Target: ATXN1; (-) strand; PAM type: NRG; PAM sequence: AAG
gtattaggtgacactagctc

SEQ ID NO: 38716 - DNA, 20 bp, Artificial Sequence
  Description of Artificial Sequence: Synthetic oligonucleotide
  Target: ATXN1; (-) strand; PAM type: NRG; PAM sequence: TAG
taccaagtattaggtgacac

SEQ ID NO: 38717 - DNA, 20 bp, Artificial Sequence
  Description of Artificial Sequence: Synthetic oligonucleotide
  Target: ATXN1; (-) strand; PAM type: NRG; PAM sequence: AGG
cctccagaataccaagtatt

SEQ ID NO: 38718 - DNA, 20 bp, Artificial Sequence
  Description of Artificial Sequence: Synthetic oligonucleotide
  Target: ATXN1; (-) strand; PAM type: NRG; PAM sequence: TAG
tcctccagaataccaagtat

SEQ ID NO: 38719 - DNA, 20 bp, Artificial Sequence
  Description of Artificial Sequence: Synthetic oligonucleotide
  Target: ATXN1; (-) strand; PAM type: NRG; PAM sequence: AAG
atactgtcctccagaatacc

SEQ ID NO: 38720 - DNA, 20 bp, Artificial Sequence
  Description of Artificial Sequence: Synthetic oligonucleotide
  Target: ATXN1; (-) strand; PAM type: NRG; PAM sequence: CAG
caagataacatactgtcctc

SEQ ID NO: 38721 - DNA, 20 bp, Artificial Sequence
  Description of Artificial Sequence: Synthetic oligonucleotide
  Target: ATXN1; (-) strand; PAM type: NRG; PAM sequence: AAG
tgtttacagtaatccttacc

SEQ ID NO: 38722 - DNA, 20 bp, Artificial Sequence
  Description of Artificial Sequence: Synthetic oligonucleotide
  Target: ATXN1; (-) strand; PAM type: NRG; PAM sequence: CAG
ttcgttggaagtgttgttta

SEQ ID NO: 38723 - DNA, 20 bp, Artificial Sequence
  Description of Artificial Sequence: Synthetic oligonucleotide
  Target: ATXN1; (-) strand; PAM type: NRG; PAM sequence: AAG
aatctgaaggccttcgttgg

SEQ ID NO: 38724 - DNA, 20 bp, Artificial Sequence
  Description of Artificial Sequence: Synthetic oligonucleotide
  Target: ATXN1; (-) strand; PAM type: NRG; PAM sequence: TGG
gccaatctgaaggccttcgt

SEQ ID NO: 38725 - DNA, 20 bp, Artificial Sequence
  Description of Artificial Sequence: Synthetic oligonucleotide
  Target: ATXN1; (-) strand; PAM type: NRG; PAM sequence: AGG
cttttctgtggccaatctga

SEQ ID NO: 38726 - DNA, 20 bp, Artificial Sequence
  Description of Artificial Sequence: Synthetic oligonucleotide
  Target: ATXN1; (-) strand; PAM type: NRG; PAM sequence: AAG
ccttttctgtggccaatctg

SEQ ID NO: 38727 - DNA, 20 bp, Artificial Sequence
  Description of Artificial Sequence: Synthetic oligonucleotide
  Target: ATXN1; (-) strand; PAM type: NRG; PAM sequence: TGG
tgagcctgtctccttttctg

SEQ ID NO: 38728 - DNA, 20 bp, Artificial Sequence
  Description of Artificial Sequence: Synthetic oligonucleotide
  Target: ATXN1; (-) strand; PAM type: NRG; PAM sequence: GAG
ttgctgtctggatggccaat

SEQ ID NO: 38729 - DNA, 20 bp, Artificial Sequence
  Description of Artificial Sequence: Synthetic oligonucleotide
  Target: ATXN1; (-) strand; PAM type: NRG; PAM sequence: TGG
tagtttgtttgctgtctgga

SEQ ID NO: 38730 - DNA, 20 bp, Artificial Sequence
  Description of Artificial Sequence: Synthetic oligonucleotide
  Target: ATXN1; (-) strand; PAM type: NRG; PAM sequence: TGG
cctttagtttgtttgctgtc

SEQ ID NO: 38731 - DNA, 20 bp, Artificial Sequence
  Description of Artificial Sequence: Synthetic oligonucleotide
  Target: ATXN1; (-) strand; PAM type: NRG; PAM sequence: TAG
acccacgttttctttccctt

SEQ ID NO: 38732 - DNA, 20 bp, Artificial Sequence
  Description of Artificial Sequence: Synthetic oligonucleotide
  Target: ATXN1; (-) strand; PAM type: NRG; PAM sequence: AGG
ttccactgcagatacattgg

SEQ ID NO: 38733 - DNA, 20 bp, Artificial Sequence
  Description of Artificial Sequence: Synthetic oligonucleotide
  Target: ATXN1; (-) strand; PAM type: NRG; PAM sequence: GAG
cttccactgcagatacattg

SEQ ID NO: 38734 - DNA, 20 bp, Artificial Sequence
  Description of Artificial Sequence: Synthetic oligonucleotide
  Target: ATXN1; (-) strand; PAM type: NRG; PAM sequence: TGG
gtcttccactgcagatacat

SEQ ID NO: 38735 - DNA, 20 bp, Artificial Sequence
  Description of Artificial Sequence: Synthetic oligonucleotide
  Target: ATXN1; (-) strand; PAM type: NRG; PAM sequence: CAG
aggactcaagtcttccactg

SEQ ID NO: 38736 - DNA, 20 bp, Artificial Sequence
  Description of Artificial Sequence: Synthetic oligonucleotide
  Target: ATXN1; (-) strand; PAM type: NRG; PAM sequence: AAG
tttcttatctgaaaggactc

SEQ ID NO: 38737 - DNA, 20 bp, Artificial Sequence
  Description of Artificial Sequence: Synthetic oligonucleotide
  Target: ATXN1; (-) strand; PAM type: NRG; PAM sequence: AGG
cataacttttcttatctgaa

SEQ ID NO: 38738 - DNA, 20 bp, Artificial Sequence
  Description of Artificial Sequence: Synthetic oligonucleotide
  Target: ATXN1; (-) strand; PAM type: NRG; PAM sequence: AAG
ccataacttttcttatctga

SEQ ID NO: 38739 - DNA, 20 bp, Artificial Sequence
  Description of Artificial Sequence: Synthetic oligonucleotide
  Target: ATXN1; (-) strand; PAM type: NRG; PAM sequence: AAG
atacaataacaacaatctct

SEQ ID NO: 38740 - DNA, 20 bp, Artificial Sequence
  Description of Artificial Sequence: Synthetic oligonucleotide
  Target: ATXN1; (-) strand; PAM type: NRG; PAM sequence: TAG
aagtgcatttggccaatagg

SEQ ID NO: 38741 - DNA, 20 bp, Artificial Sequence
  Description of Artificial Sequence: Synthetic oligonucleotide
  Target: ATXN1; (-) strand; PAM type: NRG; PAM sequence: AGG
attaagtgcatttggccaat

SEQ ID NO: 38742 - DNA, 20 bp, Artificial Sequence
  Description of Artificial Sequence: Synthetic oligonucleotide
  Target: ATXN1; (-) strand; PAM type: NRG; PAM sequence: TAG
aattaagtgcatttggccaa

SEQ ID NO: 38743 - DNA, 20 bp, Artificial Sequence
  Description of Artificial Sequence: Synthetic oligonucleotide
  Target: ATXN1; (-) strand; PAM type: NRG; PAM sequence: TGG
gtattaaaattaagtgcatt

SEQ ID NO: 38744 - DNA, 20 bp, Artificial Sequence
  Description of Artificial Sequence: Synthetic oligonucleotide
  Target: ATXN1; (-) strand; PAM type: NRG; PAM sequence: AAG
ggttcaactgtattaaaatt

SEQ ID NO: 38745 - DNA, 20 bp, Artificial Sequence
  Description of Artificial Sequence: Synthetic oligonucleotide
  Target: ATXN1; (-) strand; PAM type: NRG; PAM sequence: TGG
ccccatgacttgcatacaaa

SEQ ID NO: 38746 - DNA, 20 bp, Artificial Sequence
  Description of Artificial Sequence: Synthetic oligonucleotide
  Target: ATXN1; (-) strand; PAM type: NRG; PAM sequence: CAG
gcgggagggaacaccggctt

SEQ ID NO: 38747 - DNA, 20 bp, Artificial Sequence
  Description of Artificial Sequence: Synthetic oligonucleotide
  Target: ATXN1; (-) strand; PAM type: NRG; PAM sequence: CGG
gtaatggcgggagggaacac

SEQ ID NO: 38748 - DNA, 20 bp, Artificial Sequence
  Description of Artificial Sequence: Synthetic oligonucleotide
  Target: ATXN1; (-) strand; PAM type: NRG; PAM sequence: GGG
tctcctgtgtaatggcggga

SEQ ID NO: 38749 - DNA, 20 bp, Artificial Sequence
  Description of Artificial Sequence: Synthetic oligonucleotide
  Target: ATXN1; (-) strand; PAM type: NRG; PAM sequence: AGG
ttctcctgtgtaatggcggg

SEQ ID NO: 38750 - DNA, 20 bp, Artificial Sequence
  Description of Artificial Sequence: Synthetic oligonucleotide
  Target: ATXN1; (-) strand; PAM type: NRG; PAM sequence: GAG
tttctcctgtgtaatggcgg

SEQ ID NO: 38751 - DNA, 20 bp, Artificial Sequence
  Description of Artificial Sequence: Synthetic oligonucleotide
  Target: ATXN1; (-) strand; PAM type: NRG; PAM sequence: GGG
actttctcctgtgtaatggc

SEQ ID NO: 38752 - DNA, 20 bp, Artificial Sequence
  Description of Artificial Sequence: Synthetic oligonucleotide
  Target: ATXN1; (-) strand; PAM type: NRG; PAM sequence: CGG
aactttctcctgtgtaatgg

SEQ ID NO: 38753 - DNA, 20 bp, Artificial Sequence
  Description of Artificial Sequence: Synthetic oligonucleotide
  Target: ATXN1; (-) strand; PAM type: NRG; PAM sequence: TGG
gctaactttctcctgtgtaa

SEQ ID NO: 38754 - DNA, 20 bp, Artificial Sequence
  Description of Artificial Sequence: Synthetic oligonucleotide
  Target: ATXN1; (-) strand; PAM type: NRG; PAM sequence: TAG
gttgaaggcaactgttctgg

SEQ ID NO: 38755 - DNA, 20 bp, Artificial Sequence
  Description of Artificial Sequence: Synthetic oligonucleotide
  Target: ATXN1; (-) strand; PAM type: NRG; PAM sequence: TGG
ctcgttgaaggcaactgttc

SEQ ID NO: 38756 - DNA, 20 bp, Artificial Sequence
  Description of Artificial Sequence: Synthetic oligonucleotide
  Target: ATXN1; (-) strand; PAM type: NRG; PAM sequence: AGG
gtcccctcccttctcgttga

SEQ ID NO: 38757 - DNA, 20 bp, Artificial Sequence
  Description of Artificial Sequence: Synthetic oligonucleotide
  Target: ATXN1; (-) strand; PAM type: NRG; PAM sequence: AAG
cgtcccctcccttctcgttg

SEQ ID NO: 38758 - DNA, 20 bp, Artificial Sequence
  Description of Artificial Sequence: Synthetic oligonucleotide
  Target: ATXN1; (-) strand; PAM type: NRG; PAM sequence: CAG
ccacttacaattcttaaatt

SEQ ID NO: 38759 - DNA, 20 bp, Artificial Sequence
  Description of Artificial Sequence: Synthetic oligonucleotide
  Target: ATXN1; (-) strand; PAM type: NRG; PAM sequence: AAG
tggacagctgtggggatatt

SEQ ID NO: 38760 - DNA, 20 bp, Artificial Sequence
  Description of Artificial Sequence: Synthetic oligonucleotide
  Target: ATXN1; (-) strand; PAM type: NRG; PAM sequence: GGG
gtggaaactggacagctgtg

SEQ ID NO: 38761 - DNA, 20 bp, Artificial Sequence
  Description of Artificial Sequence: Synthetic oligonucleotide
  Target: ATXN1; (-) strand; PAM type: NRG; PAM sequence: GGG
agtggaaactggacagctgt

SEQ ID NO: 38762 - DNA, 20 bp, Artificial Sequence
  Description of Artificial Sequence: Synthetic oligonucleotide
  Target: ATXN1; (-) strand; PAM type: NRG; PAM sequence: TGG
cagtggaaactggacagctg

SEQ ID NO: 38763 - DNA, 20 bp, Artificial Sequence
  Description of Artificial Sequence: Synthetic oligonucleotide
  Target: ATXN1; (-) strand; PAM type: NRG; PAM sequence: CAG
gccggacagtggaaactgga

SEQ ID NO: 38764 - DNA, 20 bp, Artificial Sequence
  Description of Artificial Sequence: Synthetic oligonucleotide
  Target: ATXN1; (-) strand; PAM type: NRG; PAM sequence: TGG
tcaagccggacagtggaaac

SEQ ID NO: 38765 - DNA, 20 bp, Artificial Sequence
  Description of Artificial Sequence: Synthetic oligonucleotide
  Target: ATXN1; (-) strand; PAM type: NRG; PAM sequence: TGG
ccaaaaatcaagccggacag

SEQ ID NO: 38766 - DNA, 20 bp, Artificial Sequence
  Description of Artificial Sequence: Synthetic oligonucleotide
  Target: ATXN1; (-) strand; PAM type: NRG; PAM sequence: CAG
tgtccaaaaatcaagccgga

SEQ ID NO: 38767 - DNA, 20 bp, Artificial Sequence
  Description of Artificial Sequence: Synthetic oligonucleotide
  Target: ATXN1; (-) strand; PAM type: NRG; PAM sequence: CGG
ttcctgtccaaaaatcaagc

SEQ ID NO: 38768 - DNA, 20 bp, Artificial Sequence
  Description of Artificial Sequence: Synthetic oligonucleotide
  Target: ATXN1; (-) strand; PAM type: NRG; PAM sequence: AAG
agtattcctgtccaaaaatc

SEQ ID NO: 38769 - DNA, 20 bp, Artificial Sequence
  Description of Artificial Sequence: Synthetic oligonucleotide
  Target: ATXN1; (-) strand; PAM type: NRG; PAM sequence: TAG
tacggagcatcttctcagaa

SEQ ID NO: 38770 - DNA, 20 bp, Artificial Sequence
  Description of Artificial Sequence: Synthetic oligonucleotide
  Target: ATXN1; (-) strand; PAM type: NRG; PAM sequence: CAG
ataaatacggagcatcttct

SEQ ID NO: 38771 - DNA, 20 bp, Artificial Sequence
  Description of Artificial Sequence: Synthetic oligonucleotide
  Target: ATXN1; (-) strand; PAM type: NRG; PAM sequence: GAG
aagaggccagaataaatacg

SEQ ID NO: 38772 - DNA, 20 bp, Artificial Sequence
  Description of Artificial Sequence: Synthetic oligonucleotide
  Target: ATXN1; (-) strand; PAM type: NRG; PAM sequence: CGG
taaagaggccagaataaata

SEQ ID NO: 38773 - DNA, 20 bp, Artificial Sequence
  Description of Artificial Sequence: Synthetic oligonucleotide
  Target: ATXN1; (-) strand; PAM type: NRG; PAM sequence: CAG
tttatttaatataaagaggc

SEQ ID NO: 38774 - DNA, 20 bp, Artificial Sequence
  Description of Artificial Sequence: Synthetic oligonucleotide
  Target: ATXN1; (-) strand; PAM type: NRG; PAM sequence: AGG
gatttttatttaatataaag

SEQ ID NO: 38775 - DNA, 20 bp, Artificial Sequence
  Description of Artificial Sequence: Synthetic oligonucleotide
  Target: ATXN1; (-) strand; PAM type: NRG; PAM sequence: GAG
tgatttttatttaatataaa

SEQ ID NO: 38776 - DNA, 20 bp, Artificial Sequence
  Description of Artificial Sequence: Synthetic oligonucleotide
  Target: ATXN1; (-) strand; PAM type: NRG; PAM sequence: AAG
tttgatttttatttaatata

SEQ ID NO: 38777 - DNA, 20 bp, Artificial Sequence
  Description of Artificial Sequence: Synthetic oligonucleotide
  Target: ATXN1; (-) strand; PAM type: NRG; PAM sequence: TAG
gtaaatgcctcattttattt

SEQ ID NO: 38778 - DNA, 20 bp, Artificial Sequence
  Description of Artificial Sequence: Synthetic oligonucleotide
  Target: ATXN1; (-) strand; PAM type: NRG; PAM sequence: GAG
acacctcatttaaatggggg

SEQ ID NO: 38779 - DNA, 20 bp, Artificial Sequence
  Description of Artificial Sequence: Synthetic oligonucleotide
  Target: ATXN1; (-) strand; PAM type: NRG; PAM sequence: GGG
ccacacctcatttaaatggg

SEQ ID NO: 38780 - DNA, 20 bp, Artificial Sequence
  Description of Artificial Sequence: Synthetic oligonucleotide
  Target: ATXN1; (-) strand; PAM type: NRG; PAM sequence: GGG
cccacacctcatttaaatgg

SEQ ID NO: 38781 - DNA, 20 bp, Artificial Sequence
  Description of Artificial Sequence: Synthetic oligonucleotide
  Target: ATXN1; (-) strand; PAM type: NRG; PAM sequence: GGG
ccccacacctcatttaaatg

SEQ ID NO: 38782 - DNA, 20 bp, Artificial Sequence
  Description of Artificial Sequence: Synthetic oligonucleotide
  Target: ATXN1; (-) strand; PAM type: NRG; PAM sequence: GGG
cccccacacctcatttaaat

SEQ ID NO: 38783 - DNA, 20 bp, Artificial Sequence
  Description of Artificial Sequence: Synthetic oligonucleotide
  Target: ATXN1; (-) strand; PAM type: NRG; PAM sequence: TGG
ccccccacacctcatttaaa

SEQ ID NO: 38784 - DNA, 20 bp, Artificial Sequence
  Description of Artificial Sequence: Synthetic oligonucleotide
  Target: ATXN1; (-) strand; PAM type: NRG; PAM sequence: GGG
atcaaacaggactcattatg

SEQ ID NO: 38785 - DNA, 20 bp, Artificial Sequence
  Description of Artificial Sequence: Synthetic oligonucleotide
  Target: ATXN1; (-) strand; PAM type: NRG; PAM sequence: GGG
aatcaaacaggactcattat

SEQ ID NO: 38786 - DNA, 20 bp, Artificial Sequence
  Description of Artificial Sequence: Synthetic oligonucleotide
  Target: ATXN1; (-) strand; PAM type: NRG; PAM sequence: TGG
caatcaaacaggactcatta

SEQ ID NO: 38787 - DNA, 20 bp, Artificial Sequence
  Description of Artificial Sequence: Synthetic oligonucleotide
  Target: ATXN1; (-) strand; PAM type: NRG; PAM sequence: AGG
atccaggctaccaatcaaac

SEQ ID NO: 38788 - DNA, 20 bp, Artificial Sequence
  Description of Artificial Sequence: Synthetic oligonucleotide
  Target: ATXN1; (-) strand; PAM type: NRG; PAM sequence: CAG
gatccaggctaccaatcaaa

SEQ ID NO: 38789 - DNA, 20 bp, Artificial Sequence
  Description of Artificial Sequence: Synthetic oligonucleotide
  Target: ATXN1; (-) strand; PAM type: NRG; PAM sequence: AGG
gtgtttgtaacaagggatcc

SEQ ID NO: 38790 - DNA, 20 bp, Artificial Sequence
  Description of Artificial Sequence: Synthetic oligonucleotide
  Target: ATXN1; (-) strand; PAM type: NRG; PAM sequence: CAG
agtgtttgtaacaagggatc

SEQ ID NO: 38791 - DNA, 20 bp, Artificial Sequence
  Description of Artificial Sequence: Synthetic oligonucleotide
  Target: ATXN1; (-) strand; PAM type: NRG; PAM sequence: GGG
acacgaagtgtttgtaacaa

SEQ ID NO: 38792 - DNA, 20 bp, Artificial Sequence
  Description of Artificial Sequence: Synthetic oligonucleotide
  Target: ATXN1; (-) strand; PAM type: NRG; PAM sequence: AGG
aacacgaagtgtttgtaaca

SEQ ID NO: 38793 - DNA, 20 bp, Artificial Sequence
  Description of Artificial Sequence: Synthetic oligonucleotide
  Target: ATXN1; (-) strand; PAM type: NRG; PAM sequence: AAG
gaacacgaagtgtttgtaac

SEQ ID NO: 38794 - DNA, 20 bp, Artificial Sequence
  Description of Artificial Sequence: Synthetic oligonucleotide
  Target: ATXN1; (-) strand; PAM type: NRG; PAM sequence: AAG
agaatataatcttgaacacg

SEQ ID NO: 38795 - DNA, 20 bp, Artificial Sequence
  Description of Artificial Sequence: Synthetic oligonucleotide
  Target: ATXN1; (-) strand; PAM type: NRG; PAM sequence: AAG
ttcctgttcctataaaccca

SEQ ID NO: 38796 - DNA, 20 bp, Artificial Sequence
  Description of Artificial Sequence: Synthetic oligonucleotide
  Target: ATXN1; (-) strand; PAM type: NRG; PAM sequence: CAG
gagatgatgtttgacatttt

SEQ ID NO: 38797 - DNA, 20 bp, Artificial Sequence
  Description of Artificial Sequence: Synthetic oligonucleotide
  Target: ATXN1; (-) strand; PAM type: NRG; PAM sequence: GAG
ttgcaacttctttttcttca

SEQ ID NO: 38798 - DNA, 20 bp, Artificial Sequence
  Description of Artificial Sequence: Synthetic oligonucleotide
  Target: ATXN1; (-) strand; PAM type: NRG; PAM sequence: CAG
cattgcaacttctttttctt

SEQ ID NO: 38799 - DNA, 20 bp, Artificial Sequence
  Description of Artificial Sequence: Synthetic oligonucleotide
  Target: ATXN1; (-) strand; PAM type: NRG; PAM sequence: AAG
ccttcttagtctaaactctt

SEQ ID NO: 38800 - DNA, 20 bp, Artificial Sequence
  Description of Artificial Sequence: Synthetic oligonucleotide
  Target: ATXN1; (-) strand; PAM type: NRG; PAM sequence: TAG
acttctctgagctcccttct

SEQ ID NO: 38801 - DNA, 20 bp, Artificial Sequence
  Description of Artificial Sequence: Synthetic oligonucleotide
  Target: ATXN1; (-) strand; PAM type: NRG; PAM sequence: GAG
tatgctgaaagtacttctct

SEQ ID NO: 38802 - DNA, 20 bp, Artificial Sequence
  Description of Artificial Sequence: Synthetic oligonucleotide
  Target: ATXN1; (-) strand; PAM type: NRG; PAM sequence: AAG
actgttcattcctatgctga

SEQ ID NO: 38803 - DNA, 20 bp, Artificial Sequence
  Description of Artificial Sequence: Synthetic oligonucleotide
  Target: ATXN1; (-) strand; PAM type: NRG; PAM sequence: GAG
aactcggtattctgcgattt

SEQ ID NO: 38804 - DNA, 20 bp, Artificial Sequence
  Description of Artificial Sequence: Synthetic oligonucleotide
  Target: ATXN1; (-) strand; PAM type: NRG; PAM sequence: CGG
tcgtctgagggaggggaact

SEQ ID NO: 38805 - DNA, 20 bp, Artificial Sequence
  Description of Artificial Sequence: Synthetic oligonucleotide
  Target: ATXN1; (-) strand; PAM type: NRG; PAM sequence: GGG
atagccctcgtctgagggag

SEQ ID NO: 38806 - DNA, 20 bp, Artificial Sequence
  Description of Artificial Sequence: Synthetic oligonucleotide
  Target: ATXN1; (-) strand; PAM type: NRG; PAM sequence: GGG
tatagccctcgtctgaggga

SEQ ID NO: 38807 - DNA, 20 bp, Artificial Sequence
  Description of Artificial Sequence: Synthetic oligonucleotide
  Target: ATXN1; (-) strand; PAM type: NRG; PAM sequence: AGG
atatagccctcgtctgaggg

SEQ ID NO: 38808 - DNA, 20 bp, Artificial Sequence
  Description of Artificial Sequence: Synthetic oligonucleotide
  Target: ATXN1; (-) strand; PAM type: NRG; PAM sequence: GAG
catatagccctcgtctgagg

SEQ ID NO: 38809 - DNA, 20 bp, Artificial Sequence
  Description of Artificial Sequence: Synthetic oligonucleotide
  Target: ATXN1; (-) strand; PAM type: NRG; PAM sequence: GGG
tacatatagccctcgtctga

SEQ ID NO: 38810 - DNA, 20 bp, Artificial Sequence
  Description of Artificial Sequence: Synthetic oligonucleotide
  Target: ATXN1; (-) strand; PAM type: NRG; PAM sequence: AGG
ttacatatagccctcgtctg

SEQ ID NO: 38811 - DNA, 20 bp, Artificial Sequence
  Description of Artificial Sequence: Synthetic oligonucleotide
  Target: ATXN1; (-) strand; PAM type: NRG; PAM sequence: GAG
gttacatatagccctcgtct

SEQ ID NO: 38812 - DNA, 20 bp, Artificial Sequence
  Description of Artificial Sequence: Synthetic oligonucleotide
  Target: ATXN1; (-) strand; PAM type: NRG; PAM sequence: TAG
attgttatttttgttacata

SEQ ID NO: 38813 - DNA, 20 bp, Artificial Sequence
  Description of Artificial Sequence: Synthetic oligonucleotide
  Target: ATXN1; (-) strand; PAM type: NRG; PAM sequence: AGG
tggaagaattactacgtaaa

SEQ ID NO: 38814 - DNA, 20 bp, Artificial Sequence
  Description of Artificial Sequence: Synthetic oligonucleotide
  Target: ATXN1; (-) strand; PAM type: NRG; PAM sequence: AAG
ctggaagaattactacgtaa

SEQ ID NO: 38815 - DNA, 20 bp, Artificial Sequence
  Description of Artificial Sequence: Synthetic oligonucleotide
  Target: ATXN1; (-) strand; PAM type: NRG; PAM sequence: AAG
tttgtatggttatggcctgg

SEQ ID NO: 38816 - DNA, 20 bp, Artificial Sequence
  Description of Artificial Sequence: Synthetic oligonucleotide
  Target: ATXN1; (-) strand; PAM type: NRG; PAM sequence: TGG
agatttgtatggttatggcc

SEQ ID NO: 38817 - DNA, 20 bp, Artificial Sequence
  Description of Artificial Sequence: Synthetic oligonucleotide
  Target: ATXN1; (-) strand; PAM type: NRG; PAM sequence: TGG
tgatcagatttgtatggtta

SEQ ID NO: 38818 - DNA, 20 bp, Artificial Sequence
  Description of Artificial Sequence: Synthetic oligonucleotide
  Target: ATXN1; (-) strand; PAM type: NRG; PAM sequence: TGG
tctaaatgatcagatttgta

SEQ ID NO: 38819 - DNA, 20 bp, Artificial Sequence
  Description of Artificial Sequence: Synthetic oligonucleotide
  Target: ATXN1; (-) strand; PAM type: NRG; PAM sequence: CAG
atttgtcatgtctaaatgat

SEQ ID NO: 38820 - DNA, 20 bp, Artificial Sequence
  Description of Artificial Sequence: Synthetic oligonucleotide
  Target: ATXN1; (-) strand; PAM type: NRG; PAM sequence: TAG
gttacatgtttttttgtata

SEQ ID NO: 38821 - DNA, 20 bp, Artificial Sequence
  Description of Artificial Sequence: Synthetic oligonucleotide
  Target: ATXN1; (-) strand; PAM type: NRG; PAM sequence: AAG
aaaaagcagagaagggttga

SEQ ID NO: 38822 - DNA, 20 bp, Artificial Sequence
  Description of Artificial Sequence: Synthetic oligonucleotide
  Target: ATXN1; (-) strand; PAM type: NRG; PAM sequence: GGG
aaaaaaaaaaaagcagagaa

SEQ ID NO: 38823 - DNA, 20 bp, Artificial Sequence
  Description of Artificial Sequence: Synthetic oligonucleotide
  Target: ATXN1; (-) strand; PAM type: NRG; PAM sequence: AGG
taaaaaaaaaaaagcagaga

SEQ ID NO: 38824 - DNA, 20 bp, Artificial Sequence
  Description of Artificial Sequence: Synthetic oligonucleotide
  Target: ATXN1; (-) strand; PAM type: NRG; PAM sequence: AAG
gtaaaaaaaaaaaagcagag

SEQ ID NO: 38825 - DNA, 20 bp, Artificial Sequence
  Description of Artificial Sequence: Synthetic oligonucleotide
  Target: ATXN1; (-) strand; PAM type: NRG; PAM sequence: GAG
tttgtaaaaaaaaaaaagca

SEQ ID NO: 38826 - DNA, 20 bp, Artificial Sequence
  Description of Artificial Sequence: Synthetic oligonucleotide
  Target: ATXN1; (-) strand; PAM type: NRG; PAM sequence: CAG
tgtttgtaaaaaaaaaaaag

SEQ ID NO: 38827 - DNA, 20 bp, Artificial Sequence
  Description of Artificial Sequence: Synthetic oligonucleotide
  Target: ATXN1; (-) strand; PAM type: NRG; PAM sequence: AAG
ctttgtttgtaaaaaaaaaa

SEQ ID NO: 38828 - DNA, 20 bp, Artificial Sequence
  Description of Artificial Sequence: Synthetic oligonucleotide
  Target: ATXN1; (-) strand; PAM type: NRG; PAM sequence: GAG
tatggctctgttgaaacaat

SEQ ID NO: 38829 - DNA, 20 bp, Artificial Sequence
  Description of Artificial Sequence: Synthetic oligonucleotide
  Target: ATXN1; (-) strand; PAM type: NRG; PAM sequence: TGG
cattcagtgtttgaaagata

SEQ ID NO: 38830 - DNA, 20 bp, Artificial Sequence
  Description of Artificial Sequence: Synthetic oligonucleotide
  Target: ATXN1; (-) strand; PAM type: NRG; PAM sequence: AAG
atgattcattcagtgtttga

SEQ ID NO: 38831 - DNA, 20 bp, Artificial Sequence
  Description of Artificial Sequence: Synthetic oligonucleotide
  Target: ATXN1; (-) strand; PAM type: NRG; PAM sequence: CAG
gaatgtcgaaatgattcatt

SEQ ID NO: 38832 - DNA, 20 bp, Artificial Sequence
  Description of Artificial Sequence: Synthetic oligonucleotide
  Target: ATXN1; (-) strand; PAM type: NRG; PAM sequence: AAG
tgttttaaaaaattgcacaa

SEQ ID NO: 38833 - DNA, 20 bp, Artificial Sequence
  Description of Artificial Sequence: Synthetic oligonucleotide
  Target: ATXN1; (-) strand; PAM type: NRG; PAM sequence: AGG
gcactcactttgaggagtac

SEQ ID NO: 38834 - DNA, 20 bp, Artificial Sequence
  Description of Artificial Sequence: Synthetic oligonucleotide
  Target: ATXN1; (-) strand; PAM type: NRG; PAM sequence: CAG
agcactcactttgaggagta

SEQ ID NO: 38835 - DNA, 20 bp, Artificial Sequence
  Description of Artificial Sequence: Synthetic oligonucleotide
  Target: ATXN1; (-) strand; PAM type: NRG; PAM sequence: GAG
tttgaagcactcactttgag

SEQ ID NO: 38836 - DNA, 20 bp, Artificial Sequence
  Description of Artificial Sequence: Synthetic oligonucleotide
  Target: ATXN1; (-) strand; PAM type: NRG; PAM sequence: AGG
attttgaagcactcactttg

SEQ ID NO: 38837 - DNA, 20 bp, Artificial Sequence
  Description of Artificial Sequence: Synthetic oligonucleotide
  Target: ATXN1; (-) strand; PAM type: NRG; PAM sequence: GAG
aattttgaagcactcacttt

SEQ ID NO: 38838 - DNA, 20 bp, Artificial Sequence
  Description of Artificial Sequence: Synthetic oligonucleotide
  Target: ATXN1; (-) strand; PAM type: NRG; PAM sequence: AAG
ctgaagaaaacaaaattttg

SEQ ID NO: 38839 - DNA, 20 bp, Artificial Sequence
  Description of Artificial Sequence: Synthetic oligonucleotide
  Target: ATXN1; (-) strand; PAM type: NRG; PAM sequence: AAG
acacctgatttgagaagctg

SEQ ID NO: 38840 - DNA, 20 bp, Artificial Sequence
  Description of Artificial Sequence: Synthetic oligonucleotide
  Target: ATXN1; (-) strand; PAM type: NRG; PAM sequence: AAG
aaatgtacacctgatttgag

SEQ ID NO: 38841 - DNA, 20 bp, Artificial Sequence
  Description of Artificial Sequence: Synthetic oligonucleotide
  Target: ATXN1; (-) strand; PAM type: NRG; PAM sequence: GAG
tttaaatgtacacctgattt

SEQ ID NO: 38842 - DNA, 20 bp, Artificial Sequence
  Description of Artificial Sequence: Synthetic oligonucleotide
  Target: ATXN1; (-) strand; PAM type: NRG; PAM sequence: GGG
cttgtagcactataccttgt

SEQ ID NO: 38843 - DNA, 20 bp, Artificial Sequence
  Description of Artificial Sequence: Synthetic oligonucleotide
  Target: ATXN1; (-) strand; PAM type: NRG; PAM sequence: TGG
tcttgtagcactataccttg

SEQ ID NO: 38844 - DNA, 20 bp, Artificial Sequence
  Description of Artificial Sequence: Synthetic oligonucleotide
  Target: ATXN1; (-) strand; PAM type: NRG; PAM sequence: TAG
gatgataggatcttttcttg

SEQ ID NO: 38845 - DNA, 20 bp, Artificial Sequence
  Description of Artificial Sequence: Synthetic oligonucleotide
  Target: ATXN1; (-) strand; PAM type: NRG; PAM sequence: AGG
tacgttaccttactgatgat

SEQ ID NO: 38846 - DNA, 20 bp, Artificial Sequence
  Description of Artificial Sequence: Synthetic oligonucleotide
  Target: ATXN1; (-) strand; PAM type: NRG; PAM sequence: TAG
atacgttaccttactgatga

SEQ ID NO: 38847 - DNA, 20 bp, Artificial Sequence
  Description of Artificial Sequence: Synthetic oligonucleotide
  Target: ATXN1; (-) strand; PAM type: NRG; PAM sequence: TAG
gagctgagatttcttttaca

SEQ ID NO: 38848 - DNA, 20 bp, Artificial Sequence
  Description of Artificial Sequence: Synthetic oligonucleotide
  Target: ATXN1; (-) strand; PAM type: NRG; PAM sequence: GAG
cacacctctactccggagct

SEQ ID NO: 38849 - DNA, 20 bp, Artificial Sequence
  Description of Artificial Sequence: Synthetic oligonucleotide
  Target: ATXN1; (-) strand; PAM type: NRG; PAM sequence: GAG
acttgcacacctctactccg

SEQ ID NO: 38850 - DNA, 20 bp, Artificial Sequence
  Description of Artificial Sequence: Synthetic oligonucleotide
  Target: ATXN1; (-) strand; PAM type: NRG; PAM sequence: CGG
caacttgcacacctctactc

SEQ ID NO: 38851 - DNA, 20 bp, Artificial Sequence
  Description of Artificial Sequence: Synthetic oligonucleotide
  Target: ATXN1; (-) strand; PAM type: NRG; PAM sequence: GGG
agtgttgtgtttctggcata

SEQ ID NO: 38852 - DNA, 20 bp, Artificial Sequence
  Description of Artificial Sequence: Synthetic oligonucleotide
  Target: ATXN1; (-) strand; PAM type: NRG; PAM sequence: AGG
cagtgttgtgtttctggcat

SEQ ID NO: 38853 - DNA, 20 bp, Artificial Sequence
  Description of Artificial Sequence: Synthetic oligonucleotide
  Target: ATXN1; (-) strand; PAM type: NRG; PAM sequence: TAG
acagtgttgtgtttctggca

SEQ ID NO: 38854 - DNA, 20 bp, Artificial Sequence
  Description of Artificial Sequence: Synthetic oligonucleotide
  Target: ATXN1; (-) strand; PAM type: NRG; PAM sequence: TGG
cacggacagtgttgtgtttc

SEQ ID NO: 38855 - DNA, 20 bp, Artificial Sequence
  Description of Artificial Sequence: Synthetic oligonucleotide
  Target: ATXN1; (-) strand; PAM type: NRG; PAM sequence: CAG
tttcctctcttttccacgga

SEQ ID NO: 38856 - DNA, 20 bp, Artificial Sequence
  Description of Artificial Sequence: Synthetic oligonucleotide
  Target: ATXN1; (-) strand; PAM type: NRG; PAM sequence: CGG
ttggtttcctctcttttcca

SEQ ID NO: 38857 - DNA, 20 bp, Artificial Sequence
  Description of Artificial Sequence: Synthetic oligonucleotide
  Target: ATXN1; (-) strand; PAM type: NRG; PAM sequence: TGG
catctgctattgtgttgggt

SEQ ID NO: 38858 - DNA, 20 bp, Artificial Sequence
  Description of Artificial Sequence: Synthetic oligonucleotide
  Target: ATXN1; (-) strand; PAM type: NRG; PAM sequence: GGG
catgcatctgctattgtgtt

SEQ ID NO: 38859 - DNA, 20 bp, Artificial Sequence
  Description of Artificial Sequence: Synthetic oligonucleotide
  Target: ATXN1; (-) strand; PAM type: NRG; PAM sequence: TGG
acatgcatctgctattgtgt

SEQ ID NO: 38860 - DNA, 20 bp, Artificial Sequence
  Description of Artificial Sequence: Synthetic oligonucleotide
  Target: ATXN1; (-) strand; PAM type: NRG; PAM sequence: AAG
agagaatatacttttttata

SEQ ID NO: 38861 - DNA, 20 bp, Artificial Sequence
  Description of Artificial Sequence: Synthetic oligonucleotide
  Target: ATXN1; (-) strand; PAM type: NRG; PAM sequence: GAG
catcaagtaataaatataca

SEQ ID NO: 38862 - DNA, 20 bp, Artificial Sequence
  Description of Artificial Sequence: Synthetic oligonucleotide
  Target: ATXN1; (-) strand; PAM type: NRG; PAM sequence: CAG
cacatcaagtaataaatata

SEQ ID NO: 38863 - DNA, 20 bp, Artificial Sequence
  Description of Artificial Sequence: Synthetic oligonucleotide
  Target: ATXN1; (-) strand; PAM type: NRG; PAM sequence: AAG
agagaatttaagaacacatc

SEQ ID NO: 38864 - DNA, 20 bp, Artificial Sequence
  Description of Artificial Sequence: Synthetic oligonucleotide
  Target: ATXN1; (-) strand; PAM type: NRG; PAM sequence: AAG
atttctgaaatagagaattt

SEQ ID NO: 38865 - DNA, 20 bp, Artificial Sequence
  Description of Artificial Sequence: Synthetic oligonucleotide
  Target: ATXN1; (-) strand; PAM type: NRG; PAM sequence: GAG
aacccagaatttctgaaata

SEQ ID NO: 38866 - DNA, 20 bp, Artificial Sequence
  Description of Artificial Sequence: Synthetic oligonucleotide
  Target: ATXN1; (-) strand; PAM type: NRG; PAM sequence: TAG
ttaacccagaatttctgaaa

SEQ ID NO: 38867 - DNA, 20 bp, Artificial Sequence
  Description of Artificial Sequence: Synthetic oligonucleotide
  Target: ATXN1; (-) strand; PAM type: NRG; PAM sequence: CAG
ttccacatttgtttttaacc

SEQ ID NO: 38868 - DNA, 20 bp, Artificial Sequence
  Description of Artificial Sequence: Synthetic oligonucleotide
  Target: ATXN1; (-) strand; PAM type: NRG; PAM sequence: AGG
tttttttttaagtggcgtgg

SEQ ID NO: 38869 - DNA, 20 bp, Artificial Sequence
  Description of Artificial Sequence: Synthetic oligonucleotide
  Target: ATXN1; (-) strand; PAM type: NRG; PAM sequence: GAG
ttttttttttaagtggcgtg

SEQ ID NO: 38870 - DNA, 20 bp, Artificial Sequence
  Description of Artificial Sequence: Synthetic oligonucleotide
  Target: ATXN1; (-) strand; PAM type: NRG; PAM sequence: TGG
ttttttttttttaagtggcg

SEQ ID NO: 38871 - DNA, 20 bp, Artificial Sequence
  Description of Artificial Sequence: Synthetic oligonucleotide
  Target: ATXN1; (-) strand; PAM type: NRG; PAM sequence: TGG
acactttttttttttttaag

SEQ ID NO: 38872 - DNA, 20 bp, Artificial Sequence
  Description of Artificial Sequence: Synthetic oligonucleotide
  Target: ATXN1; (-) strand; PAM type: NRG; PAM sequence: AAG
attacacttttttttttttt

SEQ ID NO: 38873 - DNA, 20 bp, Artificial Sequence
  Description of Artificial Sequence: Synthetic oligonucleotide
  Target: ATXN1; (-) strand; PAM type: NRG; PAM sequence: GAG
tcggtggtgatgtgaaagga

SEQ ID NO: 38874 - DNA, 20 bp, Artificial Sequence
  Description of Artificial Sequence: Synthetic oligonucleotide
  Target: ATXN1; (-) strand; PAM type: NRG; PAM sequence: GAG
cttcggtggtgatgtgaaag

SEQ ID NO: 38875 - DNA, 20 bp, Artificial Sequence
  Description of Artificial Sequence: Synthetic oligonucleotide
  Target: ATXN1; (-) strand; PAM type: NRG; PAM sequence: AGG
ttcttcggtggtgatgtgaa

SEQ ID NO: 38876 - DNA, 20 bp, Artificial Sequence
  Description of Artificial Sequence: Synthetic oligonucleotide
  Target: ATXN1; (-) strand; PAM type: NRG; PAM sequence: AAG
tttcttcggtggtgatgtga

SEQ ID NO: 38877 - DNA, 20 bp, Artificial Sequence
  Description of Artificial Sequence: Synthetic oligonucleotide
  Target: ATXN1; (-) strand; PAM type: NRG; PAM sequence: TGG
gcccaattcggtttcttcgg

SEQ ID NO: 38878 - DNA, 20 bp, Artificial Sequence
  Description of Artificial Sequence: Synthetic oligonucleotide
  Target: ATXN1; (-) strand; PAM type: NRG; PAM sequence: CGG
atggcccaattcggtttctt

SEQ ID NO: 38879 - DNA, 20 bp, Artificial Sequence
  Description of Artificial Sequence: Synthetic oligonucleotide
  Target: ATXN1; (-) strand; PAM type: NRG; PAM sequence: CGG
gcagactccatggcccaatt

SEQ ID NO: 38880 - DNA, 20 bp, Artificial Sequence
  Description of Artificial Sequence: Synthetic oligonucleotide
  Target: ATXN1; (-) strand; PAM type: NRG; PAM sequence: TGG
aacagggccagcagactcca

SEQ ID NO: 38881 - DNA, 20 bp, Artificial Sequence
  Description of Artificial Sequence: Synthetic oligonucleotide
  Target: ATXN1; (-) strand; PAM type: NRG; PAM sequence: CAG
ccaggtgaaaacagggccag

SEQ ID NO: 38882 - DNA, 20 bp, Artificial Sequence
  Description of Artificial Sequence: Synthetic oligonucleotide
  Target: ATXN1; (-) strand; PAM type: NRG; PAM sequence: CAG
gcaccaggtgaaaacagggc

SEQ ID NO: 38883 - DNA, 20 bp, Artificial Sequence
  Description of Artificial Sequence: Synthetic oligonucleotide
  Target: ATXN1; (-) strand; PAM type: NRG; PAM sequence: GGG
atttgcaccaggtgaaaaca

SEQ ID NO: 38884 - DNA, 20 bp, Artificial Sequence
  Description of Artificial Sequence: Synthetic oligonucleotide
  Target: ATXN1; (-) strand; PAM type: NRG; PAM sequence: AGG
aatttgcaccaggtgaaaac

SEQ ID NO: 38885 - DNA, 20 bp, Artificial Sequence
  Description of Artificial Sequence: Synthetic oligonucleotide
  Target: ATXN1; (-) strand; PAM type: NRG; PAM sequence: CAG
caatttgcaccaggtgaaaa

SEQ ID NO: 38886 - DNA, 20 bp, Artificial Sequence
  Description of Artificial Sequence: Synthetic oligonucleotide
  Target: ATXN1; (-) strand; PAM type: NRG; PAM sequence: AGG
tttgcacttcaatttgcacc

SEQ ID NO: 38887 - DNA, 20 bp, Artificial Sequence
  Description of Artificial Sequence: Synthetic oligonucleotide
  Target: ATXN1; (-) strand; PAM type: NRG; PAM sequence: CAG
ctttgcacttcaatttgcac

SEQ ID NO: 38888 - DNA, 20 bp, Artificial Sequence
  Description of Artificial Sequence: Synthetic oligonucleotide
  Target: ATXN1; (-) strand; PAM type: NRG; PAM sequence: TGG
ccacaagcagctcaacagac

SEQ ID NO: 38889 - DNA, 20 bp, Artificial Sequence
  Description of Artificial Sequence: Synthetic oligonucleotide
  Target: ATXN1; (-) strand; PAM type: NRG; PAM sequence: CAG
atgaaccacaagcagctcaa

SEQ ID NO: 38890 - DNA, 20 bp, Artificial Sequence
  Description of Artificial Sequence: Synthetic oligonucleotide
  Target: ATXN1; (-) strand; PAM type: NRG; PAM sequence: CAG
actgtttcatgaaccacaag

SEQ ID NO: 38891 - DNA, 20 bp, Artificial Sequence
  Description of Artificial Sequence: Synthetic oligonucleotide
  Target: ATXN1; (-) strand; PAM type: NRG; PAM sequence: AAG
gctactgtttcatgaaccac

SEQ ID NO: 38892 - DNA, 20 bp, Artificial Sequence
  Description of Artificial Sequence: Synthetic oligonucleotide
  Target: ATXN1; (-) strand; PAM type: NRG; PAM sequence: TGG
ttgagctgtgttggttgtca

SEQ ID NO: 38893 - DNA, 20 bp, Artificial Sequence
  Description of Artificial Sequence: Synthetic oligonucleotide
  Target: ATXN1; (-) strand; PAM type: NRG; PAM sequence: TGG
ccgggcttcttgagctgtgt

SEQ ID NO: 38894 - DNA, 20 bp, Artificial Sequence
  Description of Artificial Sequence: Synthetic oligonucleotide
  Target: ATXN1; (-) strand; PAM type: NRG; PAM sequence: GAG
taccgaaggccgggcttctt

SEQ ID NO: 38895 - DNA, 20 bp, Artificial Sequence
  Description of Artificial Sequence: Synthetic oligonucleotide
  Target: ATXN1; (-) strand; PAM type: NRG; PAM sequence: GGG
agctctcggtaccgaaggcc

SEQ ID NO: 38896 - DNA, 20 bp, Artificial Sequence
  Description of Artificial Sequence: Synthetic oligonucleotide
  Target: ATXN1; (-) strand; PAM type: NRG; PAM sequence: CGG
gagctctcggtaccgaaggc

SEQ ID NO: 38897 - DNA, 20 bp, Artificial Sequence
  Description of Artificial Sequence: Synthetic oligonucleotide
  Target: ATXN1; (-) strand; PAM type: NRG; PAM sequence: AGG
agcagagctctcggtaccga

SEQ ID NO: 38898 - DNA, 20 bp, Artificial Sequence
  Description of Artificial Sequence: Synthetic oligonucleotide
  Target: ATXN1; (-) strand; PAM type: NRG; PAM sequence: AAG
aagcagagctctcggtaccg

SEQ ID NO: 38899 - DNA, 20 bp, Artificial Sequence
  Description of Artificial Sequence: Synthetic oligonucleotide
  Target: ATXN1; (-) strand; PAM type: NRG; PAM sequence: CGG
gggtgaggaagcagagctct

SEQ ID NO: 38900 - DNA, 20 bp, Artificial Sequence
  Description of Artificial Sequence: Synthetic oligonucleotide
  Target: ATXN1; (-) strand; PAM type: NRG; PAM sequence: GAG
cagatatgggtgaggaagca

SEQ ID NO: 38901 - DNA, 20 bp, Artificial Sequence
  Description of Artificial Sequence: Synthetic oligonucleotide
  Target: ATXN1; (-) strand; PAM type: NRG; PAM sequence: CAG
ttcagatatgggtgaggaag

SEQ ID NO: 38902 - DNA, 20 bp, Artificial Sequence
  Description of Artificial Sequence: Synthetic oligonucleotide
  Target: ATXN1; (-) strand; PAM type: NRG; PAM sequence: AAG
tatttcagatatgggtgagg

SEQ ID NO: 38903 - DNA, 20 bp, Artificial Sequence
  Description of Artificial Sequence: Synthetic oligonucleotide
  Target: ATXN1; (-) strand; PAM type: NRG; PAM sequence: AGG
tgctatttcagatatgggtg

SEQ ID NO: 38904 - DNA, 20 bp, Artificial Sequence
  Description of Artificial Sequence: Synthetic oligonucleotide
  Target: ATXN1; (-) strand; PAM type: NRG; PAM sequence: GAG
gtgctatttcagatatgggt

SEQ ID NO: 38905 - DNA, 20 bp, Artificial Sequence
  Description of Artificial Sequence: Synthetic oligonucleotide
  Target: ATXN1; (-) strand; PAM type: NRG; PAM sequence: GGG
taccgtgctatttcagatat

SEQ ID NO: 38906 - DNA, 20 bp, Artificial Sequence
  Description of Artificial Sequence: Synthetic oligonucleotide
  Target: ATXN1; (-) strand; PAM type: NRG; PAM sequence: TGG
ataccgtgctatttcagata

SEQ ID NO: 38907 - DNA, 20 bp, Artificial Sequence
  Description of Artificial Sequence: Synthetic oligonucleotide
  Target: ATXN1; (-) strand; PAM type: NRG; PAM sequence: CAG
acactaataccgtgctattt

SEQ ID NO: 38908 - DNA, 20 bp, Artificial Sequence
  Description of Artificial Sequence: Synthetic oligonucleotide
  Target: ATXN1; (-) strand; PAM type: NRG; PAM sequence: AAG
aaaaatctccaatgcttttg

SEQ ID NO: 38909 - DNA, 20 bp, Artificial Sequence
  Description of Artificial Sequence: Synthetic oligonucleotide
  Target: ATXN1; (-) strand; PAM type: NRG; PAM sequence: GAG
aaacctatttctttcataga

SEQ ID NO: 38910 - DNA, 20 bp, Artificial Sequence
  Description of Artificial Sequence: Synthetic oligonucleotide
  Target: ATXN1; (-) strand; PAM type: NRG; PAM sequence: GAG
ggaaacctatttctttcata

SEQ ID NO: 38911 - DNA, 20 bp, Artificial Sequence
  Description of Artificial Sequence: Synthetic oligonucleotide
  Target: ATXN1; (-) strand; PAM type: NRG; PAM sequence: TAG
aaggaaacctatttctttca

SEQ ID NO: 38912 - DNA, 20 bp, Artificial Sequence
  Description of Artificial Sequence: Synthetic oligonucleotide
  Target: ATXN1; (-) strand; PAM type: NRG; PAM sequence: AGG
tttaacatctgtgactacta

SEQ ID NO: 38913 - DNA, 20 bp, Artificial Sequence
  Description of Artificial Sequence: Synthetic oligonucleotide
  Target: ATXN1; (-) strand; PAM type: NRG; PAM sequence: AAG
ctttaacatctgtgactact

SEQ ID NO: 38914 - DNA, 20 bp, Artificial Sequence
  Description of Artificial Sequence: Synthetic oligonucleotide
  Target: ATXN1; (-) strand; PAM type: NRG; PAM sequence: AGG
ttgttttgttttgtttttta

SEQ ID NO: 38915 - DNA, 20 bp, Artificial Sequence
  Description of Artificial Sequence: Synthetic oligonucleotide
  Target: ATXN1; (-) strand; PAM type: NRG; PAM sequence: AAG
tttgttttgttttgtttttt

SEQ ID NO: 38916 - DNA, 20 bp, Artificial Sequence
  Description of Artificial Sequence: Synthetic oligonucleotide
  Target: ATXN1; (-) strand; PAM type: NRG; PAM sequence: TGG
tatttttgttgttgtagctc

SEQ ID NO: 38917 - DNA, 20 bp, Artificial Sequence
  Description of Artificial Sequence: Synthetic oligonucleotide
  Target: ATXN1; (-) strand; PAM type: NRG; PAM sequence: TAG
aaaatttatttttgttgttg

SEQ ID NO: 38918 - DNA, 20 bp, Artificial Sequence
  Description of Artificial Sequence: Synthetic oligonucleotide
  Target: ATXN1; (-) strand; PAM type: NRG; PAM sequence: CAG
cataaaatccactctttgca

SEQ ID NO: 38919 - DNA, 20 bp, Artificial Sequence
  Description of Artificial Sequence: Synthetic oligonucleotide
  Target: ATXN1; (-) strand; PAM type: NRG; PAM sequence: TAG
tcaagatgaacagtagctcc

SEQ ID NO: 38920 - DNA, 20 bp, Artificial Sequence
  Description of Artificial Sequence: Synthetic oligonucleotide
  Target: ATXN1; (-) strand; PAM type: NRG; PAM sequence: TAG
tgcatgttcaagatgaacag

SEQ ID NO: 38921 - DNA, 20 bp, Artificial Sequence
  Description of Artificial Sequence: Synthetic oligonucleotide
  Target: ATXN1; (-) strand; PAM type: NRG; PAM sequence: CAG
tgctgcatgttcaagatgaa

SEQ ID NO: 38922 - DNA, 20 bp, Artificial Sequence
  Description of Artificial Sequence: Synthetic oligonucleotide
  Target: ATXN1; (-) strand; PAM type: NRG; PAM sequence: AAG
caatataatgctgcatgttc

SEQ ID NO: 38923 - DNA, 20 bp, Artificial Sequence
  Description of Artificial Sequence: Synthetic oligonucleotide
  Target: ATXN1; (-) strand; PAM type: NRG; PAM sequence: TAG
attactccttagataccgca

SEQ ID NO: 38924 - DNA, 20 bp, Artificial Sequence
  Description of Artificial Sequence: Synthetic oligonucleotide
  Target: ATXN1; (-) strand; PAM type: NRG; PAM sequence: TAG
gcatcttgtggattactcct

SEQ ID NO: 38925 - DNA, 20 bp, Artificial Sequence
  Description of Artificial Sequence: Synthetic oligonucleotide
  Target: ATXN1; (-) strand; PAM type: NRG; PAM sequence: TGG
tttggatttcctgcatcttg

SEQ ID NO: 38926 - DNA, 20 bp, Artificial Sequence
  Description of Artificial Sequence: Synthetic oligonucleotide
  Target: ATXN1; (-) strand; PAM type: NRG; PAM sequence: TGG
gtacaatttcaaggaatgtt

SEQ ID NO: 38927 - DNA, 20 bp, Artificial Sequence
  Description of Artificial Sequence: Synthetic oligonucleotide
  Target: ATXN1; (-) strand; PAM type: NRG; PAM sequence: AGG
agtagggttgtacaatttca

SEQ ID NO: 38928 - DNA, 20 bp, Artificial Sequence
  Description of Artificial Sequence: Synthetic oligonucleotide
  Target: ATXN1; (-) strand; PAM type: NRG; PAM sequence: AAG
gagtagggttgtacaatttc

SEQ ID NO: 38929 - DNA, 20 bp, Artificial Sequence
  Description of Artificial Sequence: Synthetic oligonucleotide
  Target: ATXN1; (-) strand; PAM type: NRG; PAM sequence: GGG
actttgactgctctggagta

SEQ ID NO: 38930 - DNA, 20 bp, Artificial Sequence
  Description of Artificial Sequence: Synthetic oligonucleotide
  Target: ATXN1; (-) strand; PAM type: NRG; PAM sequence: AGG
cactttgactgctctggagt

SEQ ID NO: 38931 - DNA, 20 bp, Artificial Sequence
  Description of Artificial Sequence: Synthetic oligonucleotide
  Target: ATXN1; (-) strand; PAM type: NRG; PAM sequence: TAG
gcactttgactgctctggag

SEQ ID NO: 38932 - DNA, 20 bp, Artificial Sequence
  Description of Artificial Sequence: Synthetic oligonucleotide
  Target: ATXN1; (-) strand; PAM type: NRG; PAM sequence: GAG
gcagcactttgactgctctg

SEQ ID NO: 38933 - DNA, 20 bp, Artificial Sequence
  Description of Artificial Sequence: Synthetic oligonucleotide
  Target: ATXN1; (-) strand; PAM type: NRG; PAM sequence: TGG
aagcagcactttgactgctc

SEQ ID NO: 38934 - DNA, 20 bp, Artificial Sequence
  Description of Artificial Sequence: Synthetic oligonucleotide
  Target: ATXN1; (-) strand; PAM type: NRG; PAM sequence: CAG
tacactgacgtgtccagaag

SEQ ID NO: 38935 - DNA, 20 bp, Artificial Sequence
  Description of Artificial Sequence: Synthetic oligonucleotide
  Target: ATXN1; (-) strand; PAM type: NRG; PAM sequence: AAG
tggtacactgacgtgtccag

SEQ ID NO: 38936 - DNA, 20 bp, Artificial Sequence
  Description of Artificial Sequence: Synthetic oligonucleotide
  Target: ATXN1; (-) strand; PAM type: NRG; PAM sequence: CAG
gtgtggtacactgacgtgtc

SEQ ID NO: 38937 - DNA, 20 bp, Artificial Sequence
  Description of Artificial Sequence: Synthetic oligonucleotide
  Target: ATXN1; (-) strand; PAM type: NRG; PAM sequence: TGG
ggacggggcaggtgtgtgtg

SEQ ID NO: 38938 - DNA, 20 bp, Artificial Sequence
  Description of Artificial Sequence: Synthetic oligonucleotide
  Target: ATXN1; (-) strand; PAM type: NRG; PAM sequence: AGG
ctctttctcagggacggggc

SEQ ID NO: 38939 - DNA, 20 bp, Artificial Sequence
  Description of Artificial Sequence: Synthetic oligonucleotide
  Target: ATXN1; (-) strand; PAM type: NRG; PAM sequence: CAG
cctctttctcagggacgggg

SEQ ID NO: 38940 - DNA, 20 bp, Artificial Sequence
  Description of Artificial Sequence: Synthetic oligonucleotide
  Target: ATXN1; (-) strand; PAM type: NRG; PAM sequence: GGG
acacctctttctcagggacg

SEQ ID NO: 38941 - DNA, 20 bp, Artificial Sequence
  Description of Artificial Sequence: Synthetic oligonucleotide
  Target: ATXN1; (-) strand; PAM type: NRG; PAM sequence: GGG
cacacctctttctcagggac

SEQ ID NO: 38942 - DNA, 20 bp, Artificial Sequence
  Description of Artificial Sequence: Synthetic oligonucleotide
  Target: ATXN1; (-) strand; PAM type: NRG; PAM sequence: CGG
tcacacctctttctcaggga

SEQ ID NO: 38943 - DNA, 20 bp, Artificial Sequence
  Description of Artificial Sequence: Synthetic oligonucleotide
  Target: ATXN1; (-) strand; PAM type: NRG; PAM sequence: GGG
cctttcacacctctttctca

SEQ ID NO: 38944 - DNA, 20 bp, Artificial Sequence
  Description of Artificial Sequence: Synthetic oligonucleotide
  Target: ATXN1; (-) strand; PAM type: NRG; PAM sequence: AGG
acctttcacacctctttctc

SEQ ID NO: 38945 - DNA, 20 bp, Artificial Sequence
  Description of Artificial Sequence: Synthetic oligonucleotide
  Target: ATXN1; (-) strand; PAM type: NRG; PAM sequence: CAG
aacctttcacacctctttct

SEQ ID NO: 38946 - DNA, 20 bp, Artificial Sequence
  Description of Artificial Sequence: Synthetic oligonucleotide
  Target: ATXN1; (-) strand; PAM type: NRG; PAM sequence: CGG
tctcccctaaagggactctg

SEQ ID NO: 38947 - DNA, 20 bp, Artificial Sequence
  Description of Artificial Sequence: Synthetic oligonucleotide
  Target: ATXN1; (-) strand; PAM type: NRG; PAM sequence: GGG
atccctccttctcccctaaa

SEQ ID NO: 38948 - DNA, 20 bp, Artificial Sequence
  Description of Artificial Sequence: Synthetic oligonucleotide
  Target: ATXN1; (-) strand; PAM type: NRG; PAM sequence: AGG
catccctccttctcccctaa

SEQ ID NO: 38949 - DNA, 20 bp, Artificial Sequence
  Description of Artificial Sequence: Synthetic oligonucleotide
  Target: ATXN1; (-) strand; PAM type: NRG; PAM sequence: AAG
gcatccctccttctccccta

SEQ ID NO: 38950 - DNA, 20 bp, Artificial Sequence
  Description of Artificial Sequence: Synthetic oligonucleotide
  Target: ATXN1; (-) strand; PAM type: NRG; PAM sequence: CAG
ttccccccaccaggaagtgg

SEQ ID NO: 38951 - DNA, 20 bp, Artificial Sequence
  Description of Artificial Sequence: Synthetic oligonucleotide
  Target: ATXN1; (-) strand; PAM type: NRG; PAM sequence: TGG
tttttccccccaccaggaag

SEQ ID NO: 38952 - DNA, 20 bp, Artificial Sequence
  Description of Artificial Sequence: Synthetic oligonucleotide
  Target: ATXN1; (-) strand; PAM type: NRG; PAM sequence: AAG
ggttttttccccccaccagg

SEQ ID NO: 38953 - DNA, 20 bp, Artificial Sequence
  Description of Artificial Sequence: Synthetic oligonucleotide
  Target: ATXN1; (-) strand; PAM type: NRG; PAM sequence: AGG
ttgggttttttccccccacc

SEQ ID NO: 38954 - DNA, 20 bp, Artificial Sequence
  Description of Artificial Sequence: Synthetic oligonucleotide
  Target: ATXN1; (-) strand; PAM type: NRG; PAM sequence: CAG
gttgggttttttccccccac

SEQ ID NO: 38955 - DNA, 20 bp, Artificial Sequence
  Description of Artificial Sequence: Synthetic oligonucleotide
  Target: ATXN1; (-) strand; PAM type: NRG; PAM sequence: GGG
ttctgttaggtgagtgtgtt

SEQ ID NO: 38956 - DNA, 20 bp, Artificial Sequence
  Description of Artificial Sequence: Synthetic oligonucleotide
  Target: ATXN1; (-) strand; PAM type: NRG; PAM sequence: TGG
tttctgttaggtgagtgtgt

SEQ ID NO: 38957 - DNA, 20 bp, Artificial Sequence
  Description of Artificial Sequence: Synthetic oligonucleotide
  Target: ATXN1; (-) strand; PAM type: NRG; PAM sequence: GAG
ctctatgttttctgttaggt

SEQ ID NO: 38958 - DNA, 20 bp, Artificial Sequence
  Description of Artificial Sequence: Synthetic oligonucleotide
  Target: ATXN1; (-) strand; PAM type: NRG; PAM sequence: AGG
gagcctctatgttttctgtt

SEQ ID NO: 38959 - DNA, 20 bp, Artificial Sequence
  Description of Artificial Sequence: Synthetic oligonucleotide
  Target: ATXN1; (-) strand; PAM type: NRG; PAM sequence: TAG
tgagcctctatgttttctgt

SEQ ID NO: 38960 - DNA, 20 bp, Artificial Sequence
  Description of Artificial Sequence: Synthetic oligonucleotide
  Target: ATXN1; (-) strand; PAM type: NRG; PAM sequence: GAG
catttctaacttggaattgt

SEQ ID NO: 38961 - DNA, 20 bp, Artificial Sequence
  Description of Artificial Sequence: Synthetic oligonucleotide
  Target: ATXN1; (-) strand; PAM type: NRG; PAM sequence: TGG
tgttgatcccatttctaact

SEQ ID NO: 38962 - DNA, 20 bp, Artificial Sequence
  Description of Artificial Sequence: Synthetic oligonucleotide
  Target: ATXN1; (-) strand; PAM type: NRG; PAM sequence: GGG
taactcacccagtttagttt

SEQ ID NO: 38963 - DNA, 20 bp, Artificial Sequence
  Description of Artificial Sequence: Synthetic oligonucleotide
  Target: ATXN1; (-) strand; PAM type: NRG; PAM sequence: TGG
ctaactcacccagtttagtt

SEQ ID NO: 38964 - DNA, 20 bp, Artificial Sequence
  Description of Artificial Sequence: Synthetic oligonucleotide
  Target: ATXN1; (-) strand; PAM type: NRG; PAM sequence: TAG
tttccctaactcacccagtt

SEQ ID NO: 38965 - DNA, 20 bp, Artificial Sequence
  Description of Artificial Sequence: Synthetic oligonucleotide
  Target: ATXN1; (-) strand; PAM type: NRG; PAM sequence: CAG
ttcgttttccctaactcacc

SEQ ID NO: 38966 - DNA, 20 bp, Artificial Sequence
  Description of Artificial Sequence: Synthetic oligonucleotide
  Target: ATXN1; (-) strand; PAM type: NRG; PAM sequence: TGG
ttcaggataattttctatgt

SEQ ID NO: 38967 - DNA, 20 bp, Artificial Sequence
  Description of Artificial Sequence: Synthetic oligonucleotide
  Target: ATXN1; (-) strand; PAM type: NRG; PAM sequence: AGG
gaattttcatttggactttc

SEQ ID NO: 38968 - DNA, 20 bp, Artificial Sequence
  Description of Artificial Sequence: Synthetic oligonucleotide
  Target: ATXN1; (-) strand; PAM type: NRG; PAM sequence: CAG
tgaattttcatttggacttt

SEQ ID NO: 38969 - DNA, 20 bp, Artificial Sequence
  Description of Artificial Sequence: Synthetic oligonucleotide
  Target: ATXN1; (-) strand; PAM type: NRG; PAM sequence: TGG
atccaaattgaattttcatt

SEQ ID NO: 38970 - DNA, 20 bp, Artificial Sequence
  Description of Artificial Sequence: Synthetic oligonucleotide
  Target: ATXN1; (-) strand; PAM type: NRG; PAM sequence: TGG
ttacctcagatcttttaaag

SEQ ID NO: 38971 - DNA, 20 bp, Artificial Sequence
  Description of Artificial Sequence: Synthetic oligonucleotide
  Target: ATXN1; (-) strand; PAM type: NRG; PAM sequence: AAG
cacttacctcagatctttta

SEQ ID NO: 38972 - DNA, 20 bp, Artificial Sequence
  Description of Artificial Sequence: Synthetic oligonucleotide
  Target: ATXN1; (-) strand; PAM type: NRG; PAM sequence: CAG
gagatggatgccacttacct

SEQ ID NO: 38973 - DNA, 20 bp, Artificial Sequence
  Description of Artificial Sequence: Synthetic oligonucleotide
  Target: ATXN1; (-) strand; PAM type: NRG; PAM sequence: TGG
gggagggagggatacagaga

SEQ ID NO: 38974 - DNA, 20 bp, Artificial Sequence
  Description of Artificial Sequence: Synthetic oligonucleotide
  Target: ATXN1; (-) strand; PAM type: NRG; PAM sequence: GAG
aggggggagggagggataca

SEQ ID NO: 38975 - DNA, 20 bp, Artificial Sequence
  Description of Artificial Sequence: Synthetic oligonucleotide
  Target: ATXN1; (-) strand; PAM type: NRG; PAM sequence: CAG
agaggggggagggagggata

SEQ ID NO: 38976 - DNA, 20 bp, Artificial Sequence
  Description of Artificial Sequence: Synthetic oligonucleotide
  Target: ATXN1; (-) strand; PAM type: NRG; PAM sequence: GGG
tggggcagaggggggaggga

SEQ ID NO: 38977 - DNA, 20 bp, Artificial Sequence
  Description of Artificial Sequence: Synthetic oligonucleotide
  Target: ATXN1; (-) strand; PAM type: NRG; PAM sequence: AGG
ctggggcagaggggggaggg

SEQ ID NO: 38978 - DNA, 20 bp, Artificial Sequence
  Description of Artificial Sequence: Synthetic oligonucleotide
  Target: ATXN1; (-) strand; PAM type: NRG; PAM sequence: GAG
actggggcagaggggggagg

SEQ ID NO: 38979 - DNA, 20 bp, Artificial Sequence
  Description of Artificial Sequence: Synthetic oligonucleotide
  Target: ATXN1; (-) strand; PAM type: NRG; PAM sequence: GGG
acactggggcagagggggga

SEQ ID NO: 38980 - DNA, 20 bp, Artificial Sequence
  Description of Artificial Sequence: Synthetic oligonucleotide
  Target: ATXN1; (-) strand; PAM type: NRG; PAM sequence: AGG
cacactggggcagagggggg

SEQ ID NO: 38981 - DNA, 20 bp, Artificial Sequence
  Description of Artificial Sequence: Synthetic oligonucleotide
  Target: ATXN1; (-) strand; PAM type: NRG; PAM sequence: GAG
ccacactggggcagaggggg

SEQ ID NO: 38982 - DNA, 20 bp, Artificial Sequence
  Description of Artificial Sequence: Synthetic oligonucleotide
  Target: ATXN1; (-) strand; PAM type: NRG; PAM sequence: GGG
ggccacactggggcagaggg

SEQ ID NO: 38983 - DNA, 20 bp, Artificial Sequence
  Description of Artificial Sequence: Synthetic oligonucleotide
  Target: ATXN1; (-) strand; PAM type: NRG; PAM sequence: GGG
gggccacactggggcagagg

SEQ ID NO: 38984 - DNA, 20 bp, Artificial Sequence
  Description of Artificial Sequence: Synthetic oligonucleotide
  Target: ATXN1; (-) strand; PAM type: NRG; PAM sequence: GGG
tgggccacactggggcagag

SEQ ID NO: 38985 - DNA, 20 bp, Artificial Sequence
  Description of Artificial Sequence: Synthetic oligonucleotide
  Target: ATXN1; (-) strand; PAM type: NRG; PAM sequence: GGG
ctgggccacactggggcaga

SEQ ID NO: 38986 - DNA, 20 bp, Artificial Sequence
  Description of Artificial Sequence: Synthetic oligonucleotide
  Target: ATXN1; (-) strand; PAM type: NRG; PAM sequence: AGG
tctgggccacactggggcag

SEQ ID NO: 38987 - DNA, 20 bp, Artificial Sequence
  Description of Artificial Sequence: Synthetic oligonucleotide
  Target: ATXN1; (-) strand; PAM type: NRG; PAM sequence: GAG
gtctgggccacactggggca

SEQ ID NO: 38988 - DNA, 20 bp, Artificial Sequence
  Description of Artificial Sequence: Synthetic oligonucleotide
  Target: ATXN1; (-) strand; PAM type: NRG; PAM sequence: CAG
ttgtctgggccacactgggg

SEQ ID NO: 38989 - DNA, 20 bp, Artificial Sequence
  Description of Artificial Sequence: Synthetic oligonucleotide
  Target: ATXN1; (-) strand; PAM type: NRG; PAM sequence: GGG
agtttgtctgggccacactg

SEQ ID NO: 38990 - DNA, 20 bp, Artificial Sequence
  Description of Artificial Sequence: Synthetic oligonucleotide
  Target: ATXN1; (-) strand; PAM type: NRG; PAM sequence: GGG
cagtttgtctgggccacact

SEQ ID NO: 38991 - DNA, 20 bp, Artificial Sequence
  Description of Artificial Sequence: Synthetic oligonucleotide
  Target: ATXN1; (-) strand; PAM type: NRG; PAM sequence: TGG
tcagtttgtctgggccacac

SEQ ID NO: 38992 - DNA, 20 bp, Artificial Sequence
  Description of Artificial Sequence: Synthetic oligonucleotide
  Target: ATXN1; (-) strand; PAM type: NRG; PAM sequence: GGG
agaattatttcagtttgtct

SEQ ID NO: 38993 - DNA, 20 bp, Artificial Sequence
  Description of Artificial Sequence: Synthetic oligonucleotide
  Target: ATXN1; (-) strand; PAM type: NRG; PAM sequence: TGG
aagaattatttcagtttgtc

SEQ ID NO: 38994 - DNA, 20 bp, Artificial Sequence
  Description of Artificial Sequence: Synthetic oligonucleotide
  Target: ATXN1; (-) strand; PAM type: NRG; PAM sequence: CAG
gtttaacttaagaattattt

SEQ ID NO: 38995 - DNA, 20 bp, Artificial Sequence
  Description of Artificial Sequence: Synthetic oligonucleotide
  Target: ATXN1; (-) strand; PAM type: NRG; PAM sequence: AAG
ttccttagaatgtttaactt

SEQ ID NO: 38996 - DNA, 20 bp, Artificial Sequence
  Description of Artificial Sequence: Synthetic oligonucleotide
  Target: ATXN1; (-) strand; PAM type: NRG; PAM sequence: TAG
tatataaaatgactgttcct

SEQ ID NO: 38997 - DNA, 20 bp, Artificial Sequence
  Description of Artificial Sequence: Synthetic oligonucleotide
  Target: ATXN1; (-) strand; PAM type: NRG; PAM sequence: GGG
aacaagaacctctctttcta

SEQ ID NO: 38998 - DNA, 20 bp, Artificial Sequence
  Description of Artificial Sequence: Synthetic oligonucleotide
  Target: ATXN1; (-) strand; PAM type: NRG; PAM sequence: AGG
aaacaagaacctctctttct

SEQ ID NO: 38999 - DNA, 20 bp, Artificial Sequence
  Description of Artificial Sequence: Synthetic oligonucleotide
  Target: ATXN1; (-) strand; PAM type: NRG; PAM sequence: TAG
caaacaagaacctctctttc

SEQ ID NO: 39000 - DNA, 20 bp, Artificial Sequence
  Description of Artificial Sequence: Synthetic oligonucleotide
  Target: ATXN1; (-) strand; PAM type: NRG; PAM sequence: AAG
ttaataagaaaccaacaaac

SEQ ID NO: 39001 - DNA, 20 bp, Artificial Sequence
  Description of Artificial Sequence: Synthetic oligonucleotide
  Target: ATXN1; (-) strand; PAM type: NRG; PAM sequence: AAG
aaaaaaataatactattaat

SEQ ID NO: 39002 - DNA, 20 bp, Artificial Sequence
  Description of Artificial Sequence: Synthetic oligonucleotide
  Target: ATXN1; (-) strand; PAM type: NRG; PAM sequence: AAG
aagaaattagtcagggcgaa

SEQ ID NO: 39003 - DNA, 20 bp, Artificial Sequence
  Description of Artificial Sequence: Synthetic oligonucleotide
  Target: ATXN1; (-) strand; PAM type: NRG; PAM sequence: GGG
aatcaccaagaaattagtca

SEQ ID NO: 39004 - DNA, 20 bp, Artificial Sequence
  Description of Artificial Sequence: Synthetic oligonucleotide
  Target: ATXN1; (-) strand; PAM type: NRG; PAM sequence: AGG
caatcaccaagaaattagtc

SEQ ID NO: 39005 - DNA, 20 bp, Artificial Sequence
  Description of Artificial Sequence: Synthetic oligonucleotide
  Target: ATXN1; (-) strand; PAM type: NRG; PAM sequence: CAG
acaatcaccaagaaattagt

SEQ ID NO: 39006 - DNA, 20 bp, Artificial Sequence
  Description of Artificial Sequence: Synthetic oligonucleotide
  Target: ATXN1; (-) strand; PAM type: NRG; PAM sequence: TAG
gaacacaatcaccaagaaat

SEQ ID NO: 39007 - DNA, 20 bp, Artificial Sequence
  Description of Artificial Sequence: Synthetic oligonucleotide
  Target: ATXN1; (-) strand; PAM type: NRG; PAM sequence: AAG
tacaatggaacacaatcacc

SEQ ID NO: 39008 - DNA, 20 bp, Artificial Sequence
  Description of Artificial Sequence: Synthetic oligonucleotide
  Target: ATXN1; (-) strand; PAM type: NRG; PAM sequence: TGG
caggccttttgcgtttacaa

SEQ ID NO: 39009 - DNA, 20 bp, Artificial Sequence
  Description of Artificial Sequence: Synthetic oligonucleotide
  Target: ATXN1; (-) strand; PAM type: NRG; PAM sequence: AGG
atttttaaactagtaacagc

SEQ ID NO: 39010 - DNA, 20 bp, Artificial Sequence
  Description of Artificial Sequence: Synthetic oligonucleotide
  Target: ATXN1; (-) strand; PAM type: NRG; PAM sequence: CAG
catttttaaactagtaacag

SEQ ID NO: 39011 - DNA, 20 bp, Artificial Sequence
  Description of Artificial Sequence: Synthetic oligonucleotide
  Target: ATXN1; (-) strand; PAM type: NRG; PAM sequence: CAG
ttccatttttaaactagtaa

SEQ ID NO: 39012 - DNA, 20 bp, Artificial Sequence
  Description of Artificial Sequence: Synthetic oligonucleotide
  Target: ATXN1; (-) strand; PAM type: NRG; PAM sequence: TAG
cctgttttccatttttaaac

SEQ ID NO: 39013 - DNA, 20 bp, Artificial Sequence
  Description of Artificial Sequence: Synthetic oligonucleotide
  Target: ATXN1; (-) strand; PAM type: NRG; PAM sequence: CAG
cactttgcaatatttaccga

SEQ ID NO: 39014 - DNA, 20 bp, Artificial Sequence
  Description of Artificial Sequence: Synthetic oligonucleotide
  Target: ATXN1; (-) strand; PAM type: NRG; PAM sequence: CAG
gccgttcagcttacaaggat

SEQ ID NO: 39015 - DNA, 20 bp, Artificial Sequence
  Description of Artificial Sequence: Synthetic oligonucleotide
  Target: ATXN1; (-) strand; PAM type: NRG; PAM sequence: AGG
tcggtgccgttcagcttaca

SEQ ID NO: 39016 - DNA, 20 bp, Artificial Sequence
  Description of Artificial Sequence: Synthetic oligonucleotide
  Target: ATXN1; (-) strand; PAM type: NRG; PAM sequence: AAG
ttcggtgccgttcagcttac

SEQ ID NO: 39017 - DNA, 20 bp, Artificial Sequence
  Description of Artificial Sequence: Synthetic oligonucleotide
  Target: ATXN1; (-) strand; PAM type: NRG; PAM sequence: CAG
agaaattcttcggtgccgtt

SEQ ID NO: 39018 - DNA, 20 bp, Artificial Sequence
  Description of Artificial Sequence: Synthetic oligonucleotide
  Target: ATXN1; (-) strand; PAM type: NRG; PAM sequence: CGG
tgacaggggtagaaattctt

SEQ ID NO: 39019 - DNA, 20 bp, Artificial Sequence
  Description of Artificial Sequence: Synthetic oligonucleotide
  Target: ATXN1; (-) strand; PAM type: NRG; PAM sequence: TAG
aacattaacgatgacagggg

SEQ ID NO: 39020 - DNA, 20 bp, Artificial Sequence
  Description of Artificial Sequence: Synthetic oligonucleotide
  Target: ATXN1; (-) strand; PAM type: NRG; PAM sequence: GGG
gcaaacattaacgatgacag

SEQ ID NO: 39021 - DNA, 20 bp, Artificial Sequence
  Description of Artificial Sequence: Synthetic oligonucleotide
  Target: ATXN1; (-) strand; PAM type: NRG; PAM sequence: GGG
agcaaacattaacgatgaca

SEQ ID NO: 39022 - DNA, 20 bp, Artificial Sequence
  Description of Artificial Sequence: Synthetic oligonucleotide
  Target: ATXN1; (-) strand; PAM type: NRG; PAM sequence: AGG
tagcaaacattaacgatgac

SEQ ID NO: 39023 - DNA, 20 bp, Artificial Sequence
  Description of Artificial Sequence: Synthetic oligonucleotide
  Target: ATXN1; (-) strand; PAM type: NRG; PAM sequence: CAG
gtagcaaacattaacgatga

SEQ ID NO: 39024 - DNA, 20 bp, Artificial Sequence
  Description of Artificial Sequence: Synthetic oligonucleotide
  Target: ATXN1; (-) strand; PAM type: NRG; PAM sequence: TAG
cctctgtcaccgcttctgtg

SEQ ID NO: 39025 - DNA, 20 bp, Artificial Sequence
  Description of Artificial Sequence: Synthetic oligonucleotide
  Target: ATXN1; (-) strand; PAM type: NRG; PAM sequence: CAG
gggccccgaggctcccagag

SEQ ID NO: 39026 - DNA, 20 bp, Artificial Sequence
  Description of Artificial Sequence: Synthetic oligonucleotide
  Target: ATXN1; (-) strand; PAM type: NRG; PAM sequence: GAG
ggcgggccccgaggctccca

SEQ ID NO: 39027 - DNA, 20 bp, Artificial Sequence
  Description of Artificial Sequence: Synthetic oligonucleotide
  Target: ATXN1; (-) strand; PAM type: NRG; PAM sequence: CAG
ttggcgggccccgaggctcc

SEQ ID NO: 39028 - DNA, 20 bp, Artificial Sequence
  Description of Artificial Sequence: Synthetic oligonucleotide
  Target: ATXN1; (-) strand; PAM type: NRG; PAM sequence: AGG
gcagacgttggcgggccccg

SEQ ID NO: 39029 - DNA, 20 bp, Artificial Sequence
  Description of Artificial Sequence: Synthetic oligonucleotide
  Target: ATXN1; (-) strand; PAM type: NRG; PAM sequence: GAG
tgcagacgttggcgggcccc

SEQ ID NO: 39030 - DNA, 20 bp, Artificial Sequence
  Description of Artificial Sequence: Synthetic oligonucleotide
  Target: ATXN1; (-) strand; PAM type: NRG; PAM sequence: GGG
tcctgtttgcagacgttggc

SEQ ID NO: 39031 - DNA, 20 bp, Artificial Sequence
  Description of Artificial Sequence: Synthetic oligonucleotide
  Target: ATXN1; (-) strand; PAM type: NRG; PAM sequence: CGG
ctcctgtttgcagacgttgg

SEQ ID NO: 39032 - DNA, 20 bp, Artificial Sequence
  Description of Artificial Sequence: Synthetic oligonucleotide
  Target: ATXN1; (-) strand; PAM type: NRG; PAM sequence: TGG
agcctcctgtttgcagacgt

SEQ ID NO: 39033 - DNA, 20 bp, Artificial Sequence
  Description of Artificial Sequence: Synthetic oligonucleotide
  Target: ATXN1; (-) strand; PAM type: NRG; PAM sequence: CAG
gggcaggagcctcctgtttg

SEQ ID NO: 39034 - DNA, 20 bp, Artificial Sequence
  Description of Artificial Sequence: Synthetic oligonucleotide
  Target: ATXN1; (-) strand; PAM type: NRG; PAM sequence: GAG
gaagaacgcacagagggcag

SEQ ID NO: 39035 - DNA, 20 bp, Artificial Sequence
  Description of Artificial Sequence: Synthetic oligonucleotide
  Target: ATXN1; (-) strand; PAM type: NRG; PAM sequence: AGG
aggaagaacgcacagagggc

SEQ ID NO: 39036 - DNA, 20 bp, Artificial Sequence
  Description of Artificial Sequence: Synthetic oligonucleotide
  Target: ATXN1; (-) strand; PAM type: NRG; PAM sequence: CAG
taggaagaacgcacagaggg

SEQ ID NO: 39037 - DNA, 20 bp, Artificial Sequence
  Description of Artificial Sequence: Synthetic oligonucleotide
  Target: ATXN1; (-) strand; PAM type: NRG; PAM sequence: GGG
aaataggaagaacgcacaga

SEQ ID NO: 39038 - DNA, 20 bp, Artificial Sequence
  Description of Artificial Sequence: Synthetic oligonucleotide
  Target: ATXN1; (-) strand; PAM type: NRG; PAM sequence: AGG
caaataggaagaacgcacag

SEQ ID NO: 39039 - DNA, 20 bp, Artificial Sequence
  Description of Artificial Sequence: Synthetic oligonucleotide
  Target: ATXN1; (-) strand; PAM type: NRG; PAM sequence: GAG
tcaaataggaagaacgcaca

SEQ ID NO: 39040 - DNA, 20 bp, Artificial Sequence
  Description of Artificial Sequence: Synthetic oligonucleotide
  Target: ATXN1; (-) strand; PAM type: NRG; PAM sequence: CAG
cttcaaataggaagaacgca

SEQ ID NO: 39041 - DNA, 20 bp, Artificial Sequence
  Description of Artificial Sequence: Synthetic oligonucleotide
  Target: ATXN1; (-) strand; PAM type: NRG; PAM sequence: AAG
cagctttctcttcaaatagg

SEQ ID NO: 39042 - DNA, 20 bp, Artificial Sequence
  Description of Artificial Sequence: Synthetic oligonucleotide
  Target: ATXN1; (-) strand; PAM type: NRG; PAM sequence: AGG
tggcagctttctcttcaaat

SEQ ID NO: 39043 - DNA, 20 bp, Artificial Sequence
  Description of Artificial Sequence: Synthetic oligonucleotide
  Target: ATXN1; (-) strand; PAM type: NRG; PAM sequence: TAG
gtggcagctttctcttcaaa

SEQ ID NO: 39044 - DNA, 20 bp, Artificial Sequence
  Description of Artificial Sequence: Synthetic oligonucleotide
  Target: ATXN1; (-) strand; PAM type: NRG; PAM sequence: CAG
cggtcaccactcccttgtgg

SEQ ID NO: 39045 - DNA, 20 bp, Artificial Sequence
  Description of Artificial Sequence: Synthetic oligonucleotide
  Target: ATXN1; (-) strand; PAM type: NRG; PAM sequence: TGG
ccacggtcaccactcccttg

SEQ ID NO: 39046 - DNA, 20 bp, Artificial Sequence
  Description of Artificial Sequence: Synthetic oligonucleotide
  Target: ATXN1; (-) strand; PAM type: NRG; PAM sequence: CGG
aggggaccacctgccaccca

SEQ ID NO: 39047 - DNA, 20 bp, Artificial Sequence
  Description of Artificial Sequence: Synthetic oligonucleotide
  Target: ATXN1; (-) strand; PAM type: NRG; PAM sequence: GGG
gttggccagtggctgtggag

SEQ ID NO: 39048 - DNA, 20 bp, Artificial Sequence
  Description of Artificial Sequence: Synthetic oligonucleotide
  Target: ATXN1; (-) strand; PAM type: NRG; PAM sequence: GGG
tgttggccagtggctgtgga

SEQ ID NO: 39049 - DNA, 20 bp, Artificial Sequence
  Description of Artificial Sequence: Synthetic oligonucleotide
  Target: ATXN1; (-) strand; PAM type: NRG; PAM sequence: AGG
gtgttggccagtggctgtgg

SEQ ID NO: 39050 - DNA, 20 bp, Artificial Sequence
  Description of Artificial Sequence: Synthetic oligonucleotide
  Target: ATXN1; (-) strand; PAM type: NRG; PAM sequence: GAG
cgtgttggccagtggctgtg

SEQ ID NO: 39051 - DNA, 20 bp, Artificial Sequence
  Description of Artificial Sequence: Synthetic oligonucleotide
  Target: ATXN1; (-) strand; PAM type: NRG; PAM sequence: TGG
agcgtgttggccagtggctg

SEQ ID NO: 39052 - DNA, 20 bp, Artificial Sequence
  Description of Artificial Sequence: Synthetic oligonucleotide
  Target: ATXN1; (-) strand; PAM type: NRG; PAM sequence: TGG
gttctgagcgtgttggccag

SEQ ID NO: 39053 - DNA, 20 bp, Artificial Sequence
  Description of Artificial Sequence: Synthetic oligonucleotide
  Target: ATXN1; (-) strand; PAM type: NRG; PAM sequence: CAG
tgcgttctgagcgtgttggc

SEQ ID NO: 39054 - DNA, 20 bp, Artificial Sequence
  Description of Artificial Sequence: Synthetic oligonucleotide
  Target: ATXN1; (-) strand; PAM type: NRG; PAM sequence: TGG
tgtgtgcgttctgagcgtgt

SEQ ID NO: 39055 - DNA, 20 bp, Artificial Sequence
  Description of Artificial Sequence: Synthetic oligonucleotide
  Target: ATXN1; (-) strand; PAM type: NRG; PAM sequence: GAG
ctgttgtgtgtgtgcgttct

SEQ ID NO: 39056 - DNA, 20 bp, Artificial Sequence
  Description of Artificial Sequence: Synthetic oligonucleotide
  Target: ATXN1; (-) strand; PAM type: NRG; PAM sequence: TGG
ctgagcctggacgggaagtg

SEQ ID NO: 39057 - DNA, 20 bp, Artificial Sequence
  Description of Artificial Sequence: Synthetic oligonucleotide
  Target: ATXN1; (-) strand; PAM type: NRG; PAM sequence: AAG
tgcctctgagcctggacggg

SEQ ID NO: 39058 - DNA, 20 bp, Artificial Sequence
  Description of Artificial Sequence: Synthetic oligonucleotide
  Target: ATXN1; (-) strand; PAM type: NRG; PAM sequence: GGG
ccctgcctctgagcctggac

SEQ ID NO: 39059 - DNA, 20 bp, Artificial Sequence
  Description of Artificial Sequence: Synthetic oligonucleotide
  Target: ATXN1; (-) strand; PAM type: NRG; PAM sequence: CGG
gccctgcctctgagcctgga

SEQ ID NO: 39060 - DNA, 20 bp, Artificial Sequence
  Description of Artificial Sequence: Synthetic oligonucleotide
  Target: ATXN1; (-) strand; PAM type: NRG; PAM sequence: TGG
tggagccctgcctctgagcc

SEQ ID NO: 39061 - DNA, 20 bp, Artificial Sequence
  Description of Artificial Sequence: Synthetic oligonucleotide
  Target: ATXN1; (-) strand; PAM type: NRG; PAM sequence: GAG
agacttggagccctgcctct

SEQ ID NO: 39062 - DNA, 20 bp, Artificial Sequence
  Description of Artificial Sequence: Synthetic oligonucleotide
  Target: ATXN1; (-) strand; PAM type: NRG; PAM sequence: GAG
gtctgtgtccttgagacttg

SEQ ID NO: 39063 - DNA, 20 bp, Artificial Sequence
  Description of Artificial Sequence: Synthetic oligonucleotide
  Target: ATXN1; (-) strand; PAM type: NRG; PAM sequence: TGG
gggtctgtgtccttgagact

SEQ ID NO: 39064 - DNA, 20 bp, Artificial Sequence
  Description of Artificial Sequence: Synthetic oligonucleotide
  Target: ATXN1; (-) strand; PAM type: NRG; PAM sequence: GAG
tcctcggggtctgtgtcctt

SEQ ID NO: 39065 - DNA, 20 bp, Artificial Sequence
  Description of Artificial Sequence: Synthetic oligonucleotide
  Target: ATXN1; (-) strand; PAM type: NRG; PAM sequence: GGG
agtgggcaggcccctcctcg

SEQ ID NO: 39066 - DNA, 20 bp, Artificial Sequence
  Description of Artificial Sequence: Synthetic oligonucleotide
  Target: ATXN1; (-) strand; PAM type: NRG; PAM sequence: GGG
aagtgggcaggcccctcctc

SEQ ID NO: 39067 - DNA, 20 bp, Artificial Sequence
  Description of Artificial Sequence: Synthetic oligonucleotide
  Target: ATXN1; (-) strand; PAM type: NRG; PAM sequence: CGG
caagtgggcaggcccctcct

SEQ ID NO: 39068 - DNA, 20 bp, Artificial Sequence
  Description of Artificial Sequence: Synthetic oligonucleotide
  Target: ATXN1; (-) strand; PAM type: NRG; PAM sequence: AGG
ggtcttttctgcaagtgggc

SEQ ID NO: 39069 - DNA, 20 bp, Artificial Sequence
  Description of Artificial Sequence: Synthetic oligonucleotide
  Target: ATXN1; (-) strand; PAM type: NRG; PAM sequence: CAG
cggtcttttctgcaagtggg

SEQ ID NO: 39070 - DNA, 20 bp, Artificial Sequence
  Description of Artificial Sequence: Synthetic oligonucleotide
  Target: ATXN1; (-) strand; PAM type: NRG; PAM sequence: GGG
ccacggtcttttctgcaagt

SEQ ID NO: 39071 - DNA, 20 bp, Artificial Sequence
  Description of Artificial Sequence: Synthetic oligonucleotide
  Target: ATXN1; (-) strand; PAM type: NRG; PAM sequence: TGG
tccacggtcttttctgcaag

SEQ ID NO: 39072 - DNA, 20 bp, Artificial Sequence
  Description of Artificial Sequence: Synthetic oligonucleotide
  Target: ATXN1; (-) strand; PAM type: NRG; PAM sequence: AAG
ttttccacggtcttttctgc

SEQ ID NO: 39073 - DNA, 20 bp, Artificial Sequence
  Description of Artificial Sequence: Synthetic oligonucleotide
  Target: ATXN1; (-) strand; PAM type: NRG; PAM sequence: CGG
tggagtcaacccattttcca

SEQ ID NO: 39074 - DNA, 20 bp, Artificial Sequence
  Description of Artificial Sequence: Synthetic oligonucleotide
  Target: ATXN1; (-) strand; PAM type: NRG; PAM sequence: GAG
ctctggagccatgtagcctg

SEQ ID NO: 39075 - DNA, 20 bp, Artificial Sequence
  Description of Artificial Sequence: Synthetic oligonucleotide
  Target: ATXN1; (-) strand; PAM type: NRG; PAM sequence: TGG
cactctggagccatgtagcc

SEQ ID NO: 39076 - DNA, 20 bp, Artificial Sequence
  Description of Artificial Sequence: Synthetic oligonucleotide
  Target: ATXN1; (-) strand; PAM type: NRG; PAM sequence: TAG
agacgcactctggagccatg

SEQ ID NO: 39077 - DNA, 20 bp, Artificial Sequence
  Description of Artificial Sequence: Synthetic oligonucleotide
  Target: ATXN1; (-) strand; PAM type: NRG; PAM sequence: GAG
catttctaagacgcactctg

SEQ ID NO: 39078 - DNA, 20 bp, Artificial Sequence
  Description of Artificial Sequence: Synthetic oligonucleotide
  Target: ATXN1; (-) strand; PAM type: NRG; PAM sequence: TGG
ttcatttctaagacgcactc

SEQ ID NO: 39079 - DNA, 20 bp, Artificial Sequence
  Description of Artificial Sequence: Synthetic oligonucleotide
  Target: ATXN1; (-) strand; PAM type: NRG; PAM sequence: AAG
aaggaggcagattcatttct

SEQ ID NO: 39080 - DNA, 20 bp, Artificial Sequence
  Description of Artificial Sequence: Synthetic oligonucleotide
  Target: ATXN1; (-) strand; PAM type: NRG; PAM sequence: CAG
gagtgtggagaggaaggagg

SEQ ID NO: 39081 - DNA, 20 bp, Artificial Sequence
  Description of Artificial Sequence: Synthetic oligonucleotide
  Target: ATXN1; (-) strand; PAM type: NRG; PAM sequence: AGG
gtggagtgtggagaggaagg

SEQ ID NO: 39082 - DNA, 20 bp, Artificial Sequence
  Description of Artificial Sequence: Synthetic oligonucleotide
  Target: ATXN1; (-) strand; PAM type: NRG; PAM sequence: GAG
tgtggagtgtggagaggaag

SEQ ID NO: 39083 - DNA, 20 bp, Artificial Sequence
  Description of Artificial Sequence: Synthetic oligonucleotide
  Target: ATXN1; (-) strand; PAM type: NRG; PAM sequence: AGG
aatgtggagtgtggagagga

SEQ ID NO: 39084 - DNA, 20 bp, Artificial Sequence
  Description of Artificial Sequence: Synthetic oligonucleotide
  Target: ATXN1; (-) strand; PAM type: NRG; PAM sequence: AAG
gaatgtggagtgtggagagg

SEQ ID NO: 39085 - DNA, 20 bp, Artificial Sequence
  Description of Artificial Sequence: Synthetic oligonucleotide
  Target: ATXN1; (-) strand; PAM type: NRG; PAM sequence: AGG
agtgaatgtggagtgtggag

SEQ ID NO: 39086 - DNA, 20 bp, Artificial Sequence
  Description of Artificial Sequence: Synthetic oligonucleotide
  Target: ATXN1; (-) strand; PAM type: NRG; PAM sequence: GAG
tagtgaatgtggagtgtgga

SEQ ID NO: 39087 - DNA, 20 bp, Artificial Sequence
  Description of Artificial Sequence: Synthetic oligonucleotide
  Target: ATXN1; (-) strand; PAM type: NRG; PAM sequence: GAG
aatagtgaatgtggagtgtg

SEQ ID NO: 39088 - DNA, 20 bp, Artificial Sequence
  Description of Artificial Sequence: Synthetic oligonucleotide
  Target: ATXN1; (-) strand; PAM type: NRG; PAM sequence: TGG
ggaatagtgaatgtggagtg

SEQ ID NO: 39089 - DNA, 20 bp, Artificial Sequence
  Description of Artificial Sequence: Synthetic oligonucleotide
  Target: ATXN1; (-) strand; PAM type: NRG; PAM sequence: GAG
cacacggaatagtgaatgtg

SEQ ID NO: 39090 - DNA, 20 bp, Artificial Sequence
  Description of Artificial Sequence: Synthetic oligonucleotide
  Target: ATXN1; (-) strand; PAM type: NRG; PAM sequence: TGG
accacacggaatagtgaatg

SEQ ID NO: 39091 - DNA, 20 bp, Artificial Sequence
  Description of Artificial Sequence: Synthetic oligonucleotide
  Target: ATXN1; (-) strand; PAM type: NRG; PAM sequence: TAG
tcccctgtcaccacacggaa

SEQ ID NO: 39092 - DNA, 20 bp, Artificial Sequence
  Description of Artificial Sequence: Synthetic oligonucleotide
  Target: ATXN1; (-) strand; PAM type: NRG; PAM sequence: CGG
cagtgtcccctgtcaccaca

SEQ ID NO: 39093 - DNA, 20 bp, Artificial Sequence
  Description of Artificial Sequence: Synthetic oligonucleotide
  Target: ATXN1; (-) strand; PAM type: NRG; PAM sequence: CAG
gagacccgggggaggaaccg

SEQ ID NO: 39094 - DNA, 20 bp, Artificial Sequence
  Description of Artificial Sequence: Synthetic oligonucleotide
  Target: ATXN1; (-) strand; PAM type: NRG; PAM sequence: AGG
cagccaaggagacccggggg

SEQ ID NO: 39095 - DNA, 20 bp, Artificial Sequence
  Description of Artificial Sequence: Synthetic oligonucleotide
  Target: ATXN1; (-) strand; PAM type: NRG; PAM sequence: GAG
ccagccaaggagacccgggg

SEQ ID NO: 39096 - DNA, 20 bp, Artificial Sequence
  Description of Artificial Sequence: Synthetic oligonucleotide
  Target: ATXN1; (-) strand; PAM type: NRG; PAM sequence: GGG
agccagccaaggagacccgg

SEQ ID NO: 39097 - DNA, 20 bp, Artificial Sequence
  Description of Artificial Sequence: Synthetic oligonucleotide
  Target: ATXN1; (-) strand; PAM type: NRG; PAM sequence: GGG
gagccagccaaggagacccg

SEQ ID NO: 39098 - DNA, 20 bp, Artificial Sequence
  Description of Artificial Sequence: Synthetic oligonucleotide
  Target: ATXN1; (-) strand; PAM type: NRG; PAM sequence: GGG
agagccagccaaggagaccc

SEQ ID NO: 39099 - DNA, 20 bp, Artificial Sequence
  Description of Artificial Sequence: Synthetic oligonucleotide
  Target: ATXN1; (-) strand; PAM type: NRG; PAM sequence: CGG
aagagccagccaaggagacc

SEQ ID NO: 39100 - DNA, 20 bp, Artificial Sequence
  Description of Artificial Sequence: Synthetic oligonucleotide
  Target: ATXN1; (-) strand; PAM type: NRG; PAM sequence: GAG
tgcagaaagagccagccaag

SEQ ID NO: 39101 - DNA, 20 bp, Artificial Sequence
  Description of Artificial Sequence: Synthetic oligonucleotide
  Target: ATXN1; (-) strand; PAM type: NRG; PAM sequence: AGG
gttgcagaaagagccagcca

SEQ ID NO: 39102 - DNA, 20 bp, Artificial Sequence
  Description of Artificial Sequence: Synthetic oligonucleotide
  Target: ATXN1; (-) strand; PAM type: NRG; PAM sequence: AAG
cgttgcagaaagagccagcc

SEQ ID NO: 39103 - DNA, 20 bp, Artificial Sequence
  Description of Artificial Sequence: Synthetic oligonucleotide
  Target: ATXN1; (-) strand; PAM type: NRG; PAM sequence: CAG
cgccacgttgcagaaagagc

SEQ ID NO: 39104 - DNA, 20 bp, Artificial Sequence
  Description of Artificial Sequence: Synthetic oligonucleotide
  Target: ATXN1; (-) strand; PAM type: NRG; PAM sequence: GAG
ctgccgccacgttgcagaaa

SEQ ID NO: 39105 - DNA, 20 bp, Artificial Sequence
  Description of Artificial Sequence: Synthetic oligonucleotide
  Target: ATXN1; (-) strand; PAM type: NRG; PAM sequence: AAG
gtctgccgccacgttgcaga

SEQ ID NO: 39106 - DNA, 20 bp, Artificial Sequence
  Description of Artificial Sequence: Synthetic oligonucleotide
  Target: ATXN1; (-) strand; PAM type: NRG; PAM sequence: CAG
gtgcgtctgccgccacgttg

SEQ ID NO: 39107 - DNA, 20 bp, Artificial Sequence
  Description of Artificial Sequence: Synthetic oligonucleotide
  Target: ATXN1; (-) strand; PAM type: NRG; PAM sequence: GAG
ctggggcggggagccttcag

SEQ ID NO: 39108 - DNA, 20 bp, Artificial Sequence
  Description of Artificial Sequence: Synthetic oligonucleotide
  Target: ATXN1; (-) strand; PAM type: NRG; PAM sequence: AGG
tgctggggcggggagccttc

SEQ ID NO: 39109 - DNA, 20 bp, Artificial Sequence
  Description of Artificial Sequence: Synthetic oligonucleotide
  Target: ATXN1; (-) strand; PAM type: NRG; PAM sequence: CAG
gtgctggggcggggagcctt

SEQ ID NO: 39110 - DNA, 20 bp, Artificial Sequence
  Description of Artificial Sequence: Synthetic oligonucleotide
  Target: ATXN1; (-) strand; PAM type: NRG; PAM sequence: GAG
atgctgagtgctggggcggg

SEQ ID NO: 39111 - DNA, 20 bp, Artificial Sequence
  Description of Artificial Sequence: Synthetic oligonucleotide
  Target: ATXN1; (-) strand; PAM type: NRG; PAM sequence: GGG
ggatgctgagtgctggggcg

SEQ ID NO: 39112 - DNA, 20 bp, Artificial Sequence
  Description of Artificial Sequence: Synthetic oligonucleotide
  Target: ATXN1; (-) strand; PAM type: NRG; PAM sequence: GGG
cggatgctgagtgctggggc

SEQ ID NO: 39113 - DNA, 20 bp, Artificial Sequence
  Description of Artificial Sequence: Synthetic oligonucleotide
  Target: ATXN1; (-) strand; PAM type: NRG; PAM sequence: CGG
gcggatgctgagtgctgggg

SEQ ID NO: 39114 - DNA, 20 bp, Artificial Sequence
  Description of Artificial Sequence: Synthetic oligonucleotide
  Target: ATXN1; (-) strand; PAM type: NRG; PAM sequence: GGG
gctgcggatgctgagtgctg

SEQ ID NO: 39115 - DNA, 20 bp, Artificial Sequence
  Description of Artificial Sequence: Synthetic oligonucleotide
  Target: ATXN1; (-) strand; PAM type: NRG; PAM sequence: GGG
tgctgcggatgctgagtgct

SEQ ID NO: 39116 - DNA, 20 bp, Artificial Sequence
  Description of Artificial Sequence: Synthetic oligonucleotide
  Target: ATXN1; (-) strand; PAM type: NRG; PAM sequence: TGG
ctgctgcggatgctgagtgc

SEQ ID NO: 39117 - DNA, 20 bp, Artificial Sequence
  Description of Artificial Sequence: Synthetic oligonucleotide
  Target: ATXN1; (-) strand; PAM type: NRG; PAM sequence: GAG
tttcccctgctgcggatgct

SEQ ID NO: 39118 - DNA, 20 bp, Artificial Sequence
  Description of Artificial Sequence: Synthetic oligonucleotide
  Target: ATXN1; (-) strand; PAM type: NRG; PAM sequence: CGG
ctcccacctttcccctgctg

SEQ ID NO: 39119 - DNA, 20 bp, Artificial Sequence
  Description of Artificial Sequence: Synthetic oligonucleotide
  Target: ATXN1; (-) strand; PAM type: NRG; PAM sequence: GAG
ggaaggagccaggagggaga

SEQ ID NO: 39120 - DNA, 20 bp, Artificial Sequence
  Description of Artificial Sequence: Synthetic oligonucleotide
  Target: ATXN1; (-) strand; PAM type: NRG; PAM sequence: GAG
agggaaggagccaggaggga

SEQ ID NO: 39121 - DNA, 20 bp, Artificial Sequence
  Description of Artificial Sequence: Synthetic oligonucleotide
  Target: ATXN1; (-) strand; PAM type: NRG; PAM sequence: GAG
ggagggaaggagccaggagg

SEQ ID NO: 39122 - DNA, 20 bp, Artificial Sequence
  Description of Artificial Sequence: Synthetic oligonucleotide
  Target: ATXN1; (-) strand; PAM type: NRG; PAM sequence: GGG
ctggagggaaggagccagga

SEQ ID NO: 39123 - DNA, 20 bp, Artificial Sequence
  Description of Artificial Sequence: Synthetic oligonucleotide
  Target: ATXN1; (-) strand; PAM type: NRG; PAM sequence: AGG
gctggagggaaggagccagg

SEQ ID NO: 39124 - DNA, 20 bp, Artificial Sequence
  Description of Artificial Sequence: Synthetic oligonucleotide
  Target: ATXN1; (-) strand; PAM type: NRG; PAM sequence: GAG
ggctggagggaaggagccag

SEQ ID NO: 39125 - DNA, 20 bp, Artificial Sequence
  Description of Artificial Sequence: Synthetic oligonucleotide
  Target: ATXN1; (-) strand; PAM type: NRG; PAM sequence: AGG
agggctggagggaaggagcc

SEQ ID NO: 39126 - DNA, 20 bp, Artificial Sequence
  Description of Artificial Sequence: Synthetic oligonucleotide
  Target: ATXN1; (-) strand; PAM type: NRG; PAM sequence: CAG
cagggctggagggaaggagc

SEQ ID NO: 39127 - DNA, 20 bp, Artificial Sequence
  Description of Artificial Sequence: Synthetic oligonucleotide
  Target: ATXN1; (-) strand; PAM type: NRG; PAM sequence: GAG
agagcagggctggagggaag

SEQ ID NO: 39128 - DNA, 20 bp, Artificial Sequence
  Description of Artificial Sequence: Synthetic oligonucleotide
  Target: ATXN1; (-) strand; PAM type: NRG; PAM sequence: AGG
ccagagcagggctggaggga

SEQ ID NO: 39129 - DNA, 20 bp, Artificial Sequence
  Description of Artificial Sequence: Synthetic oligonucleotide
  Target: ATXN1; (-) strand; PAM type: NRG; PAM sequence: AAG
gccagagcagggctggaggg

SEQ ID NO: 39130 - DNA, 20 bp, Artificial Sequence
  Description of Artificial Sequence: Synthetic oligonucleotide
  Target: ATXN1; (-) strand; PAM type: NRG; PAM sequence: GGG
ctggccagagcagggctgga

SEQ ID NO: 39131 - DNA, 20 bp, Artificial Sequence
  Description of Artificial Sequence: Synthetic oligonucleotide
  Target: ATXN1; (-) strand; PAM type: NRG; PAM sequence: AGG
tctggccagagcagggctgg

SEQ ID NO: 39132 - DNA, 20 bp, Artificial Sequence
  Description of Artificial Sequence: Synthetic oligonucleotide
  Target: ATXN1; (-) strand; PAM type: NRG; PAM sequence: GAG
ttctggccagagcagggctg

SEQ ID NO: 39133 - DNA, 20 bp, Artificial Sequence
  Description of Artificial Sequence: Synthetic oligonucleotide
  Target: ATXN1; (-) strand; PAM type: NRG; PAM sequence: TGG
cattctggccagagcagggc

SEQ ID NO: 39134 - DNA, 20 bp, Artificial Sequence
  Description of Artificial Sequence: Synthetic oligonucleotide
  Target: ATXN1; (-) strand; PAM type: NRG; PAM sequence: GGG
tccccattctggccagagca

SEQ ID NO: 39135 - DNA, 20 bp, Artificial Sequence
  Description of Artificial Sequence: Synthetic oligonucleotide
  Target: ATXN1; (-) strand; PAM type: NRG; PAM sequence: AGG
ttccccattctggccagagc

SEQ ID NO: 39136 - DNA, 20 bp, Artificial Sequence
  Description of Artificial Sequence: Synthetic oligonucleotide
  Target: ATXN1; (-) strand; PAM type: NRG; PAM sequence: CAG
cttccccattctggccagag

SEQ ID NO: 39137 - DNA, 20 bp, Artificial Sequence
  Description of Artificial Sequence: Synthetic oligonucleotide
  Target: ATXN1; (-) strand; PAM type: NRG; PAM sequence: GAG
gatcttccccattctggcca

SEQ ID NO: 39138 - DNA, 20 bp, Artificial Sequence
  Description of Artificial Sequence: Synthetic oligonucleotide
  Target: ATXN1; (-) strand; PAM type: NRG; PAM sequence: CAG
ttgatcttccccattctggc

SEQ ID NO: 39139 - DNA, 20 bp, Artificial Sequence
  Description of Artificial Sequence: Synthetic oligonucleotide
  Target: ATXN1; (-) strand; PAM type: NRG; PAM sequence: TGG
ttggttgatcttccccattc

SEQ ID NO: 39140 - DNA, 20 bp, Artificial Sequence
  Description of Artificial Sequence: Synthetic oligonucleotide
  Target: ATXN1; (-) strand; PAM type: NRG; PAM sequence: TGG
cttttggctttttccttgtt

SEQ ID NO: 39141 - DNA, 20 bp, Artificial Sequence
  Description of Artificial Sequence: Synthetic oligonucleotide
  Target: ATXN1; (-) strand; PAM type: NRG; PAM sequence: TGG
agttaaagctcattcccttt

SEQ ID NO: 39142 - DNA, 20 bp, Artificial Sequence
  Description of Artificial Sequence: Synthetic oligonucleotide
  Target: ATXN1; (-) strand; PAM type: NRG; PAM sequence: AAG
accagtgtgctatatagtta

SEQ ID NO: 39143 - DNA, 20 bp, Artificial Sequence
  Description of Artificial Sequence: Synthetic oligonucleotide
  Target: ATXN1; (-) strand; PAM type: NRG; PAM sequence: TAG
agtctgaccagtgtgctata

SEQ ID NO: 39144 - DNA, 20 bp, Artificial Sequence
  Description of Artificial Sequence: Synthetic oligonucleotide
  Target: ATXN1; (-) strand; PAM type: NRG; PAM sequence: CAG
ctgtgccaatagagtctgac

SEQ ID NO: 39145 - DNA, 20 bp, Artificial Sequence
  Description of Artificial Sequence: Synthetic oligonucleotide
  Target: ATXN1; (-) strand; PAM type: NRG; PAM sequence: GAG
caatactttctgtgccaata

SEQ ID NO: 39146 - DNA, 20 bp, Artificial Sequence
  Description of Artificial Sequence: Synthetic oligonucleotide
  Target: ATXN1; (-) strand; PAM type: NRG; PAM sequence: TAG
tgcaatactttctgtgccaa

SEQ ID NO: 39147 - DNA, 20 bp, Artificial Sequence
  Description of Artificial Sequence: Synthetic oligonucleotide
  Target: ATXN1; (-) strand; PAM type: NRG; PAM sequence: TAG
atttcattctcttgcttttt

SEQ ID NO: 39148 - DNA, 20 bp, Artificial Sequence
  Description of Artificial Sequence: Synthetic oligonucleotide
  Target: ATXN1; (-) strand; PAM type: NRG; PAM sequence: TGG
tataggaattataaaataat

SEQ ID NO: 39149 - DNA, 20 bp, Artificial Sequence
  Description of Artificial Sequence: Synthetic oligonucleotide
  Target: ATXN1; (-) strand; PAM type: NRG; PAM sequence: AGG
tgtggttctatttcaggtat

SEQ ID NO: 39150 - DNA, 20 bp, Artificial Sequence
  Description of Artificial Sequence: Synthetic oligonucleotide
  Target: ATXN1; (-) strand; PAM type: NRG; PAM sequence: TAG
ttgtggttctatttcaggta

SEQ ID NO: 39151 - DNA, 20 bp, Artificial Sequence
  Description of Artificial Sequence: Synthetic oligonucleotide
  Target: ATXN1; (-) strand; PAM type: NRG; PAM sequence: AGG
aatttttgtggttctatttc

SEQ ID NO: 39152 - DNA, 20 bp, Artificial Sequence
  Description of Artificial Sequence: Synthetic oligonucleotide
  Target: ATXN1; (-) strand; PAM type: NRG; PAM sequence: CAG
taatttttgtggttctattt

SEQ ID NO: 39153 - DNA, 20 bp, Artificial Sequence
  Description of Artificial Sequence: Synthetic oligonucleotide
  Target: ATXN1; (-) strand; PAM type: NRG; PAM sequence: TGG
gaacatcatcataatttttg

SEQ ID NO: 39154 - DNA, 20 bp, Artificial Sequence
  Description of Artificial Sequence: Synthetic oligonucleotide
  Target: ATXN1; (-) strand; PAM type: NRG; PAM sequence: AGG
cacacatggtttggagcaat

SEQ ID NO: 39155 - DNA, 20 bp, Artificial Sequence
  Description of Artificial Sequence: Synthetic oligonucleotide
  Target: ATXN1; (-) strand; PAM type: NRG; PAM sequence: TAG
acacacatggtttggagcaa

SEQ ID NO: 39156 - DNA, 20 bp, Artificial Sequence
  Description of Artificial Sequence: Synthetic oligonucleotide
  Target: ATXN1; (-) strand; PAM type: NRG; PAM sequence: GAG
gggaaaacacacatggtttg

SEQ ID NO: 39157 - DNA, 20 bp, Artificial Sequence
  Description of Artificial Sequence: Synthetic oligonucleotide
  Target: ATXN1; (-) strand; PAM type: NRG; PAM sequence: TGG
atgggaaaacacacatggtt

SEQ ID NO: 39158 - DNA, 20 bp, Artificial Sequence
  Description of Artificial Sequence: Synthetic oligonucleotide
  Target: ATXN1; (-) strand; PAM type: NRG; PAM sequence: TGG
ctaagatgggaaaacacaca

SEQ ID NO: 39159 - DNA, 20 bp, Artificial Sequence
  Description of Artificial Sequence: Synthetic oligonucleotide
  Target: ATXN1; (-) strand; PAM type: NRG; PAM sequence: GGG
cactaaaccaacactaagat

SEQ ID NO: 39160 - DNA, 20 bp, Artificial Sequence
  Description of Artificial Sequence: Synthetic oligonucleotide
  Target: ATXN1; (-) strand; PAM type: NRG; PAM sequence: TGG
ccactaaaccaacactaaga

SEQ ID NO: 39161 - DNA, 20 bp, Artificial Sequence
  Description of Artificial Sequence: Synthetic oligonucleotide
  Target: ATXN1; (-) strand; PAM type: NRG; PAM sequence: AAG
ggatccactaaaccaacact

SEQ ID NO: 39162 - DNA, 20 bp, Artificial Sequence
  Description of Artificial Sequence: Synthetic oligonucleotide
  Target: ATXN1; (-) strand; PAM type: NRG; PAM sequence: TGG
acttcgagtattgaattgac

SEQ ID NO: 39163 - DNA, 20 bp, Artificial Sequence
  Description of Artificial Sequence: Synthetic oligonucleotide
  Target: ATXN1; (-) strand; PAM type: NRG; PAM sequence: GAG
accaccttttggcttacttc

SEQ ID NO: 39164 - DNA, 20 bp, Artificial Sequence
  Description of Artificial Sequence: Synthetic oligonucleotide
  Target: ATXN1; (-) strand; PAM type: NRG; PAM sequence: TGG
gaaaaacacacaccaccttt

SEQ ID NO: 39165 - DNA, 20 bp, Artificial Sequence
  Description of Artificial Sequence: Synthetic oligonucleotide
  Target: ATXN1; (-) strand; PAM type: NRG; PAM sequence: CAG
atttacaactcatgtggact

SEQ ID NO: 39166 - DNA, 20 bp, Artificial Sequence
  Description of Artificial Sequence: Synthetic oligonucleotide
  Target: ATXN1; (-) strand; PAM type: NRG; PAM sequence: TGG
atcactatttacaactcatg

SEQ ID NO: 39167 - DNA, 20 bp, Artificial Sequence
  Description of Artificial Sequence: Synthetic oligonucleotide
  Target: ATXN1; (-) strand; PAM type: NRG; PAM sequence: TAG
gaggaatacgggctgccaca

SEQ ID NO: 39168 - DNA, 20 bp, Artificial Sequence
  Description of Artificial Sequence: Synthetic oligonucleotide
  Target: ATXN1; (-) strand; PAM type: NRG; PAM sequence: GGG
tttgatggtaagaggaatac

SEQ ID NO: 39169 - DNA, 20 bp, Artificial Sequence
  Description of Artificial Sequence: Synthetic oligonucleotide
  Target: ATXN1; (-) strand; PAM type: NRG; PAM sequence: CGG
ctttgatggtaagaggaata

SEQ ID NO: 39170 - DNA, 20 bp, Artificial Sequence
  Description of Artificial Sequence: Synthetic oligonucleotide
  Target: ATXN1; (-) strand; PAM type: NRG; PAM sequence: AGG
ttttagcctttgatggtaag

SEQ ID NO: 39171 - DNA, 20 bp, Artificial Sequence
  Description of Artificial Sequence: Synthetic oligonucleotide
  Target: ATXN1; (-) strand; PAM type: NRG; PAM sequence: GAG
tttttagcctttgatggtaa

SEQ ID NO: 39172 - DNA, 20 bp, Artificial Sequence
  Description of Artificial Sequence: Synthetic oligonucleotide
  Target: ATXN1; (-) strand; PAM type: NRG; PAM sequence: AAG
gttttttagcctttgatggt

SEQ ID NO: 39173 - DNA, 20 bp, Artificial Sequence
  Description of Artificial Sequence: Synthetic oligonucleotide
  Target: ATXN1; (-) strand; PAM type: NRG; PAM sequence: TGG
ttttgttttttagcctttga

SEQ ID NO: 39174 - DNA, 20 bp, Artificial Sequence
  Description of Artificial Sequence: Synthetic oligonucleotide
  Target: ATXN1; (-) strand; PAM type: NRG; PAM sequence: TAG
ttgtttttctttttgttttt

SEQ ID NO: 39175 - DNA, 20 bp, Artificial Sequence
  Description of Artificial Sequence: Synthetic oligonucleotide
  Target: ATXN1; (-) strand; PAM type: NRG; PAM sequence: AGG
tcagggcacttgcaattatt

SEQ ID NO: 39176 - DNA, 20 bp, Artificial Sequence
  Description of Artificial Sequence: Synthetic oligonucleotide
  Target: ATXN1; (-) strand; PAM type: NRG; PAM sequence: TAG
ctcagggcacttgcaattat

SEQ ID NO: 39177 - DNA, 20 bp, Artificial Sequence
  Description of Artificial Sequence: Synthetic oligonucleotide
  Target: ATXN1; (-) strand; PAM type: NRG; PAM sequence: GGG
tcttccatatattctgctca

SEQ ID NO: 39178 - DNA, 20 bp, Artificial Sequence
  Description of Artificial Sequence: Synthetic oligonucleotide
  Target: ATXN1; (-) strand; PAM type: NRG; PAM sequence: AGG
atcttccatatattctgctc

SEQ ID NO: 39179 - DNA, 20 bp, Artificial Sequence
  Description of Artificial Sequence: Synthetic oligonucleotide
  Target: ATXN1; (-) strand; PAM type: NRG; PAM sequence: CAG
aatcttccatatattctgct

SEQ ID NO: 39180 - DNA, 20 bp, Artificial Sequence
  Description of Artificial Sequence: Synthetic oligonucleotide
  Target: ATXN1; (-) strand; PAM type: NRG; PAM sequence: GAG
tttttaaacgtttctgttca

SEQ ID NO: 39181 - DNA, 20 bp, Artificial Sequence
  Description of Artificial Sequence: Synthetic oligonucleotide
  Target: ATXN1; (-) strand; PAM type: NRG; PAM sequence: CAG
attttttaaacgtttctgtt

SEQ ID NO: 39182 - DNA, 20 bp, Artificial Sequence
  Description of Artificial Sequence: Synthetic oligonucleotide
  Target: ATXN1; (-) strand; PAM type: NRG; PAM sequence: TAG
ttgcagtcatactgcttatt

SEQ ID NO: 39183 - DNA, 20 bp, Artificial Sequence
  Description of Artificial Sequence: Synthetic oligonucleotide
  Target: ATXN1; (-) strand; PAM type: NRG; PAM sequence: CAG
gctgggtgggctcattcttg

SEQ ID NO: 39184 - DNA, 20 bp, Artificial Sequence
  Description of Artificial Sequence: Synthetic oligonucleotide
  Target: ATXN1; (-) strand; PAM type: NRG; PAM sequence: GGG
atgcttgcagagagctgggt

SEQ ID NO: 39185 - DNA, 20 bp, Artificial Sequence
  Description of Artificial Sequence: Synthetic oligonucleotide
  Target: ATXN1; (-) strand; PAM type: NRG; PAM sequence: TGG
catgcttgcagagagctggg

SEQ ID NO: 39186 - DNA, 20 bp, Artificial Sequence
  Description of Artificial Sequence: Synthetic oligonucleotide
  Target: ATXN1; (-) strand; PAM type: NRG; PAM sequence: GGG
cagcatgcttgcagagagct

SEQ ID NO: 39187 - DNA, 20 bp, Artificial Sequence
  Description of Artificial Sequence: Synthetic oligonucleotide
  Target: ATXN1; (-) strand; PAM type: NRG; PAM sequence: TGG
tcagcatgcttgcagagagc

SEQ ID NO: 39188 - DNA, 20 bp, Artificial Sequence
  Description of Artificial Sequence: Synthetic oligonucleotide
  Target: ATXN1; (-) strand; PAM type: NRG; PAM sequence: GAG
cctctcagcatgcttgcaga

SEQ ID NO: 39189 - DNA, 20 bp, Artificial Sequence
  Description of Artificial Sequence: Synthetic oligonucleotide
  Target: ATXN1; (-) strand; PAM type: NRG; PAM sequence: GAG
accctctcagcatgcttgca

SEQ ID NO: 39190 - DNA, 20 bp, Artificial Sequence
  Description of Artificial Sequence: Synthetic oligonucleotide
  Target: ATXN1; (-) strand; PAM type: NRG; PAM sequence: CAG
ttaccctctcagcatgcttg

SEQ ID NO: 39191 - DNA, 20 bp, Artificial Sequence
  Description of Artificial Sequence: Synthetic oligonucleotide
  Target: ATXN1; (-) strand; PAM type: NRG; PAM sequence: CAG
ctcgaatttcattaccctct

SEQ ID NO: 39192 - DNA, 20 bp, Artificial Sequence
  Description of Artificial Sequence: Synthetic oligonucleotide
  Target: ATXN1; (-) strand; PAM type: NRG; PAM sequence: TAG
taggtttagaatagctagaa

SEQ ID NO: 39193 - DNA, 20 bp, Artificial Sequence
  Description of Artificial Sequence: Synthetic oligonucleotide
  Target: ATXN1; (-) strand; PAM type: NRG; PAM sequence: TAG
ttgaataggtttagaatagc

SEQ ID NO: 39194 - DNA, 20 bp, Artificial Sequence
  Description of Artificial Sequence: Synthetic oligonucleotide
  Target: ATXN1; (-) strand; PAM type: NRG; PAM sequence: TAG
acatttgaataggtttagaa

SEQ ID NO: 39195 - DNA, 20 bp, Artificial Sequence
  Description of Artificial Sequence: Synthetic oligonucleotide
  Target: ATXN1; (-) strand; PAM type: NRG; PAM sequence: TAG
caaaaacatttgaataggtt

SEQ ID NO: 39196 - DNA, 20 bp, Artificial Sequence
  Description of Artificial Sequence: Synthetic oligonucleotide
  Target: ATXN1; (-) strand; PAM type: NRG; PAM sequence: AGG
tgtaccaaaaacatttgaat

SEQ ID NO: 39197 - DNA, 20 bp, Artificial Sequence
  Description of Artificial Sequence: Synthetic oligonucleotide
  Target: ATXN1; (-) strand; PAM type: NRG; PAM sequence: TAG
gtgtaccaaaaacatttgaa

SEQ ID NO: 39198 - DNA, 20 bp, Artificial Sequence
  Description of Artificial Sequence: Synthetic oligonucleotide
  Target: ATXN1; (-) strand; PAM type: NRG; PAM sequence: GGG
tttttataaaccgttttctg

SEQ ID NO: 39199 - DNA, 20 bp, Artificial Sequence
  Description of Artificial Sequence: Synthetic oligonucleotide
  Target: ATXN1; (-) strand; PAM type: NRG; PAM sequence: GGG
atttttataaaccgttttct

SEQ ID NO: 39200 - DNA, 20 bp, Artificial Sequence
  Description of Artificial Sequence: Synthetic oligonucleotide
  Target: ATXN1; (-) strand; PAM type: NRG; PAM sequence: TGG
gatttttataaaccgttttc

SEQ ID NO: 39201 - DNA, 20 bp, Artificial Sequence
  Description of Artificial Sequence: Synthetic oligonucleotide
  Target: ATXN1; (-) strand; PAM type: NRG; PAM sequence: AGG
atttacatttagggttcacc

SEQ ID NO: 39202 - DNA, 20 bp, Artificial Sequence
  Description of Artificial Sequence: Synthetic oligonucleotide
  Target: ATXN1; (-) strand; PAM type: NRG; PAM sequence: CAG
catttacatttagggttcac

SEQ ID NO: 39203 - DNA, 20 bp, Artificial Sequence
  Description of Artificial Sequence: Synthetic oligonucleotide
  Target: ATXN1; (-) strand; PAM type: NRG; PAM sequence: GGG
ctagtattcatttacattta

SEQ ID NO: 39204 - DNA, 20 bp, Artificial Sequence
  Description of Artificial Sequence: Synthetic oligonucleotide
  Target: ATXN1; (-) strand; PAM type: NRG; PAM sequence: AGG
tctagtattcatttacattt

SEQ ID NO: 39205 - DNA, 20 bp, Artificial Sequence
  Description of Artificial Sequence: Synthetic oligonucleotide
  Target: ATXN1; (-) strand; PAM type: NRG; PAM sequence: TAG
gtctagtattcatttacatt

SEQ ID NO: 39206 - DNA, 20 bp, Artificial Sequence
  Description of Artificial Sequence: Synthetic oligonucleotide
  Target: ATXN1; (-) strand; PAM type: NRG; PAM sequence: TAG
caacccacattttggctgtc

SEQ ID NO: 39207 - DNA, 20 bp, Artificial Sequence
  Description of Artificial Sequence: Synthetic oligonucleotide
  Target: ATXN1; (-) strand; PAM type: NRG; PAM sequence: TGG
tctggtatcaacccacattt

SEQ ID NO: 39208 - DNA, 20 bp, Artificial Sequence
  Description of Artificial Sequence: Synthetic oligonucleotide
  Target: ATXN1; (-) strand; PAM type: NRG; PAM sequence: TGG
cacaaattaaaaaaaaaatc

SEQ ID NO: 39209 - DNA, 20 bp, Artificial Sequence
  Description of Artificial Sequence: Synthetic oligonucleotide
  Target: ATXN1; (-) strand; PAM type: NRG; PAM sequence: TAG
ttcttttaccccattgaaaa

SEQ ID NO: 39210 - DNA, 20 bp, Artificial Sequence
  Description of Artificial Sequence: Synthetic oligonucleotide
  Target: ATXN1; (-) strand; PAM type: NRG; PAM sequence: TGG
tttaaatattcttacttgga

SEQ ID NO: 39211 - DNA, 20 bp, Artificial Sequence
  Description of Artificial Sequence: Synthetic oligonucleotide
  Target: ATXN1; (-) strand; PAM type: NRG; PAM sequence: TGG
aatttttaaatattcttact

SEQ ID NO: 39212 - DNA, 20 bp, Artificial Sequence
  Description of Artificial Sequence: Synthetic oligonucleotide
  Target: ATXN1; (-) strand; PAM type: NRG; PAM sequence: GAG
aaaaaagttttataagtagg

SEQ ID NO: 39213 - DNA, 20 bp, Artificial Sequence
  Description of Artificial Sequence: Synthetic oligonucleotide
  Target: ATXN1; (-) strand; PAM type: NRG; PAM sequence: GGG
aaaaaaaagttttataagta

SEQ ID NO: 39214 - DNA, 20 bp, Artificial Sequence
  Description of Artificial Sequence: Synthetic oligonucleotide
  Target: ATXN1; (-) strand; PAM type: NRG; PAM sequence: AGG
taaaaaaaagttttataagt

SEQ ID NO: 39215 - DNA, 20 bp, Artificial Sequence
  Description of Artificial Sequence: Synthetic oligonucleotide
  Target: ATXN1; (-) strand; PAM type: NRG; PAM sequence: TAG
ttaaaaaaaagttttataag

SEQ ID NO: 39216 - DNA, 20 bp, Artificial Sequence
  Description of Artificial Sequence: Synthetic oligonucleotide
  Target: ATXN1; (-) strand; PAM type: NRG; PAM sequence: AAG
gctttaaaaaaaagttttat

SEQ ID NO: 39217 - DNA, 20 bp, Artificial Sequence
  Description of Artificial Sequence: Synthetic oligonucleotide
  Target: ATXN1; (-) strand; PAM type: NRG; PAM sequence: AAG
ctttaaagtgctttaaaaaa

SEQ ID NO: 39218 - DNA, 20 bp, Artificial Sequence
  Description of Artificial Sequence: Synthetic oligonucleotide
  Target: ATXN1; (-) strand; PAM type: NRG; PAM sequence: AAG
gggttttgaatgcatcttta

SEQ ID NO: 39219 - DNA, 20 bp, Artificial Sequence
  Description of Artificial Sequence: Synthetic oligonucleotide
  Target: ATXN1; (-) strand; PAM type: NRG; PAM sequence: GGG
agatccgaaatatcatttgt

SEQ ID NO: 39220 - DNA, 20 bp, Artificial Sequence
  Description of Artificial Sequence: Synthetic oligonucleotide
  Target: ATXN1; (-) strand; PAM type: NRG; PAM sequence: TGG
gagatccgaaatatcatttg

SEQ ID NO: 39221 - DNA, 20 bp, Artificial Sequence
  Description of Artificial Sequence: Synthetic oligonucleotide
  Target: ATXN1; (-) strand; PAM type: NRG; PAM sequence: GAG
ttttaaacctttcattccca

SEQ ID NO: 39222 - DNA, 20 bp, Artificial Sequence
  Description of Artificial Sequence: Synthetic oligonucleotide
  Target: ATXN1; (-) strand; PAM type: NRG; PAM sequence: CAG
gtttttaaacctttcattcc

SEQ ID NO: 39223 - DNA, 20 bp, Artificial Sequence
  Description of Artificial Sequence: Synthetic oligonucleotide
  Target: ATXN1; (-) strand; PAM type: NRG; PAM sequence: TAG
aacccagaaagggtatttca

SEQ ID NO: 39224 - DNA, 20 bp, Artificial Sequence
  Description of Artificial Sequence: Synthetic oligonucleotide
  Target: ATXN1; (-) strand; PAM type: NRG; PAM sequence: GGG
gtttggtacaaacccagaaa

SEQ ID NO: 39225 - DNA, 20 bp, Artificial Sequence
  Description of Artificial Sequence: Synthetic oligonucleotide
  Target: ATXN1; (-) strand; PAM type: NRG; PAM sequence: AGG
tgtttggtacaaacccagaa

SEQ ID NO: 39226 - DNA, 20 bp, Artificial Sequence
  Description of Artificial Sequence: Synthetic oligonucleotide
  Target: ATXN1; (-) strand; PAM type: NRG; PAM sequence: AAG
atgtttggtacaaacccaga

SEQ ID NO: 39227 - DNA, 20 bp, Artificial Sequence
  Description of Artificial Sequence: Synthetic oligonucleotide
  Target: ATXN1; (-) strand; PAM type: NRG; PAM sequence: CAG
tttaatgtttggtacaaacc

SEQ ID NO: 39228 - DNA, 20 bp, Artificial Sequence
  Description of Artificial Sequence: Synthetic oligonucleotide
  Target: ATXN1; (-) strand; PAM type: NRG; PAM sequence: TGG
tcaaatcgagatttaatgtt

SEQ ID NO: 39229 - DNA, 20 bp, Artificial Sequence
  Description of Artificial Sequence: Synthetic oligonucleotide
  Target: ATXN1; (-) strand; PAM type: NRG; PAM sequence: GAG
tttctattcaaaatcaaatc

SEQ ID NO: 39230 - DNA, 20 bp, Artificial Sequence
  Description of Artificial Sequence: Synthetic oligonucleotide
  Target: ATXN1; (-) strand; PAM type: NRG; PAM sequence: TGG
tattaatgttattttcagaa

SEQ ID NO: 39231 - DNA, 20 bp, Artificial Sequence
  Description of Artificial Sequence: Synthetic oligonucleotide
  Target: ATXN1; (-) strand; PAM type: NRG; PAM sequence: CAG
gttgttattaatgttatttt

SEQ ID NO: 39232 - DNA, 20 bp, Artificial Sequence
  Description of Artificial Sequence: Synthetic oligonucleotide
  Target: ATXN1; (-) strand; PAM type: NRG; PAM sequence: AAG
agacatttatatatgtgagc

SEQ ID NO: 39233 - DNA, 20 bp, Artificial Sequence
  Description of Artificial Sequence: Synthetic oligonucleotide
  Target: ATXN1; (-) strand; PAM type: NRG; PAM sequence: GAG
ataaagacatttatatatgt

SEQ ID NO: 39234 - DNA, 20 bp, Artificial Sequence
  Description of Artificial Sequence: Synthetic oligonucleotide
  Target: ATXN1; (-) strand; PAM type: NRG; PAM sequence: AAG
cattgagagagttttccata

SEQ ID NO: 39235 - DNA, 20 bp, Artificial Sequence
  Description of Artificial Sequence: Synthetic oligonucleotide
  Target: ATXN1; (-) strand; PAM type: NRG; PAM sequence: GAG
tttcttcagattcattgaga

SEQ ID NO: 39236 - DNA, 20 bp, Artificial Sequence
  Description of Artificial Sequence: Synthetic oligonucleotide
  Target: ATXN1; (-) strand; PAM type: NRG; PAM sequence: GAG
attttcttcagattcattga

SEQ ID NO: 39237 - DNA, 20 bp, Artificial Sequence
  Description of Artificial Sequence: Synthetic oligonucleotide
  Target: ATXN1; (-) strand; PAM type: NRG; PAM sequence: GAG
gaattttcttcagattcatt

SEQ ID NO: 39238 - DNA, 20 bp, Artificial Sequence
  Description of Artificial Sequence: Synthetic oligonucleotide
  Target: ATXN1; (-) strand; PAM type: NRG; PAM sequence: CAG
gaaactctgagaattttctt

SEQ ID NO: 39239 - DNA, 20 bp, Artificial Sequence
  Description of Artificial Sequence: Synthetic oligonucleotide
  Target: ATXN1; (-) strand; PAM type: NRG; PAM sequence: GAG
agcgggctcttagaaactct

SEQ ID NO: 39240 - DNA, 20 bp, Artificial Sequence
  Description of Artificial Sequence: Synthetic oligonucleotide
  Target: ATXN1; (-) strand; PAM type: NRG; PAM sequence: TAG
gccaggtcttagcgggctct

SEQ ID NO: 39241 - DNA, 20 bp, Artificial Sequence
  Description of Artificial Sequence: Synthetic oligonucleotide
  Target: ATXN1; (-) strand; PAM type: NRG; PAM sequence: GGG
acaaaaagccaggtcttagc

SEQ ID NO: 39242 - DNA, 20 bp, Artificial Sequence
  Description of Artificial Sequence: Synthetic oligonucleotide
  Target: ATXN1; (-) strand; PAM type: NRG; PAM sequence: CGG
cacaaaaagccaggtcttag

SEQ ID NO: 39243 - DNA, 20 bp, Artificial Sequence
  Description of Artificial Sequence: Synthetic oligonucleotide
  Target: ATXN1; (-) strand; PAM type: NRG; PAM sequence: TAG
tgtcacaaaaagccaggtct

SEQ ID NO: 39244 - DNA, 20 bp, Artificial Sequence
  Description of Artificial Sequence: Synthetic oligonucleotide
  Target: ATXN1; (-) strand; PAM type: NRG; PAM sequence: AGG
cacatctgtcacaaaaagcc

SEQ ID NO: 39245 - DNA, 20 bp, Artificial Sequence
  Description of Artificial Sequence: Synthetic oligonucleotide
  Target: ATXN1; (-) strand; PAM type: NRG; PAM sequence: CAG
ccacatctgtcacaaaaagc

SEQ ID NO: 39246 - DNA, 20 bp, Artificial Sequence
  Description of Artificial Sequence: Synthetic oligonucleotide
  Target: ATXN1; (-) strand; PAM type: NRG; PAM sequence: AAG
tttaccacatctgtcacaaa

SEQ ID NO: 39247 - DNA, 20 bp, Artificial Sequence
  Description of Artificial Sequence: Synthetic oligonucleotide
  Target: ATXN1; (-) strand; PAM type: NRG; PAM sequence: TGG
gttcctttgaaaattcattt

SEQ ID NO: 39248 - DNA, 20 bp, Artificial Sequence
  Description of Artificial Sequence: Synthetic oligonucleotide
  Target: ATXN1; (-) strand; PAM type: NRG; PAM sequence: AGG
aaactctaggccattttata

SEQ ID NO: 39249 - DNA, 20 bp, Artificial Sequence
  Description of Artificial Sequence: Synthetic oligonucleotide
  Target: ATXN1; (-) strand; PAM type: NRG; PAM sequence: AAG
taaactctaggccattttat

SEQ ID NO: 39250 - DNA, 20 bp, Artificial Sequence
  Description of Artificial Sequence: Synthetic oligonucleotide
  Target: ATXN1; (-) strand; PAM type: NRG; PAM sequence: AGG
ttctaacctgcctaaactct

SEQ ID NO: 39251 - DNA, 20 bp, Artificial Sequence
  Description of Artificial Sequence: Synthetic oligonucleotide
  Target: ATXN1; (-) strand; PAM type: NRG; PAM sequence: TAG
tttctaacctgcctaaactc

SEQ ID NO: 39252 - DNA, 20 bp, Artificial Sequence
  Description of Artificial Sequence: Synthetic oligonucleotide
  Target: ATXN1; (-) strand; PAM type: NRG; PAM sequence: TAG
tgaacgagcataaataaatg

SEQ ID NO: 39253 - DNA, 20 bp, Artificial Sequence
  Description of Artificial Sequence: Synthetic oligonucleotide
  Target: ATXN1; (-) strand; PAM type: NRG; PAM sequence: GAG
aaaggtttgggggactgaac

SEQ ID NO: 39254 - DNA, 20 bp, Artificial Sequence
  Description of Artificial Sequence: Synthetic oligonucleotide
  Target: ATXN1; (-) strand; PAM type: NRG; PAM sequence: GGG
acattgtgggaaaggtttgg

SEQ ID NO: 39255 - DNA, 20 bp, Artificial Sequence
  Description of Artificial Sequence: Synthetic oligonucleotide
  Target: ATXN1; (-) strand; PAM type: NRG; PAM sequence: GGG
aacattgtgggaaaggtttg

SEQ ID NO: 39256 - DNA, 20 bp, Artificial Sequence
  Description of Artificial Sequence: Synthetic oligonucleotide
  Target: ATXN1; (-) strand; PAM type: NRG; PAM sequence: GGG
taacattgtgggaaaggttt

SEQ ID NO: 39257 - DNA, 20 bp, Artificial Sequence
  Description of Artificial Sequence: Synthetic oligonucleotide
  Target: ATXN1; (-) strand; PAM type: NRG; PAM sequence: TGG
ataacattgtgggaaaggtt

SEQ ID NO: 39258 - DNA, 20 bp, Artificial Sequence
  Description of Artificial Sequence: Synthetic oligonucleotide
  Target: ATXN1; (-) strand; PAM type: NRG; PAM sequence: AGG
atccaataacattgtgggaa

SEQ ID NO: 39259 - DNA, 20 bp, Artificial Sequence
  Description of Artificial Sequence: Synthetic oligonucleotide
  Target: ATXN1; (-) strand; PAM type: NRG; PAM sequence: AAG
tatccaataacattgtggga

SEQ ID NO: 39260 - DNA, 20 bp, Artificial Sequence
  Description of Artificial Sequence: Synthetic oligonucleotide
  Target: ATXN1; (-) strand; PAM type: NRG; PAM sequence: GGG
tttttatccaataacattgt

SEQ ID NO: 39261 - DNA, 20 bp, Artificial Sequence
  Description of Artificial Sequence: Synthetic oligonucleotide
  Target: ATXN1; (-) strand; PAM type: NRG; PAM sequence: TGG
gtttttatccaataacattg

SEQ ID NO: 39262 - DNA, 20 bp, Artificial Sequence
  Description of Artificial Sequence: Synthetic oligonucleotide
  Target: ATXN1; (-) strand; PAM type: NRG; PAM sequence: CAG
taacttgtgtgatattcctg

SEQ ID NO: 39263 - DNA, 20 bp, Artificial Sequence
  Description of Artificial Sequence: Synthetic oligonucleotide
  Target: ATXN1; (-) strand; PAM type: NRG; PAM sequence: GAG
ccttgcgatttgcacatatt

SEQ ID NO: 39264 - DNA, 20 bp, Artificial Sequence
  Description of Artificial Sequence: Synthetic oligonucleotide
  Target: ATXN1; (-) strand; PAM type: NRG; PAM sequence: AAG
ctttttaagatgaactttta

SEQ ID NO: 39265 - DNA, 20 bp, Artificial Sequence
  Description of Artificial Sequence: Synthetic oligonucleotide
  Target: ATXN1; (-) strand; PAM type: NRG; PAM sequence: AAG
tgtccagtgtttttcttttt

SEQ ID NO: 39266 - DNA, 20 bp, Artificial Sequence
  Description of Artificial Sequence: Synthetic oligonucleotide
  Target: ATXN1; (-) strand; PAM type: NRG; PAM sequence: CAG
agagaatactcatttttgtc

SEQ ID NO: 39267 - DNA, 20 bp, Artificial Sequence
  Description of Artificial Sequence: Synthetic oligonucleotide
  Target: ATXN1; (-) strand; PAM type: NRG; PAM sequence: GAG
gagagaaaagggatggagaa

SEQ ID NO: 39268 - DNA, 20 bp, Artificial Sequence
  Description of Artificial Sequence: Synthetic oligonucleotide
  Target: ATXN1; (-) strand; PAM type: NRG; PAM sequence: AAG
ctgagagaaaagggatggag

SEQ ID NO: 39269 - DNA, 20 bp, Artificial Sequence
  Description of Artificial Sequence: Synthetic oligonucleotide
  Target: ATXN1; (-) strand; PAM type: NRG; PAM sequence: GAG
aaactgagagaaaagggatg

SEQ ID NO: 39270 - DNA, 20 bp, Artificial Sequence
  Description of Artificial Sequence: Synthetic oligonucleotide
  Target: ATXN1; (-) strand; PAM type: NRG; PAM sequence: TGG
agaaactgagagaaaaggga

SEQ ID NO: 39271 - DNA, 20 bp, Artificial Sequence
  Description of Artificial Sequence: Synthetic oligonucleotide
  Target: ATXN1; (-) strand; PAM type: NRG; PAM sequence: GGG
gcagagaaactgagagaaaa

SEQ ID NO: 39272 - DNA, 20 bp, Artificial Sequence
  Description of Artificial Sequence: Synthetic oligonucleotide
  Target: ATXN1; (-) strand; PAM type: NRG; PAM sequence: AGG
ggcagagaaactgagagaaa

SEQ ID NO: 39273 - DNA, 20 bp, Artificial Sequence
  Description of Artificial Sequence: Synthetic oligonucleotide
  Target: ATXN1; (-) strand; PAM type: NRG; PAM sequence: AAG
tggcagagaaactgagagaa

SEQ ID NO: 39274 - DNA, 20 bp, Artificial Sequence
  Description of Artificial Sequence: Synthetic oligonucleotide
  Target: ATXN1; (-) strand; PAM type: NRG; PAM sequence: GAG
agagttggcagagaaactga

SEQ ID NO: 39275 - DNA, 20 bp, Artificial Sequence
  Description of Artificial Sequence: Synthetic oligonucleotide
  Target: ATXN1; (-) strand; PAM type: NRG; PAM sequence: GAG
gcagagttggcagagaaact

SEQ ID NO: 39276 - DNA, 20 bp, Artificial Sequence
  Description of Artificial Sequence: Synthetic oligonucleotide
  Target: ATXN1; (-) strand; PAM type: NRG; PAM sequence: GAG
aggcatatgcagagttggca

SEQ ID NO: 39277 - DNA, 20 bp, Artificial Sequence
  Description of Artificial Sequence: Synthetic oligonucleotide
  Target: ATXN1; (-) strand; PAM type: NRG; PAM sequence: CAG
caaggcatatgcagagttgg

SEQ ID NO: 39278 - DNA, 20 bp, Artificial Sequence
  Description of Artificial Sequence: Synthetic oligonucleotide
  Target: ATXN1; (-) strand; PAM type: NRG; PAM sequence: TGG
gttcaaggcatatgcagagt

SEQ ID NO: 39279 - DNA, 20 bp, Artificial Sequence
  Description of Artificial Sequence: Synthetic oligonucleotide
  Target: ATXN1; (-) strand; PAM type: NRG; PAM sequence: GAG
atcagttcaaggcatatgca

SEQ ID NO: 39280 - DNA, 20 bp, Artificial Sequence
  Description of Artificial Sequence: Synthetic oligonucleotide
  Target: ATXN1; (-) strand; PAM type: NRG; PAM sequence: CAG
gaatcagttcaaggcatatg

SEQ ID NO: 39281 - DNA, 20 bp, Artificial Sequence
  Description of Artificial Sequence: Synthetic oligonucleotide
  Target: ATXN1; (-) strand; PAM type: NRG; PAM sequence: AGG
gatgtctgagaatcagttca

SEQ ID NO: 39282 - DNA, 20 bp, Artificial Sequence
  Description of Artificial Sequence: Synthetic oligonucleotide
  Target: ATXN1; (-) strand; PAM type: NRG; PAM sequence: AAG
tgatgtctgagaatcagttc

SEQ ID NO: 39283 - DNA, 20 bp, Artificial Sequence
  Description of Artificial Sequence: Synthetic oligonucleotide
  Target: ATXN1; (-) strand; PAM type: NRG; PAM sequence: CAG
tcactttgatgtctgagaat

SEQ ID NO: 39284 - DNA, 20 bp, Artificial Sequence
  Description of Artificial Sequence: Synthetic oligonucleotide
  Target: ATXN1; (-) strand; PAM type: NRG; PAM sequence: GAG
cacttttcactttgatgtct

SEQ ID NO: 39285 - DNA, 20 bp, Artificial Sequence
  Description of Artificial Sequence: Synthetic oligonucleotide
  Target: ATXN1; (-) strand; PAM type: NRG; PAM sequence: AGG
accaagtactacctgacggg

SEQ ID NO: 39286 - DNA, 20 bp, Artificial Sequence
  Description of Artificial Sequence: Synthetic oligonucleotide
  Target: ATXN1; (-) strand; PAM type: NRG; PAM sequence: GAG
caccaagtactacctgacgg

SEQ ID NO: 39287 - DNA, 20 bp, Artificial Sequence
  Description of Artificial Sequence: Synthetic oligonucleotide
  Target: ATXN1; (-) strand; PAM type: NRG; PAM sequence: GGG
accaccaagtactacctgac

SEQ ID NO: 39288 - DNA, 20 bp, Artificial Sequence
  Description of Artificial Sequence: Synthetic oligonucleotide
  Target: ATXN1; (-) strand; PAM type: NRG; PAM sequence: CGG
gaccaccaagtactacctga

SEQ ID NO: 39289 - DNA, 20 bp, Artificial Sequence
  Description of Artificial Sequence: Synthetic oligonucleotide
  Target: ATXN1; (-) strand; PAM type: NRG; PAM sequence: AAG
tgtgacaataaatgaccacc

SEQ ID NO: 39290 - DNA, 20 bp, Artificial Sequence
  Description of Artificial Sequence: Synthetic oligonucleotide
  Target: ATXN1; (-) strand; PAM type: NRG; PAM sequence: TAG
gatgaatgtgaattatgaac

SEQ ID NO: 39291 - DNA, 20 bp, Artificial Sequence
  Description of Artificial Sequence: Synthetic oligonucleotide
  Target: ATXN1; (-) strand; PAM type: NRG; PAM sequence: GGG
aagtttcaatgtggtttaaa

SEQ ID NO: 39292 - DNA, 20 bp, Artificial Sequence
  Description of Artificial Sequence: Synthetic oligonucleotide
  Target: ATXN1; (-) strand; PAM type: NRG; PAM sequence: AGG
aaagtttcaatgtggtttaa

SEQ ID NO: 39293 - DNA, 20 bp, Artificial Sequence
  Description of Artificial Sequence: Synthetic oligonucleotide
  Target: ATXN1; (-) strand; PAM type: NRG; PAM sequence: AAG
gaaagtttcaatgtggttta

SEQ ID NO: 39294 - DNA, 20 bp, Artificial Sequence
  Description of Artificial Sequence: Synthetic oligonucleotide
  Target: ATXN1; (-) strand; PAM type: NRG; PAM sequence: TGG
agatattgaaagtttcaatg

SEQ ID NO: 39295 - DNA, 20 bp, Artificial Sequence
  Description of Artificial Sequence: Synthetic oligonucleotide
  Target: ATXN1; (-) strand; PAM type: NRG; PAM sequence: AAG
gctgaagagcaagatattga

SEQ ID NO: 39296 - DNA, 20 bp, Artificial Sequence
  Description of Artificial Sequence: Synthetic oligonucleotide
  Target: ATXN1; (-) strand; PAM type: NRG; PAM sequence: AAG
ctgcagaattgctgaagagc

SEQ ID NO: 39297 - DNA, 20 bp, Artificial Sequence
  Description of Artificial Sequence: Synthetic oligonucleotide
  Target: ATXN1; (-) strand; PAM type: NRG; PAM sequence: GAG
agctctgcagaattgctgaa

SEQ ID NO: 39298 - DNA, 20 bp, Artificial Sequence
  Description of Artificial Sequence: Synthetic oligonucleotide
  Target: ATXN1; (-) strand; PAM type: NRG; PAM sequence: AAG
tcagctctgcagaattgctg

SEQ ID NO: 39299 - DNA, 20 bp, Artificial Sequence
  Description of Artificial Sequence: Synthetic oligonucleotide
  Target: ATXN1; (-) strand; PAM type: NRG; PAM sequence: CAG
gtaactacatttcagctctg

SEQ ID NO: 39300 - DNA, 20 bp, Artificial Sequence
  Description of Artificial Sequence: Synthetic oligonucleotide
  Target: ATXN1; (-) strand; PAM type: NRG; PAM sequence: CAG
tcaacactgtaactacattt

SEQ ID NO: 39301 - DNA, 20 bp, Artificial Sequence
  Description of Artificial Sequence: Synthetic oligonucleotide
  Target: ATXN1; (-) strand; PAM type: NRG; PAM sequence: AAG
aaacaaaaacaaaaaaaact

SEQ ID NO: 39302 - DNA, 20 bp, Artificial Sequence
  Description of Artificial Sequence: Synthetic oligonucleotide
  Target: ATXN1; (-) strand; PAM type: NRG; PAM sequence: GGG
atctcactttaaactctttg

SEQ ID NO: 39303 - DNA, 20 bp, Artificial Sequence
  Description of Artificial Sequence: Synthetic oligonucleotide
  Target: ATXN1; (-) strand; PAM type: NRG; PAM sequence: GGG
tatctcactttaaactcttt

SEQ ID NO: 39304 - DNA, 20 bp, Artificial Sequence
  Description of Artificial Sequence: Synthetic oligonucleotide
  Target: ATXN1; (-) strand; PAM type: NRG; PAM sequence: TGG
gtatctcactttaaactctt

SEQ ID NO: 39305 - DNA, 20 bp, Artificial Sequence
  Description of Artificial Sequence: Synthetic oligonucleotide
  Target: ATXN1; (-) strand; PAM type: NRG; PAM sequence: AAG
atcttggtctctcattcaac

SEQ ID NO: 39306 - DNA, 20 bp, Artificial Sequence
  Description of Artificial Sequence: Synthetic oligonucleotide
  Target: ATXN1; (-) strand; PAM type: NRG; PAM sequence: TGG
cactttattaccaagcatct

SEQ ID NO: 39307 - DNA, 20 bp, Artificial Sequence
  Description of Artificial Sequence: Synthetic oligonucleotide
  Target: ATXN1; (-) strand; PAM type: NRG; PAM sequence: AAG
actgttcacactttattacc

SEQ ID NO: 39308 - DNA, 20 bp, Artificial Sequence
  Description of Artificial Sequence: Synthetic oligonucleotide
  Target: ATXN1; (-) strand; PAM type: NRG; PAM sequence: AAG
gagcatatattactatcttt

SEQ ID NO: 39309 - DNA, 20 bp, Artificial Sequence
  Description of Artificial Sequence: Synthetic oligonucleotide
  Target: ATXN1; (-) strand; PAM type: NRG; PAM sequence: GAG
aggaattagattttgaagat

SEQ ID NO: 39310 - DNA, 20 bp, Artificial Sequence
  Description of Artificial Sequence: Synthetic oligonucleotide
  Target: ATXN1; (-) strand; PAM type: NRG; PAM sequence: AAG
acatgaggaattagattttg

SEQ ID NO: 39311 - DNA, 20 bp, Artificial Sequence
  Description of Artificial Sequence: Synthetic oligonucleotide
  Target: ATXN1; (-) strand; PAM type: NRG; PAM sequence: TAG
tccagtgtgacatgaggaat

SEQ ID NO: 39312 - DNA, 20 bp, Artificial Sequence
  Description of Artificial Sequence: Synthetic oligonucleotide
  Target: ATXN1; (-) strand; PAM type: NRG; PAM sequence: AGG
tcagattccagtgtgacatg

SEQ ID NO: 39313 - DNA, 20 bp, Artificial Sequence
  Description of Artificial Sequence: Synthetic oligonucleotide
  Target: ATXN1; (-) strand; PAM type: NRG; PAM sequence: GAG
ttcagattccagtgtgacat

SEQ ID NO: 39314 - DNA, 20 bp, Artificial Sequence
  Description of Artificial Sequence: Synthetic oligonucleotide
  Target: ATXN1; (-) strand; PAM type: NRG; PAM sequence: CAG
tttttttttttttcagattc

SEQ ID NO: 39315 - DNA, 20 bp, Artificial Sequence
  Description of Artificial Sequence: Synthetic oligonucleotide
  Target: ATXN1; (-) strand; PAM type: NRG; PAM sequence: CAG
gtgccacttttttttttttt

SEQ ID NO: 39316 - DNA, 20 bp, Artificial Sequence
  Description of Artificial Sequence: Synthetic oligonucleotide
  Target: ATXN1; (-) strand; PAM type: NRG; PAM sequence: GGG
ttcatgactatggacaactc

SEQ ID NO: 39317 - DNA, 20 bp, Artificial Sequence
  Description of Artificial Sequence: Synthetic oligonucleotide
  Target: ATXN1; (-) strand; PAM type: NRG; PAM sequence: CGG
gttcatgactatggacaact

SEQ ID NO: 39318 - DNA, 20 bp, Artificial Sequence
  Description of Artificial Sequence: Synthetic oligonucleotide
  Target: ATXN1; (-) strand; PAM type: NRG; PAM sequence: TGG
ctgtttatagttcatgacta

SEQ ID NO: 39319 - DNA, 20 bp, Artificial Sequence
  Description of Artificial Sequence: Synthetic oligonucleotide
  Target: ATXN1; (-) strand; PAM type: NRG; PAM sequence: TAG
ttgaactctagtactgttta

SEQ ID NO: 39320 - DNA, 20 bp, Artificial Sequence
  Description of Artificial Sequence: Synthetic oligonucleotide
  Target: ATXN1; (-) strand; PAM type: NRG; PAM sequence: TAG
atctttttgtctttgaactc

SEQ ID NO: 39321 - DNA, 20 bp, Artificial Sequence
  Description of Artificial Sequence: Synthetic oligonucleotide
  Target: ATXN1; (-) strand; PAM type: NRG; PAM sequence: GAG
caacagaagctcttcacgtt

SEQ ID NO: 39322 - DNA, 20 bp, Artificial Sequence
  Description of Artificial Sequence: Synthetic oligonucleotide
  Target: ATXN1; (-) strand; PAM type: NRG; PAM sequence: AAG
cccttcagtgagagcaacag

SEQ ID NO: 39323 - DNA, 20 bp, Artificial Sequence
  Description of Artificial Sequence: Synthetic oligonucleotide
  Target: ATXN1; (-) strand; PAM type: NRG; PAM sequence: CAG
ctgcccttcagtgagagcaa

SEQ ID NO: 39324 - DNA, 20 bp, Artificial Sequence
  Description of Artificial Sequence: Synthetic oligonucleotide
  Target: ATXN1; (-) strand; PAM type: NRG; PAM sequence: GAG
tgcaaactgcccttcagtga

SEQ ID NO: 39325 - DNA, 20 bp, Artificial Sequence
  Description of Artificial Sequence: Synthetic oligonucleotide
  Target: ATXN1; (-) strand; PAM type: NRG; PAM sequence: GAG
gatgcaaactgcccttcagt

SEQ ID NO: 39326 - DNA, 20 bp, Artificial Sequence
  Description of Artificial Sequence: Synthetic oligonucleotide
  Target: ATXN1; (-) strand; PAM type: NRG; PAM sequence: CAG
ggtagatgcaaactgccctt

SEQ ID NO: 39327 - DNA, 20 bp, Artificial Sequence
  Description of Artificial Sequence: Synthetic oligonucleotide
  Target: ATXN1; (-) strand; PAM type: NRG; PAM sequence: TAG
ttgacttcactcccaagagg

SEQ ID NO: 39328 - DNA, 20 bp, Artificial Sequence
  Description of Artificial Sequence: Synthetic oligonucleotide
  Target: ATXN1; (-) strand; PAM type: NRG; PAM sequence: AGG
gcattgacttcactcccaag

SEQ ID NO: 39329 - DNA, 20 bp, Artificial Sequence
  Description of Artificial Sequence: Synthetic oligonucleotide
  Target: ATXN1; (-) strand; PAM type: NRG; PAM sequence: GAG
tgcattgacttcactcccaa

SEQ ID NO: 39330 - DNA, 20 bp, Artificial Sequence
  Description of Artificial Sequence: Synthetic oligonucleotide
  Target: ATXN1; (-) strand; PAM type: NRG; PAM sequence: AAG
attgcattgacttcactccc

SEQ ID NO: 39331 - DNA, 20 bp, Artificial Sequence
  Description of Artificial Sequence: Synthetic oligonucleotide
  Target: ATXN1; (-) strand; PAM type: NRG; PAM sequence: AGG
cagtgttaggaaaaccaatc

SEQ ID NO: 39332 - DNA, 20 bp, Artificial Sequence
  Description of Artificial Sequence: Synthetic oligonucleotide
  Target: ATXN1; (-) strand; PAM type: NRG; PAM sequence: CAG
gcagtgttaggaaaaccaat

SEQ ID NO: 39333 - DNA, 20 bp, Artificial Sequence
  Description of Artificial Sequence: Synthetic oligonucleotide
  Target: ATXN1; (-) strand; PAM type: NRG; PAM sequence: AGG
gctggtttctgtgcagtgtt

SEQ ID NO: 39334 - DNA, 20 bp, Artificial Sequence
  Description of Artificial Sequence: Synthetic oligonucleotide
  Target: ATXN1; (-) strand; PAM type: NRG; PAM sequence: TAG
cgctggtttctgtgcagtgt

SEQ ID NO: 39335 - DNA, 20 bp, Artificial Sequence
  Description of Artificial Sequence: Synthetic oligonucleotide
  Target: ATXN1; (-) strand; PAM type: NRG; PAM sequence: CAG
cacccacgctggtttctgtg

SEQ ID NO: 39336 - DNA, 20 bp, Artificial Sequence
  Description of Artificial Sequence: Synthetic oligonucleotide
  Target: ATXN1; (-) strand; PAM type: NRG; PAM sequence: TGG
gagagagcgaacacccacgc

SEQ ID NO: 39337 - DNA, 20 bp, Artificial Sequence
  Description of Artificial Sequence: Synthetic oligonucleotide
  Target: ATXN1; (-) strand; PAM type: NRG; PAM sequence: GAG
gggggtgggggagagggaga

SEQ ID NO: 39338 - DNA, 20 bp, Artificial Sequence
  Description of Artificial Sequence: Synthetic oligonucleotide
  Target: ATXN1; (-) strand; PAM type: NRG; PAM sequence: GAG
ttgggggtgggggagaggga

SEQ ID NO: 39339 - DNA, 20 bp, Artificial Sequence
  Description of Artificial Sequence: Synthetic oligonucleotide
  Target: ATXN1; (-) strand; PAM type: NRG; PAM sequence: GAG
ggttgggggtgggggagagg

SEQ ID NO: 39340 - DNA, 20 bp, Artificial Sequence
  Description of Artificial Sequence: Synthetic oligonucleotide
  Target: ATXN1; (-) strand; PAM type: NRG; PAM sequence: GGG
ggggttgggggtgggggaga

SEQ ID NO: 39341 - DNA, 20 bp, Artificial Sequence
  Description of Artificial Sequence: Synthetic oligonucleotide
  Target: ATXN1; (-) strand; PAM type: NRG; PAM sequence: AGG
gggggttgggggtgggggag

SEQ ID NO: 39342 - DNA, 20 bp, Artificial Sequence
  Description of Artificial Sequence: Synthetic oligonucleotide
  Target: ATXN1; (-) strand; PAM type: NRG; PAM sequence: GAG
ggggggttgggggtggggga

SEQ ID NO: 39343 - DNA, 20 bp, Artificial Sequence
  Description of Artificial Sequence: Synthetic oligonucleotide
  Target: ATXN1; (-) strand; PAM type: NRG; PAM sequence: GAG
aaggggggttgggggtgggg

SEQ ID NO: 39344 - DNA, 20 bp, Artificial Sequence
  Description of Artificial Sequence: Synthetic oligonucleotide
  Target: ATXN1; (-) strand; PAM type: NRG; PAM sequence: GGG
gtaaggggggttgggggtgg

SEQ ID NO: 39345 - DNA, 20 bp, Artificial Sequence
  Description of Artificial Sequence: Synthetic oligonucleotide
  Target: ATXN1; (-) strand; PAM type: NRG; PAM sequence: GGG
ggtaaggggggttgggggtg

SEQ ID NO: 39346 - DNA, 20 bp, Artificial Sequence
  Description of Artificial Sequence: Synthetic oligonucleotide
  Target: ATXN1; (-) strand; PAM type: NRG; PAM sequence: GGG
gggtaaggggggttgggggt

SEQ ID NO: 39347 - DNA, 20 bp, Artificial Sequence
  Description of Artificial Sequence: Synthetic oligonucleotide
  Target: ATXN1; (-) strand; PAM type: NRG; PAM sequence: TGG
ggggtaaggggggttggggg

SEQ ID NO: 39348 - DNA, 20 bp, Artificial Sequence
  Description of Artificial Sequence: Synthetic oligonucleotide
  Target: ATXN1; (-) strand; PAM type: NRG; PAM sequence: GGG
catggggtaaggggggttgg

SEQ ID NO: 39349 - DNA, 20 bp, Artificial Sequence
  Description of Artificial Sequence: Synthetic oligonucleotide
  Target: ATXN1; (-) strand; PAM type: NRG; PAM sequence: GGG
acatggggtaaggggggttg

SEQ ID NO: 39350 - DNA, 20 bp, Artificial Sequence
  Description of Artificial Sequence: Synthetic oligonucleotide
  Target: ATXN1; (-) strand; PAM type: NRG; PAM sequence: GGG
cacatggggtaaggggggtt

SEQ ID NO: 39351 - DNA, 20 bp, Artificial Sequence
  Description of Artificial Sequence: Synthetic oligonucleotide
  Target: ATXN1; (-) strand; PAM type: NRG; PAM sequence: TGG
ccacatggggtaaggggggt

SEQ ID NO: 39352 - DNA, 20 bp, Artificial Sequence
  Description of Artificial Sequence: Synthetic oligonucleotide
  Target: ATXN1; (-) strand; PAM type: NRG; PAM sequence: GGG
ggccccacatggggtaaggg

SEQ ID NO: 39353 - DNA, 20 bp, Artificial Sequence
  Description of Artificial Sequence: Synthetic oligonucleotide
  Target: ATXN1; (-) strand; PAM type: NRG; PAM sequence: GGG
tggccccacatggggtaagg

SEQ ID NO: 39354 - DNA, 20 bp, Artificial Sequence
  Description of Artificial Sequence: Synthetic oligonucleotide
  Target: ATXN1; (-) strand; PAM type: NRG; PAM sequence: GGG
atggccccacatggggtaag

SEQ ID NO: 39355 - DNA, 20 bp, Artificial Sequence
  Description of Artificial Sequence: Synthetic oligonucleotide
  Target: ATXN1; (-) strand; PAM type: NRG; PAM sequence: GGG
catggccccacatggggtaa

SEQ ID NO: 39356 - DNA, 20 bp, Artificial Sequence
  Description of Artificial Sequence: Synthetic oligonucleotide
  Target: ATXN1; (-) strand; PAM type: NRG; PAM sequence: AGG
tcatggccccacatggggta

SEQ ID NO: 39357 - DNA, 20 bp, Artificial Sequence
  Description of Artificial Sequence: Synthetic oligonucleotide
  Target: ATXN1; (-) strand; PAM type: NRG; PAM sequence: AAG
gtcatggccccacatggggt

SEQ ID NO: 39358 - DNA, 20 bp, Artificial Sequence
  Description of Artificial Sequence: Synthetic oligonucleotide
  Target: ATXN1; (-) strand; PAM type: NRG; PAM sequence: GGG
tgctgtcatggccccacatg

SEQ ID NO: 39359 - DNA, 20 bp, Artificial Sequence
  Description of Artificial Sequence: Synthetic oligonucleotide
  Target: ATXN1; (-) strand; PAM type: NRG; PAM sequence: GGG
ctgctgtcatggccccacat

SEQ ID NO: 39360 - DNA, 20 bp, Artificial Sequence
  Description of Artificial Sequence: Synthetic oligonucleotide
  Target: ATXN1; (-) strand; PAM type: NRG; PAM sequence: TGG
cctgctgtcatggccccaca

SEQ ID NO: 39361 - DNA, 20 bp, Artificial Sequence
  Description of Artificial Sequence: Synthetic oligonucleotide
  Target: ATXN1; (-) strand; PAM type: NRG; PAM sequence: TGG
cagggaagcccctgctgtca

SEQ ID NO: 39362 - DNA, 20 bp, Artificial Sequence
  Description of Artificial Sequence: Synthetic oligonucleotide
  Target: ATXN1; (-) strand; PAM type: NRG; PAM sequence: AAG
gggtgttgtggtggacaggg

SEQ ID NO: 39363 - DNA, 20 bp, Artificial Sequence
  Description of Artificial Sequence: Synthetic oligonucleotide
  Target: ATXN1; (-) strand; PAM type: NRG; PAM sequence: GGG
ccagggtgttgtggtggaca

SEQ ID NO: 39364 - DNA, 20 bp, Artificial Sequence
  Description of Artificial Sequence: Synthetic oligonucleotide
  Target: ATXN1; (-) strand; PAM type: NRG; PAM sequence: AGG
accagggtgttgtggtggac

SEQ ID NO: 39365 - DNA, 20 bp, Artificial Sequence
  Description of Artificial Sequence: Synthetic oligonucleotide
  Target: ATXN1; (-) strand; PAM type: NRG; PAM sequence: CAG
caccagggtgttgtggtgga

SEQ ID NO: 39366 - DNA, 20 bp, Artificial Sequence
  Description of Artificial Sequence: Synthetic oligonucleotide
  Target: ATXN1; (-) strand; PAM type: NRG; PAM sequence: TGG
atgtcaccagggtgttgtgg

SEQ ID NO: 39367 - DNA, 20 bp, Artificial Sequence
  Description of Artificial Sequence: Synthetic oligonucleotide
  Target: ATXN1; (-) strand; PAM type: NRG; PAM sequence: TGG
gcgatgtcaccagggtgttg

SEQ ID NO: 39368 - DNA, 20 bp, Artificial Sequence
  Description of Artificial Sequence: Synthetic oligonucleotide
  Target: ATXN1; (-) strand; PAM type: NRG; PAM sequence: GGG
ctagtgcagcgatgtcacca

SEQ ID NO: 39369 - DNA, 20 bp, Artificial Sequence
  Description of Artificial Sequence: Synthetic oligonucleotide
  Target: ATXN1; (-) strand; PAM type: NRG; PAM sequence: AGG
actagtgcagcgatgtcacc

SEQ ID NO: 39370 - DNA, 20 bp, Artificial Sequence
  Description of Artificial Sequence: Synthetic oligonucleotide
  Target: ATXN1; (-) strand; PAM type: NRG; PAM sequence: CAG
tactagtgcagcgatgtcac

SEQ ID NO: 39371 - DNA, 20 bp, Artificial Sequence
  Description of Artificial Sequence: Synthetic oligonucleotide
  Target: ATXN1; (-) strand; PAM type: NRG; PAM sequence: CAG
atttctgctttttactagtg

SEQ ID NO: 39372 - DNA, 20 bp, Artificial Sequence
  Description of Artificial Sequence: Synthetic oligonucleotide
  Target: ATXN1; (-) strand; PAM type: NRG; PAM sequence: TAG
atttcatttctgctttttac

SEQ ID NO: 39373 - DNA, 20 bp, Artificial Sequence
  Description of Artificial Sequence: Synthetic oligonucleotide
  Target: ATXN1; (-) strand; PAM type: NRG; PAM sequence: GGG
aaagagcaactgccacatgc

SEQ ID NO: 39374 - DNA, 20 bp, Artificial Sequence
  Description of Artificial Sequence: Synthetic oligonucleotide
  Target: ATXN1; (-) strand; PAM type: NRG; PAM sequence: CGG
taaagagcaactgccacatg

SEQ ID NO: 39375 - DNA, 20 bp, Artificial Sequence
  Description of Artificial Sequence: Synthetic oligonucleotide
  Target: ATXN1; (-) strand; PAM type: NRG; PAM sequence: GAG
tgatatatattttttttaaa

SEQ ID NO: 39376 - DNA, 20 bp, Artificial Sequence
  Description of Artificial Sequence: Synthetic oligonucleotide
  Target: ATXN1; (-) strand; PAM type: NRG; PAM sequence: AAG
actgatatatatttttttta

SEQ ID NO: 39377 - DNA, 20 bp, Artificial Sequence
  Description of Artificial Sequence: Synthetic oligonucleotide
  Target: ATXN1; (-) strand; PAM type: NRG; PAM sequence: GGG
gatatatatttccccctatg

SEQ ID NO: 39378 - DNA, 20 bp, Artificial Sequence
  Description of Artificial Sequence: Synthetic oligonucleotide
  Target: ATXN1; (-) strand; PAM type: NRG; PAM sequence: GGG
agatatatatttccccctat

SEQ ID NO: 39379 - DNA, 20 bp, Artificial Sequence
  Description of Artificial Sequence: Synthetic oligonucleotide
  Target: ATXN1; (-) strand; PAM type: NRG; PAM sequence: TGG
tagatatatatttcccccta

SEQ ID NO: 39380 - DNA, 20 bp, Artificial Sequence
  Description of Artificial Sequence: Synthetic oligonucleotide
  Target: ATXN1; (-) strand; PAM type: NRG; PAM sequence: TAG
aaaagcaacttttaattgta

SEQ ID NO: 39381 - DNA, 20 bp, Artificial Sequence
  Description of Artificial Sequence: Synthetic oligonucleotide
  Target: ATXN1; (-) strand; PAM type: NRG; PAM sequence: AAG
tccaacatattttacaataa

SEQ ID NO: 39382 - DNA, 20 bp, Artificial Sequence
  Description of Artificial Sequence: Synthetic oligonucleotide
  Target: ATXN1; (-) strand; PAM type: NRG; PAM sequence: AAG
ttggaaagttaaccatttaa

SEQ ID NO: 39383 - DNA, 20 bp, Artificial Sequence
  Description of Artificial Sequence: Synthetic oligonucleotide
  Target: ATXN1; (-) strand; PAM type: NRG; PAM sequence: AAG
cgtcagatggcagatttgga

SEQ ID NO: 39384 - DNA, 20 bp, Artificial Sequence
  Description of Artificial Sequence: Synthetic oligonucleotide
  Target: ATXN1; (-) strand; PAM type: NRG; PAM sequence: TGG
gacgcgtcagatggcagatt

SEQ ID NO: 39385 - DNA, 20 bp, Artificial Sequence
  Description of Artificial Sequence: Synthetic oligonucleotide
  Target: ATXN1; (-) strand; PAM type: NRG; PAM sequence: CAG
cgcggagacgcgtcagatgg

SEQ ID NO: 39386 - DNA, 20 bp, Artificial Sequence
  Description of Artificial Sequence: Synthetic oligonucleotide
  Target: ATXN1; (-) strand; PAM type: NRG; PAM sequence: TGG
catcgcggagacgcgtcaga

SEQ ID NO: 39387 - DNA, 20 bp, Artificial Sequence
  Description of Artificial Sequence: Synthetic oligonucleotide
  Target: ATXN1; (-) strand; PAM type: NRG; PAM sequence: CAG
agggcatcgcggagacgcgt

SEQ ID NO: 39388 - DNA, 20 bp, Artificial Sequence
  Description of Artificial Sequence: Synthetic oligonucleotide
  Target: ATXN1; (-) strand; PAM type: NRG; PAM sequence: GAG
cccagcttcagggcatcgcg

SEQ ID NO: 39389 - DNA, 20 bp, Artificial Sequence
  Description of Artificial Sequence: Synthetic oligonucleotide
  Target: ATXN1; (-) strand; PAM type: NRG; PAM sequence: CGG
aacccagcttcagggcatcg

SEQ ID NO: 39390 - DNA, 20 bp, Artificial Sequence
  Description of Artificial Sequence: Synthetic oligonucleotide
  Target: ATXN1; (-) strand; PAM type: NRG; PAM sequence: GGG
acatcaggaacccagcttca

SEQ ID NO: 39391 - DNA, 20 bp, Artificial Sequence
  Description of Artificial Sequence: Synthetic oligonucleotide
  Target: ATXN1; (-) strand; PAM type: NRG; PAM sequence: AGG
aacatcaggaacccagcttc

SEQ ID NO: 39392 - DNA, 20 bp, Artificial Sequence
  Description of Artificial Sequence: Synthetic oligonucleotide
  Target: ATXN1; (-) strand; PAM type: NRG; PAM sequence: CAG
caacatcaggaacccagctt

SEQ ID NO: 39393 - DNA, 20 bp, Artificial Sequence
  Description of Artificial Sequence: Synthetic oligonucleotide
  Target: ATXN1; (-) strand; PAM type: NRG; PAM sequence: CAG
caaaatcaacatcaggaacc

SEQ ID NO: 39394 - DNA, 20 bp, Artificial Sequence
  Description of Artificial Sequence: Synthetic oligonucleotide
  Target: ATXN1; (-) strand; PAM type: NRG; PAM sequence: AGG
ccacgtgcaaaatcaacatc

SEQ ID NO: 39395 - DNA, 20 bp, Artificial Sequence
  Description of Artificial Sequence: Synthetic oligonucleotide
  Target: ATXN1; (-) strand; PAM type: NRG; PAM sequence: CAG
cccacgtgcaaaatcaacat

SEQ ID NO: 39396 - DNA, 20 bp, Artificial Sequence
  Description of Artificial Sequence: Synthetic oligonucleotide
  Target: ATXN1; (-) strand; PAM type: NRG; PAM sequence: GGG
ttcagagcagtgtcctcctg

SEQ ID NO: 39397 - DNA, 20 bp, Artificial Sequence
  Description of Artificial Sequence: Synthetic oligonucleotide
  Target: ATXN1; (-) strand; PAM type: NRG; PAM sequence: GGG
gttcagagcagtgtcctcct

SEQ ID NO: 39398 - DNA, 20 bp, Artificial Sequence
  Description of Artificial Sequence: Synthetic oligonucleotide
  Target: ATXN1; (-) strand; PAM type: NRG; PAM sequence: TGG
ggttcagagcagtgtcctcc

SEQ ID NO: 39399 - DNA, 20 bp, Artificial Sequence
  Description of Artificial Sequence: Synthetic oligonucleotide
  Target: ATXN1; (-) strand; PAM type: NRG; PAM sequence: CAG
tgggccgggggggttcagag

SEQ ID NO: 39400 - DNA, 20 bp, Artificial Sequence
  Description of Artificial Sequence: Synthetic oligonucleotide
  Target: ATXN1; (-) strand; PAM type: NRG; PAM sequence: GAG
gcatgggccgggggggttca

SEQ ID NO: 39401 - DNA, 20 bp, Artificial Sequence
  Description of Artificial Sequence: Synthetic oligonucleotide
  Target: ATXN1; (-) strand; PAM type: NRG; PAM sequence: CAG
cggcatgggccgggggggtt

SEQ ID NO: 39402 - DNA, 20 bp, Artificial Sequence
  Description of Artificial Sequence: Synthetic oligonucleotide
  Target: ATXN1; (-) strand; PAM type: NRG; PAM sequence: GGG
gctatcggcatgggccgggg

SEQ ID NO: 39403 - DNA, 20 bp, Artificial Sequence
  Description of Artificial Sequence: Synthetic oligonucleotide
  Target: ATXN1; (-) strand; PAM type: NRG; PAM sequence: GGG
tgctatcggcatgggccggg

SEQ ID NO: 39404 - DNA, 20 bp, Artificial Sequence
  Description of Artificial Sequence: Synthetic oligonucleotide
  Target: ATXN1; (-) strand; PAM type: NRG; PAM sequence: GGG
ttgctatcggcatgggccgg

SEQ ID NO: 39405 - DNA, 20 bp, Artificial Sequence
  Description of Artificial Sequence: Synthetic oligonucleotide
  Target: ATXN1; (-) strand; PAM type: NRG; PAM sequence: GGG
cttgctatcggcatgggccg

SEQ ID NO: 39406 - DNA, 20 bp, Artificial Sequence
  Description of Artificial Sequence: Synthetic oligonucleotide
  Target: ATXN1; (-) strand; PAM type: NRG; PAM sequence: GGG
tcttgctatcggcatgggcc

SEQ ID NO: 39407 - DNA, 20 bp, Artificial Sequence
  Description of Artificial Sequence: Synthetic oligonucleotide
  Target: ATXN1; (-) strand; PAM type: NRG; PAM sequence: CGG
ctcttgctatcggcatgggc

SEQ ID NO: 39408 - DNA, 20 bp, Artificial Sequence
  Description of Artificial Sequence: Synthetic oligonucleotide
  Target: ATXN1; (-) strand; PAM type: NRG; PAM sequence: GGG
cactctcttgctatcggcat

SEQ ID NO: 39409 - DNA, 20 bp, Artificial Sequence
  Description of Artificial Sequence: Synthetic oligonucleotide
  Target: ATXN1; (-) strand; PAM type: NRG; PAM sequence: TGG
tcactctcttgctatcggca

SEQ ID NO: 39410 - DNA, 20 bp, Artificial Sequence
  Description of Artificial Sequence: Synthetic oligonucleotide
  Target: ATXN1; (-) strand; PAM type: NRG; PAM sequence: CGG
ctgcctcactctcttgctat

SEQ ID NO: 39411 - DNA, 20 bp, Artificial Sequence
  Description of Artificial Sequence: Synthetic oligonucleotide
  Target: ATXN1; (-) strand; PAM type: NRG; PAM sequence: GGG
ggcgctgtggcggcgagtga

SEQ ID NO: 39412 - DNA, 20 bp, Artificial Sequence
  Description of Artificial Sequence: Synthetic oligonucleotide
  Target: ATXN1; (-) strand; PAM type: NRG; PAM sequence: AGG
aggcgctgtggcggcgagtg

SEQ ID NO: 39413 - DNA, 20 bp, Artificial Sequence
  Description of Artificial Sequence: Synthetic oligonucleotide
  Target: ATXN1; (-) strand; PAM type: NRG; PAM sequence: GAG
caggcgctgtggcggcgagt

SEQ ID NO: 39414 - DNA, 20 bp, Artificial Sequence
  Description of Artificial Sequence: Synthetic oligonucleotide
  Target: ATXN1; (-) strand; PAM type: NRG; PAM sequence: GAG
tgcacaggcgctgtggcggc

SEQ ID NO: 39415 - DNA, 20 bp, Artificial Sequence
  Description of Artificial Sequence: Synthetic oligonucleotide
  Target: ATXN1; (-) strand; PAM type: NRG; PAM sequence: CGG
ggggtgcacaggcgctgtgg

SEQ ID NO: 39416 - DNA, 20 bp, Artificial Sequence
  Description of Artificial Sequence: Synthetic oligonucleotide
  Target: ATXN1; (-) strand; PAM type: NRG; PAM sequence: TGG
gtgggggtgcacaggcgctg

SEQ ID NO: 39417 - DNA, 20 bp, Artificial Sequence
  Description of Artificial Sequence: Synthetic oligonucleotide
  Target: ATXN1; (-) strand; PAM type: NRG; PAM sequence: AGG
gcacgcatgtgggggtgcac

SEQ ID NO: 39418 - DNA, 20 bp, Artificial Sequence
  Description of Artificial Sequence: Synthetic oligonucleotide
  Target: ATXN1; (-) strand; PAM type: NRG; PAM sequence: CAG
tgcacgcatgtgggggtgca

SEQ ID NO: 39419 - DNA, 20 bp, Artificial Sequence
  Description of Artificial Sequence: Synthetic oligonucleotide
  Target: ATXN1; (-) strand; PAM type: NRG; PAM sequence: GGG
gcagggttgcacgcatgtgg

SEQ ID NO: 39420 - DNA, 20 bp, Artificial Sequence
  Description of Artificial Sequence: Synthetic oligonucleotide
  Target: ATXN1; (-) strand; PAM type: NRG; PAM sequence: GGG
tgcagggttgcacgcatgtg

SEQ ID NO: 39421 - DNA, 20 bp, Artificial Sequence
  Description of Artificial Sequence: Synthetic oligonucleotide
  Target: ATXN1; (-) strand; PAM type: NRG; PAM sequence: GGG
gtgcagggttgcacgcatgt

SEQ ID NO: 39422 - DNA, 20 bp, Artificial Sequence
  Description of Artificial Sequence: Synthetic oligonucleotide
  Target: ATXN1; (-) strand; PAM type: NRG; PAM sequence: TGG
ggtgcagggttgcacgcatg

SEQ ID NO: 39423 - DNA, 20 bp, Artificial Sequence
  Description of Artificial Sequence: Synthetic oligonucleotide
  Target: ATXN1; (-) strand; PAM type: NRG; PAM sequence: GGG
aagggtcctgcaggggtgca

SEQ ID NO: 39424 - DNA, 20 bp, Artificial Sequence
  Description of Artificial Sequence: Synthetic oligonucleotide
  Target: ATXN1; (-) strand; PAM type: NRG; PAM sequence: AGG
gaagggtcctgcaggggtgc

SEQ ID NO: 39425 - DNA, 20 bp, Artificial Sequence
  Description of Artificial Sequence: Synthetic oligonucleotide
  Target: ATXN1; (-) strand; PAM type: NRG; PAM sequence: CAG
ggaagggtcctgcaggggtg

SEQ ID NO: 39426 - DNA, 20 bp, Artificial Sequence
  Description of Artificial Sequence: Synthetic oligonucleotide
  Target: ATXN1; (-) strand; PAM type: NRG; PAM sequence: GGG
ccgtgggaagggtcctgcag

SEQ ID NO: 39427 - DNA, 20 bp, Artificial Sequence
  Description of Artificial Sequence: Synthetic oligonucleotide
  Target: ATXN1; (-) strand; PAM type: NRG; PAM sequence: GGG
cccgtgggaagggtcctgca

SEQ ID NO: 39428 - DNA, 20 bp, Artificial Sequence
  Description of Artificial Sequence: Synthetic oligonucleotide
  Target: ATXN1; (-) strand; PAM type: NRG; PAM sequence: AGG
tcccgtgggaagggtcctgc

SEQ ID NO: 39429 - DNA, 20 bp, Artificial Sequence
  Description of Artificial Sequence: Synthetic oligonucleotide
  Target: ATXN1; (-) strand; PAM type: NRG; PAM sequence: CAG
gtcccgtgggaagggtcctg

SEQ ID NO: 39430 - DNA, 20 bp, Artificial Sequence
  Description of Artificial Sequence: Synthetic oligonucleotide
  Target: ATXN1; (-) strand; PAM type: NRG; PAM sequence: GGG
ggagaaaagtcccgtgggaa

SEQ ID NO: 39431 - DNA, 20 bp, Artificial Sequence
  Description of Artificial Sequence: Synthetic oligonucleotide
  Target: ATXN1; (-) strand; PAM type: NRG; PAM sequence: AGG
aggagaaaagtcccgtggga

SEQ ID NO: 39432 - DNA, 20 bp, Artificial Sequence
  Description of Artificial Sequence: Synthetic oligonucleotide
  Target: ATXN1; (-) strand; PAM type: NRG; PAM sequence: AAG
caggagaaaagtcccgtggg

SEQ ID NO: 39433 - DNA, 20 bp, Artificial Sequence
  Description of Artificial Sequence: Synthetic oligonucleotide
  Target: ATXN1; (-) strand; PAM type: NRG; PAM sequence: GGG
tgtcaggagaaaagtcccgt

SEQ ID NO: 39434 - DNA, 20 bp, Artificial Sequence
  Description of Artificial Sequence: Synthetic oligonucleotide
  Target: ATXN1; (-) strand; PAM type: NRG; PAM sequence: TGG
gtgtcaggagaaaagtcccg

SEQ ID NO: 39435 - DNA, 20 bp, Artificial Sequence
  Description of Artificial Sequence: Synthetic oligonucleotide
  Target: ATXN1; (-) strand; PAM type: NRG; PAM sequence: AAG
tcccgctagtgtcaggagaa

SEQ ID NO: 39436 - DNA, 20 bp, Artificial Sequence
  Description of Artificial Sequence: Synthetic oligonucleotide
  Target: ATXN1; (-) strand; PAM type: NRG; PAM sequence: GAG
ctgactcccgctagtgtcag

SEQ ID NO: 39437 - DNA, 20 bp, Artificial Sequence
  Description of Artificial Sequence: Synthetic oligonucleotide
  Target: ATXN1; (-) strand; PAM type: NRG; PAM sequence: AGG
cgctgactcccgctagtgtc

SEQ ID NO: 39438 - DNA, 20 bp, Artificial Sequence
  Description of Artificial Sequence: Synthetic oligonucleotide
  Target: ATXN1; (-) strand; PAM type: NRG; PAM sequence: CAG
gcgctgactcccgctagtgt

SEQ ID NO: 39439 - DNA, 20 bp, Artificial Sequence
  Description of Artificial Sequence: Synthetic oligonucleotide
  Target: ATXN1; (-) strand; PAM type: NRG; PAM sequence: TAG
ccgggggcgctgactcccgc

SEQ ID NO: 39440 - DNA, 20 bp, Artificial Sequence
  Description of Artificial Sequence: Synthetic oligonucleotide
  Target: ATXN1; (-) strand; PAM type: NRG; PAM sequence: GGG
agcggcacagaagcagccgg

SEQ ID NO: 39441 - DNA, 20 bp, Artificial Sequence
  Description of Artificial Sequence: Synthetic oligonucleotide
  Target: ATXN1; (-) strand; PAM type: NRG; PAM sequence: GGG
tagcggcacagaagcagccg

SEQ ID NO: 39442 - DNA, 20 bp, Artificial Sequence
  Description of Artificial Sequence: Synthetic oligonucleotide
  Target: ATXN1; (-) strand; PAM type: NRG; PAM sequence: GGG
ctagcggcacagaagcagcc

SEQ ID NO: 39443 - DNA, 20 bp, Artificial Sequence
  Description of Artificial Sequence: Synthetic oligonucleotide
  Target: ATXN1; (-) strand; PAM type: NRG; PAM sequence: CGG
tctagcggcacagaagcagc

SEQ ID NO: 39444 - DNA, 20 bp, Artificial Sequence
  Description of Artificial Sequence: Synthetic oligonucleotide
  Target: ATXN1; (-) strand; PAM type: NRG; PAM sequence: CAG
cttctctagcggcacagaag

SEQ ID NO: 39445 - DNA, 20 bp, Artificial Sequence
  Description of Artificial Sequence: Synthetic oligonucleotide
  Target: ATXN1; (-) strand; PAM type: NRG; PAM sequence: AAG
tgccttctctagcggcacag

SEQ ID NO: 39446 - DNA, 20 bp, Artificial Sequence
  Description of Artificial Sequence: Synthetic oligonucleotide
  Target: ATXN1; (-) strand; PAM type: NRG; PAM sequence: CAG
gcctgccttctctagcggca

SEQ ID NO: 39447 - DNA, 20 bp, Artificial Sequence
  Description of Artificial Sequence: Synthetic oligonucleotide
  Target: ATXN1; (-) strand; PAM type: NRG; PAM sequence: CGG
acagtgcctgccttctctag

SEQ ID NO: 39448 - DNA, 20 bp, Artificial Sequence
  Description of Artificial Sequence: Synthetic oligonucleotide
  Target: ATXN1; (-) strand; PAM type: NRG; PAM sequence: TAG
ttcacagtgcctgccttctc

SEQ ID NO: 39449 - DNA, 20 bp, Artificial Sequence
  Description of Artificial Sequence: Synthetic oligonucleotide
  Target: ATXN1; (-) strand; PAM type: NRG; PAM sequence: CAG
aagaaaggaacggggcttca

SEQ ID NO: 39450 - DNA, 20 bp, Artificial Sequence
  Description of Artificial Sequence: Synthetic oligonucleotide
  Target: ATXN1; (-) strand; PAM type: NRG; PAM sequence: GGG
ccccggggaagaaaggaacg

SEQ ID NO: 39451 - DNA, 20 bp, Artificial Sequence
  Description of Artificial Sequence: Synthetic oligonucleotide
  Target: ATXN1; (-) strand; PAM type: NRG; PAM sequence: GGG
tccccggggaagaaaggaac

SEQ ID NO: 39452 - DNA, 20 bp, Artificial Sequence
  Description of Artificial Sequence: Synthetic oligonucleotide
  Target: ATXN1; (-) strand; PAM type: NRG; PAM sequence: CGG
atccccggggaagaaaggaa

SEQ ID NO: 39453 - DNA, 20 bp, Artificial Sequence
  Description of Artificial Sequence: Synthetic oligonucleotide
  Target: ATXN1; (-) strand; PAM type: NRG; PAM sequence: AGG
caggcatccccggggaagaa

SEQ ID NO: 39454 - DNA, 20 bp, Artificial Sequence
  Description of Artificial Sequence: Synthetic oligonucleotide
  Target: ATXN1; (-) strand; PAM type: NRG; PAM sequence: AAG
ccaggcatccccggggaaga

SEQ ID NO: 39455 - DNA, 20 bp, Artificial Sequence
  Description of Artificial Sequence: Synthetic oligonucleotide
  Target: ATXN1; (-) strand; PAM type: NRG; PAM sequence: AAG
ggctccaggcatccccgggg

SEQ ID NO: 39456 - DNA, 20 bp, Artificial Sequence
  Description of Artificial Sequence: Synthetic oligonucleotide
  Target: ATXN1; (-) strand; PAM type: NRG; PAM sequence: GGG
cagggctccaggcatccccg

SEQ ID NO: 39457 - DNA, 20 bp, Artificial Sequence
  Description of Artificial Sequence: Synthetic oligonucleotide
  Target: ATXN1; (-) strand; PAM type: NRG; PAM sequence: GGG
tcagggctccaggcatcccc

SEQ ID NO: 39458 - DNA, 20 bp, Artificial Sequence
  Description of Artificial Sequence: Synthetic oligonucleotide
  Target: ATXN1; (-) strand; PAM type: NRG; PAM sequence: CGG
gtcagggctccaggcatccc

SEQ ID NO: 39459 - DNA, 20 bp, Artificial Sequence
  Description of Artificial Sequence: Synthetic oligonucleotide
  Target: ATXN1; (-) strand; PAM type: NRG; PAM sequence: AGG
gcaggagcggtcagggctcc

SEQ ID NO: 39460 - DNA, 20 bp, Artificial Sequence
  Description of Artificial Sequence: Synthetic oligonucleotide
  Target: ATXN1; (-) strand; PAM type: NRG; PAM sequence: CAG
agcaggagcggtcagggctc

SEQ ID NO: 39461 - DNA, 20 bp, Artificial Sequence
  Description of Artificial Sequence: Synthetic oligonucleotide
  Target: ATXN1; (-) strand; PAM type: NRG; PAM sequence: GGG
gggcacagcaggagcggtca

SEQ ID NO: 39462 - DNA, 20 bp, Artificial Sequence
  Description of Artificial Sequence: Synthetic oligonucleotide
  Target: ATXN1; (-) strand; PAM type: NRG; PAM sequence: AGG
agggcacagcaggagcggtc

SEQ ID NO: 39463 - DNA, 20 bp, Artificial Sequence
  Description of Artificial Sequence: Synthetic oligonucleotide
  Target: ATXN1; (-) strand; PAM type: NRG; PAM sequence: CAG
aagggcacagcaggagcggt

SEQ ID NO: 39464 - DNA, 20 bp, Artificial Sequence
  Description of Artificial Sequence: Synthetic oligonucleotide
  Target: ATXN1; (-) strand; PAM type: NRG; PAM sequence: CGG
gaggaagggcacagcaggag

SEQ ID NO: 39465 - DNA, 20 bp, Artificial Sequence
  Description of Artificial Sequence: Synthetic oligonucleotide
  Target: ATXN1; (-) strand; PAM type: NRG; PAM sequence: GAG
cgggaggaagggcacagcag

SEQ ID NO: 39466 - DNA, 20 bp, Artificial Sequence
  Description of Artificial Sequence: Synthetic oligonucleotide
  Target: ATXN1; (-) strand; PAM type: NRG; PAM sequence: AGG
ggcgggaggaagggcacagc

SEQ ID NO: 39467 - DNA, 20 bp, Artificial Sequence
  Description of Artificial Sequence: Synthetic oligonucleotide
  Target: ATXN1; (-) strand; PAM type: NRG; PAM sequence: CAG
gggcgggaggaagggcacag

SEQ ID NO: 39468 - DNA, 20 bp, Artificial Sequence
  Description of Artificial Sequence: Synthetic oligonucleotide
  Target: ATXN1; (-) strand; PAM type: NRG; PAM sequence: CAG
agcgggcgggaggaagggca

SEQ ID NO: 39469 - DNA, 20 bp, Artificial Sequence
  Description of Artificial Sequence: Synthetic oligonucleotide
  Target: ATXN1; (-) strand; PAM type: NRG; PAM sequence: GGG
cagtgagcgggcgggaggaa

SEQ ID NO: 39470 - DNA, 20 bp, Artificial Sequence
  Description of Artificial Sequence: Synthetic oligonucleotide
  Target: ATXN1; (-) strand; PAM type: NRG; PAM sequence: AGG
tcagtgagcgggcgggagga

SEQ ID NO: 39471 - DNA, 20 bp, Artificial Sequence
  Description of Artificial Sequence: Synthetic oligonucleotide
  Target: ATXN1; (-) strand; PAM type: NRG; PAM sequence: AAG
gtcagtgagcgggcgggagg

SEQ ID NO: 39472 - DNA, 20 bp, Artificial Sequence
  Description of Artificial Sequence: Synthetic oligonucleotide
  Target: ATXN1; (-) strand; PAM type: NRG; PAM sequence: AGG
tctgtcagtgagcgggcggg

SEQ ID NO: 39473 - DNA, 20 bp, Artificial Sequence
  Description of Artificial Sequence: Synthetic oligonucleotide
  Target: ATXN1; (-) strand; PAM type: NRG; PAM sequence: GAG
gtctgtcagtgagcgggcgg

SEQ ID NO: 39474 - DNA, 20 bp, Artificial Sequence
  Description of Artificial Sequence: Synthetic oligonucleotide
  Target: ATXN1; (-) strand; PAM type: NRG; PAM sequence: GGG
gtgtctgtcagtgagcgggc

SEQ ID NO: 39475 - DNA, 20 bp, Artificial Sequence
  Description of Artificial Sequence: Synthetic oligonucleotide
  Target: ATXN1; (-) strand; PAM type: NRG; PAM sequence: CGG
agtgtctgtcagtgagcggg

SEQ ID NO: 39476 - DNA, 20 bp, Artificial Sequence
  Description of Artificial Sequence: Synthetic oligonucleotide
  Target: ATXN1; (-) strand; PAM type: NRG; PAM sequence: GGG
acgagtgtctgtcagtgagc

SEQ ID NO: 39477 - DNA, 20 bp, Artificial Sequence
  Description of Artificial Sequence: Synthetic oligonucleotide
  Target: ATXN1; (-) strand; PAM type: NRG; PAM sequence: CGG
cacgagtgtctgtcagtgag

SEQ ID NO: 39478 - DNA, 20 bp, Artificial Sequence
  Description of Artificial Sequence: Synthetic oligonucleotide
  Target: ATXN1; (-) strand; PAM type: NRG; PAM sequence: GAG
ttccacgagtgtctgtcagt

SEQ ID NO: 39479 - DNA, 20 bp, Artificial Sequence
  Description of Artificial Sequence: Synthetic oligonucleotide
  Target: ATXN1; (-) strand; PAM type: NRG; PAM sequence: CAG
ctttttccacgagtgtctgt

SEQ ID NO: 39480 - DNA, 20 bp, Artificial Sequence
  Description of Artificial Sequence: Synthetic oligonucleotide
  Target: ATXN1; (-) strand; PAM type: NRG; PAM sequence: GAG
ggtgcatatgctttttccac

SEQ ID NO: 39481 - DNA, 20 bp, Artificial Sequence
  Description of Artificial Sequence: Synthetic oligonucleotide
  Target: ATXN1; (-) strand; PAM type: NRG; PAM sequence: TGG
gcaggtgtgtcgcaggagac

SEQ ID NO: 39482 - DNA, 20 bp, Artificial Sequence
  Description of Artificial Sequence: Synthetic oligonucleotide
  Target: ATXN1; (-) strand; PAM type: NRG; PAM sequence: GAG
ttacagcaggtgtgtcgcag

SEQ ID NO: 39483 - DNA, 20 bp, Artificial Sequence
  Description of Artificial Sequence: Synthetic oligonucleotide
  Target: ATXN1; (-) strand; PAM type: NRG; PAM sequence: AGG
agttacagcaggtgtgtcgc

SEQ ID NO: 39484 - DNA, 20 bp, Artificial Sequence
  Description of Artificial Sequence: Synthetic oligonucleotide
  Target: ATXN1; (-) strand; PAM type: NRG; PAM sequence: CAG
gagttacagcaggtgtgtcg

SEQ ID NO: 39485 - DNA, 20 bp, Artificial Sequence
  Description of Artificial Sequence: Synthetic oligonucleotide
  Target: ATXN1; (-) strand; PAM type: NRG; PAM sequence: AGG
cttgtcattagagttacagc

SEQ ID NO: 39486 - DNA, 20 bp, Artificial Sequence
  Description of Artificial Sequence: Synthetic oligonucleotide
  Target: ATXN1; (-) strand; PAM type: NRG; PAM sequence: CAG
ccttgtcattagagttacag

SEQ ID NO: 39487 - DNA, 20 bp, Artificial Sequence
  Description of Artificial Sequence: Synthetic oligonucleotide
  Target: ATXN1; (-) strand; PAM type: NRG; PAM sequence: CAG
taaccttgtcattagagtta

SEQ ID NO: 39488 - DNA, 20 bp, Artificial Sequence
  Description of Artificial Sequence: Synthetic oligonucleotide
  Target: ATXN1; (-) strand; PAM type: NRG; PAM sequence: GAG
ctgttctaaccttgtcatta

SEQ ID NO: 39489 - DNA, 20 bp, Artificial Sequence
  Description of Artificial Sequence: Synthetic oligonucleotide
  Target: ATXN1; (-) strand; PAM type: NRG; PAM sequence: TAG
ttctgttctaaccttgtcat

SEQ ID NO: 39490 - DNA, 20 bp, Artificial Sequence
  Description of Artificial Sequence: Synthetic oligonucleotide
  Target: ATXN1; (-) strand; PAM type: NRG; PAM sequence: AGG
catgttatcttcttaatttt

SEQ ID NO: 39491 - DNA, 20 bp, Artificial Sequence
  Description of Artificial Sequence: Synthetic oligonucleotide
  Target: ATXN1; (-) strand; PAM type: NRG; PAM sequence: TAG
acatgttatcttcttaattt

SEQ ID NO: 39492 - DNA, 20 bp, Artificial Sequence
  Description of Artificial Sequence: Synthetic oligonucleotide
  Target: ATXN1; (-) strand; PAM type: NRG; PAM sequence: CAG
tactgtaggctaaaataaca

SEQ ID NO: 39493 - DNA, 20 bp, Artificial Sequence
  Description of Artificial Sequence: Synthetic oligonucleotide
  Target: ATXN1; (-) strand; PAM type: NRG; PAM sequence: AGG
tatccagattactgtactgt

SEQ ID NO: 39494 - DNA, 20 bp, Artificial Sequence
  Description of Artificial Sequence: Synthetic oligonucleotide
  Target: ATXN1; (-) strand; PAM type: NRG; PAM sequence: TAG
gtatccagattactgtactg

SEQ ID NO: 39495 - DNA, 20 bp, Artificial Sequence
  Description of Artificial Sequence: Synthetic oligonucleotide
  Target: ATXN1; (-) strand; PAM type: NRG; PAM sequence: CAG
tctcccttatcatttgtatc

SEQ ID NO: 39496 - DNA, 20 bp, Artificial Sequence
  Description of Artificial Sequence: Synthetic oligonucleotide
  Target: ATXN1; (-) strand; PAM type: NRG; PAM sequence: TGG
agcgtgggggaaaggaaacg

SEQ ID NO: 39497 - DNA, 20 bp, Artificial Sequence
  Description of Artificial Sequence: Synthetic oligonucleotide
  Target: ATXN1; (-) strand; PAM type: NRG; PAM sequence: AGG
gtagaggcagcgtgggggaa

SEQ ID NO: 39498 - DNA, 20 bp, Artificial Sequence
  Description of Artificial Sequence: Synthetic oligonucleotide
  Target: ATXN1; (-) strand; PAM type: NRG; PAM sequence: AAG
agtagaggcagcgtggggga

SEQ ID NO: 39499 - DNA, 20 bp, Artificial Sequence
  Description of Artificial Sequence: Synthetic oligonucleotide
  Target: ATXN1; (-) strand; PAM type: NRG; PAM sequence: GGG
ggcaagtagaggcagcgtgg

SEQ ID NO: 39500 - DNA, 20 bp, Artificial Sequence
  Description of Artificial Sequence: Synthetic oligonucleotide
  Target: ATXN1; (-) strand; PAM type: NRG; PAM sequence: GGG
aggcaagtagaggcagcgtg

SEQ ID NO: 39501 - DNA, 20 bp, Artificial Sequence
  Description of Artificial Sequence: Synthetic oligonucleotide
  Target: ATXN1; (-) strand; PAM type: NRG; PAM sequence: GGG
taggcaagtagaggcagcgt

SEQ ID NO: 39502 - DNA, 20 bp, Artificial Sequence
  Description of Artificial Sequence: Synthetic oligonucleotide
  Target: ATXN1; (-) strand; PAM type: NRG; PAM sequence: TGG
gtaggcaagtagaggcagcg

SEQ ID NO: 39503 - DNA, 20 bp, Artificial Sequence
  Description of Artificial Sequence: Synthetic oligonucleotide
  Target: ATXN1; (-) strand; PAM type: NRG; PAM sequence: CAG
ctaatgtaggcaagtagagg

SEQ ID NO: 39504 - DNA, 20 bp, Artificial Sequence
  Description of Artificial Sequence: Synthetic oligonucleotide
  Target: ATXN1; (-) strand; PAM type: NRG; PAM sequence: AGG
ggtctaatgtaggcaagtag

SEQ ID NO: 39505 - DNA, 20 bp, Artificial Sequence
  Description of Artificial Sequence: Synthetic oligonucleotide
  Target: ATXN1; (-) strand; PAM type: NRG; PAM sequence: GAG
cggtctaatgtaggcaagta

SEQ ID NO: 39506 - DNA, 20 bp, Artificial Sequence
  Description of Artificial Sequence: Synthetic oligonucleotide
  Target: ATXN1; (-) strand; PAM type: NRG; PAM sequence: TAG
gccggtctaatgtaggcaag

SEQ ID NO: 39507 - DNA, 20 bp, Artificial Sequence
  Description of Artificial Sequence: Synthetic oligonucleotide
  Target: ATXN1; (-) strand; PAM type: NRG; PAM sequence: AAG
aaggccggtctaatgtaggc

SEQ ID NO: 39508 - DNA, 20 bp, Artificial Sequence
  Description of Artificial Sequence: Synthetic oligonucleotide
  Target: ATXN1; (-) strand; PAM type: NRG; PAM sequence: AGG
attgaaggccggtctaatgt

SEQ ID NO: 39509 - DNA, 20 bp, Artificial Sequence
  Description of Artificial Sequence: Synthetic oligonucleotide
  Target: ATXN1; (-) strand; PAM type: NRG; PAM sequence: TAG
cattgaaggccggtctaatg

SEQ ID NO: 39510 - DNA, 20 bp, Artificial Sequence
  Description of Artificial Sequence: Synthetic oligonucleotide
  Target: ATXN1; (-) strand; PAM type: NRG; PAM sequence: CGG
ttaagatttgcattgaaggc

SEQ ID NO: 39511 - DNA, 20 bp, Artificial Sequence
  Description of Artificial Sequence: Synthetic oligonucleotide
  Target: ATXN1; (-) strand; PAM type: NRG; PAM sequence: AGG
gaggttaagatttgcattga

SEQ ID NO: 39512 - DNA, 20 bp, Artificial Sequence
  Description of Artificial Sequence: Synthetic oligonucleotide
  Target: ATXN1; (-) strand; PAM type: NRG; PAM sequence: AAG
ggaggttaagatttgcattg

SEQ ID NO: 39513 - DNA, 20 bp, Artificial Sequence
  Description of Artificial Sequence: Synthetic oligonucleotide
  Target: ATXN1; (-) strand; PAM type: NRG; PAM sequence: AAG
ctctaattcctcaggaggtt

SEQ ID NO: 39514 - DNA, 20 bp, Artificial Sequence
  Description of Artificial Sequence: Synthetic oligonucleotide
  Target: ATXN1; (-) strand; PAM type: NRG; PAM sequence: AGG
gccttctctaattcctcagg

SEQ ID NO: 39515 - DNA, 20 bp, Artificial Sequence
  Description of Artificial Sequence: Synthetic oligonucleotide
  Target: ATXN1; (-) strand; PAM type: NRG; PAM sequence: GAG
agccttctctaattcctcag

SEQ ID NO: 39516 - DNA, 20 bp, Artificial Sequence
  Description of Artificial Sequence: Synthetic oligonucleotide
  Target: ATXN1; (-) strand; PAM type: NRG; PAM sequence: AGG
taagccttctctaattcctc

SEQ ID NO: 39517 - DNA, 20 bp, Artificial Sequence
  Description of Artificial Sequence: Synthetic oligonucleotide
  Target: ATXN1; (-) strand; PAM type: NRG; PAM sequence: CAG
ctaagccttctctaattcct

SEQ ID NO: 39518 - DNA, 20 bp, Artificial Sequence
  Description of Artificial Sequence: Synthetic oligonucleotide
  Target: ATXN1; (-) strand; PAM type: NRG; PAM sequence: AAG
aaccacctttgactcttcct

SEQ ID NO: 39519 - DNA, 20 bp, Artificial Sequence
  Description of Artificial Sequence: Synthetic oligonucleotide
  Target: ATXN1; (-) strand; PAM type: NRG; PAM sequence: AAG
ccgcaaactggagaagtcag

SEQ ID NO: 39520 - DNA, 20 bp, Artificial Sequence
  Description of Artificial Sequence: Synthetic oligonucleotide
  Target: ATXN1; (-) strand; PAM type: NRG; PAM sequence: CAG
gagccgcaaactggagaagt

SEQ ID NO: 39521 - DNA, 20 bp, Artificial Sequence
  Description of Artificial Sequence: Synthetic oligonucleotide
  Target: ATXN1; (-) strand; PAM type: NRG; PAM sequence: AAG
cagagagccgcaaactggag

SEQ ID NO: 39522 - DNA, 20 bp, Artificial Sequence
  Description of Artificial Sequence: Synthetic oligonucleotide
  Target: ATXN1; (-) strand; PAM type: NRG; PAM sequence: GAG
cgccagagagccgcaaactg

SEQ ID NO: 39523 - DNA, 20 bp, Artificial Sequence
  Description of Artificial Sequence: Synthetic oligonucleotide
  Target: ATXN1; (-) strand; PAM type: NRG; PAM sequence: TGG
ggcgccagagagccgcaaac

SEQ ID NO: 39524 - DNA, 20 bp, Artificial Sequence
  Description of Artificial Sequence: Synthetic oligonucleotide
  Target: ATXN1; (-) strand; PAM type: NRG; PAM sequence: GAG
aggaggtggtcggcgccaga

SEQ ID NO: 39525 - DNA, 20 bp, Artificial Sequence
  Description of Artificial Sequence: Synthetic oligonucleotide
  Target: ATXN1; (-) strand; PAM type: NRG; PAM sequence: GAG
agaggaggtggtcggcgcca

SEQ ID NO: 39526 - DNA, 20 bp, Artificial Sequence
  Description of Artificial Sequence: Synthetic oligonucleotide
  Target: ATXN1; (-) strand; PAM type: NRG; PAM sequence: CAG
gaagaggaggtggtcggcgc

SEQ ID NO: 39527 - DNA, 20 bp, Artificial Sequence
  Description of Artificial Sequence: Synthetic oligonucleotide
  Target: ATXN1; (-) strand; PAM type: NRG; PAM sequence: CGG
aacgaggaagaggaggtggt

SEQ ID NO: 39528 - DNA, 20 bp, Artificial Sequence
  Description of Artificial Sequence: Synthetic oligonucleotide
  Target: ATXN1; (-) strand; PAM type: NRG; PAM sequence: TGG
cggcaacgaggaagaggagg

SEQ ID NO: 39529 - DNA, 20 bp, Artificial Sequence
  Description of Artificial Sequence: Synthetic oligonucleotide
  Target: ATXN1; (-) strand; PAM type: NRG; PAM sequence: AGG
ccgcggcaacgaggaagagg

SEQ ID NO: 39530 - DNA, 20 bp, Artificial Sequence
  Description of Artificial Sequence: Synthetic oligonucleotide
  Target: ATXN1; (-) strand; PAM type: NRG; PAM sequence: GAG
cccgcggcaacgaggaagag

SEQ ID NO: 39531 - DNA, 20 bp, Artificial Sequence
  Description of Artificial Sequence: Synthetic oligonucleotide
  Target: ATXN1; (-) strand; PAM type: NRG; PAM sequence: AGG
agcccgcggcaacgaggaag

SEQ ID NO: 39532 - DNA, 20 bp, Artificial Sequence
  Description of Artificial Sequence: Synthetic oligonucleotide
  Target: ATXN1; (-) strand; PAM type: NRG; PAM sequence: GAG
aagcccgcggcaacgaggaa

SEQ ID NO: 39533 - DNA, 20 bp, Artificial Sequence
  Description of Artificial Sequence: Synthetic oligonucleotide
  Target: ATXN1; (-) strand; PAM type: NRG; PAM sequence: AAG
gcaagcccgcggcaacgagg

SEQ ID NO: 39534 - DNA, 20 bp, Artificial Sequence
  Description of Artificial Sequence: Synthetic oligonucleotide
  Target: ATXN1; (-) strand; PAM type: NRG; PAM sequence: AGG
ccagcaagcccgcggcaacg

SEQ ID NO: 39535 - DNA, 20 bp, Artificial Sequence
  Description of Artificial Sequence: Synthetic oligonucleotide
  Target: ATXN1; (-) strand; PAM type: NRG; PAM sequence: GAG
cccagcaagcccgcggcaac

SEQ ID NO: 39536 - DNA, 20 bp, Artificial Sequence
  Description of Artificial Sequence: Synthetic oligonucleotide
  Target: ATXN1; (-) strand; PAM type: NRG; PAM sequence: CGG
aatagaacccagcaagcccg

SEQ ID NO: 39537 - DNA, 20 bp, Artificial Sequence
  Description of Artificial Sequence: Synthetic oligonucleotide
  Target: ATXN1; (-) strand; PAM type: NRG; PAM sequence: AAG
tcaccaaaatagaacccagc

SEQ ID NO: 39538 - DNA, 20 bp, Artificial Sequence
  Description of Artificial Sequence: Synthetic oligonucleotide
  Target: ATXN1; (-) strand; PAM type: NRG; PAM sequence: CAG
ttcctcaccaaaatagaacc

SEQ ID NO: 39539 - DNA, 20 bp, Artificial Sequence
  Description of Artificial Sequence: Synthetic oligonucleotide
  Target: ATXN1; (-) strand; PAM type: NRG; PAM sequence: TAG
agcgcccttcctcaccaaaa

SEQ ID NO: 39540 - DNA, 20 bp, Artificial Sequence
  Description of Artificial Sequence: Synthetic oligonucleotide
  Target: ATXN1; (-) strand; PAM type: NRG; PAM sequence: CAG
agagaaaatgggattgcctg

SEQ ID NO: 39541 - DNA, 20 bp, Artificial Sequence
  Description of Artificial Sequence: Synthetic oligonucleotide
  Target: ATXN1; (-) strand; PAM type: NRG; PAM sequence: GGG
ctgaagtttccagagaaaat

SEQ ID NO: 39542 - DNA, 20 bp, Artificial Sequence
  Description of Artificial Sequence: Synthetic oligonucleotide
  Target: ATXN1; (-) strand; PAM type: NRG; PAM sequence: TGG
actgaagtttccagagaaaa

SEQ ID NO: 39543 - DNA, 20 bp, Artificial Sequence
  Description of Artificial Sequence: Synthetic oligonucleotide
  Target: ATXN1; (-) strand; PAM type: NRG; PAM sequence: GAG
atggcgaactgaagtttcca

SEQ ID NO: 39544 - DNA, 20 bp, Artificial Sequence
  Description of Artificial Sequence: Synthetic oligonucleotide
  Target: ATXN1; (-) strand; PAM type: NRG; PAM sequence: CAG
gaatggcgaactgaagtttc

SEQ ID NO: 39545 - DNA, 20 bp, Artificial Sequence
  Description of Artificial Sequence: Synthetic oligonucleotide
  Target: ATXN1; (-) strand; PAM type: NRG; PAM sequence: AAG
tctctgagaatggcgaactg

SEQ ID NO: 39546 - DNA, 20 bp, Artificial Sequence
  Description of Artificial Sequence: Synthetic oligonucleotide
  Target: ATXN1; (-) strand; PAM type: NRG; PAM sequence: TGG
gcccagatgctctctgagaa

SEQ ID NO: 39547 - DNA, 20 bp, Artificial Sequence
  Description of Artificial Sequence: Synthetic oligonucleotide
  Target: ATXN1; (-) strand; PAM type: NRG; PAM sequence: GAG
ggagtgcccagatgctctct

SEQ ID NO: 39548 - DNA, 20 bp, Artificial Sequence
  Description of Artificial Sequence: Synthetic oligonucleotide
  Target: ATXN1; (-) strand; PAM type: NRG; PAM sequence: CAG
gaatcaaccaggggagtgcc

SEQ ID NO: 39549 - DNA, 20 bp, Artificial Sequence
  Description of Artificial Sequence: Synthetic oligonucleotide
  Target: ATXN1; (-) strand; PAM type: NRG; PAM sequence: GAG
gaaaacggaatcaaccaggg

SEQ ID NO: 39550 - DNA, 20 bp, Artificial Sequence
  Description of Artificial Sequence: Synthetic oligonucleotide
  Target: ATXN1; (-) strand; PAM type: NRG; PAM sequence: GGG
aggaaaacggaatcaaccag

SEQ ID NO: 39551 - DNA, 20 bp, Artificial Sequence
  Description of Artificial Sequence: Synthetic oligonucleotide
  Target: ATXN1; (-) strand; PAM type: NRG; PAM sequence: GGG
caggaaaacggaatcaacca

SEQ ID NO: 39552 - DNA, 20 bp, Artificial Sequence
  Description of Artificial Sequence: Synthetic oligonucleotide
  Target: ATXN1; (-) strand; PAM type: NRG; PAM sequence: AGG
gcaggaaaacggaatcaacc

SEQ ID NO: 39553 - DNA, 20 bp, Artificial Sequence
  Description of Artificial Sequence: Synthetic oligonucleotide
  Target: ATXN1; (-) strand; PAM type: NRG; PAM sequence: CAG
agcaggaaaacggaatcaac

SEQ ID NO: 39554 - DNA, 20 bp, Artificial Sequence
  Description of Artificial Sequence: Synthetic oligonucleotide
  Target: ATXN1; (-) strand; PAM type: NRG; PAM sequence: CGG
aggtatgccgagcaggaaaa

SEQ ID NO: 39555 - DNA, 20 bp, Artificial Sequence
  Description of Artificial Sequence: Synthetic oligonucleotide
  Target: ATXN1; (-) strand; PAM type: NRG; PAM sequence: AGG
cagacacaggtatgccgagc

SEQ ID NO: 39556 - DNA, 20 bp, Artificial Sequence
  Description of Artificial Sequence: Synthetic oligonucleotide
  Target: ATXN1; (-) strand; PAM type: NRG; PAM sequence: CAG
gcagacacaggtatgccgag

SEQ ID NO: 39557 - DNA, 20 bp, Artificial Sequence
  Description of Artificial Sequence: Synthetic oligonucleotide
  Target: ATXN1; (-) strand; PAM type: NRG; PAM sequence: GAG
gcagcagacacaggtatgcc

SEQ ID NO: 39558 - DNA, 20 bp, Artificial Sequence
  Description of Artificial Sequence: Synthetic oligonucleotide
  Target: ATXN1; (-) strand; PAM type: NRG; PAM sequence: AGG
gcctggcgggcagcagacac

SEQ ID NO: 39559 - DNA, 20 bp, Artificial Sequence
  Description of Artificial Sequence: Synthetic oligonucleotide
  Target: ATXN1; (-) strand; PAM type: NRG; PAM sequence: CAG
ggcctggcgggcagcagaca

SEQ ID NO: 39560 - DNA, 20 bp, Artificial Sequence
  Description of Artificial Sequence: Synthetic oligonucleotide
  Target: ATXN1; (-) strand; PAM type: NRG; PAM sequence: CAG
gccgacggcctggcgggcag

SEQ ID NO: 39561 - DNA, 20 bp, Artificial Sequence
  Description of Artificial Sequence: Synthetic oligonucleotide
  Target: ATXN1; (-) strand; PAM type: NRG; PAM sequence: CAG
aaggccgacggcctggcggg

SEQ ID NO: 39562 - DNA, 20 bp, Artificial Sequence
  Description of Artificial Sequence: Synthetic oligonucleotide
  Target: ATXN1; (-) strand; PAM type: NRG; PAM sequence: GGG
tcaaaggccgacggcctggc

SEQ ID NO: 39563 - DNA, 20 bp, Artificial Sequence
  Description of Artificial Sequence: Synthetic oligonucleotide
  Target: ATXN1; (-) strand; PAM type: NRG; PAM sequence: CGG
ctcaaaggccgacggcctgg

SEQ ID NO: 39564 - DNA, 20 bp, Artificial Sequence
  Description of Artificial Sequence: Synthetic oligonucleotide
  Target: ATXN1; (-) strand; PAM type: NRG; PAM sequence: TGG
gcactcaaaggccgacggcc

SEQ ID NO: 39565 - DNA, 20 bp, Artificial Sequence
  Description of Artificial Sequence: Synthetic oligonucleotide
  Target: ATXN1; (-) strand; PAM type: NRG; PAM sequence: CGG
ctgaagcactcaaaggccga

SEQ ID NO: 39566 - DNA, 20 bp, Artificial Sequence
  Description of Artificial Sequence: Synthetic oligonucleotide
  Target: ATXN1; (-) strand; PAM type: NRG; PAM sequence: AGG
cgtcctgctgaagcactcaa

SEQ ID NO: 39567 - DNA, 20 bp, Artificial Sequence
  Description of Artificial Sequence: Synthetic oligonucleotide
  Target: ATXN1; (-) strand; PAM type: NRG; PAM sequence: AAG
gcgtcctgctgaagcactca

SEQ ID NO: 39568 - DNA, 20 bp, Artificial Sequence
  Description of Artificial Sequence: Synthetic oligonucleotide
  Target: ATXN1; (-) strand; PAM type: NRG; PAM sequence: AAG
atcccgccagcgtcctgctg

SEQ ID NO: 39569 - DNA, 20 bp, Artificial Sequence
  Description of Artificial Sequence: Synthetic oligonucleotide
  Target: ATXN1; (-) strand; PAM type: NRG; PAM sequence: CAG
ggccagcccgtggatcccgc

SEQ ID NO: 39570 - DNA, 20 bp, Artificial Sequence
  Description of Artificial Sequence: Synthetic oligonucleotide
  Target: ATXN1; (-) strand; PAM type: NRG; PAM sequence: TGG
tgttaaaaagggccagcccg

SEQ ID NO: 39571 - DNA, 20 bp, Artificial Sequence
  Description of Artificial Sequence: Synthetic oligonucleotide
  Target: ATXN1; (-) strand; PAM type: NRG; PAM sequence: CAG
acggctctgttaaaaagggc

SEQ ID NO: 39572 - DNA, 20 bp, Artificial Sequence
  Description of Artificial Sequence: Synthetic oligonucleotide
  Target: ATXN1; (-) strand; PAM type: NRG; PAM sequence: GGG
aagaacggctctgttaaaaa

SEQ ID NO: 39573 - DNA, 20 bp, Artificial Sequence
  Description of Artificial Sequence: Synthetic oligonucleotide
  Target: ATXN1; (-) strand; PAM type: NRG; PAM sequence: AGG
gaagaacggctctgttaaaa

SEQ ID NO: 39574 - DNA, 20 bp, Artificial Sequence
  Description of Artificial Sequence: Synthetic oligonucleotide
  Target: ATXN1; (-) strand; PAM type: NRG; PAM sequence: AAG
tgaagaacggctctgttaaa

SEQ ID NO: 39575 - DNA, 20 bp, Artificial Sequence
  Description of Artificial Sequence: Synthetic oligonucleotide
  Target: ATXN1; (-) strand; PAM type: NRG; PAM sequence: CGG
accctcaagaacctgaagaa

SEQ ID NO: 39576 - DNA, 20 bp, Artificial Sequence
  Description of Artificial Sequence: Synthetic oligonucleotide
  Target: ATXN1; (-) strand; PAM type: NRG; PAM sequence: AAG
cgcttaccctcaagaacctg

SEQ ID NO: 39577 - DNA, 20 bp, Artificial Sequence
  Description of Artificial Sequence: Synthetic oligonucleotide
  Target: ATXN1; (-) strand; PAM type: NRG; PAM sequence: AAG
tctgcatctcgcttaccctc

SEQ ID NO: 39578 - DNA, 20 bp, Artificial Sequence
  Description of Artificial Sequence: Synthetic oligonucleotide
  Target: ATXN1; (-) strand; PAM type: NRG; PAM sequence: GGG
gtgttccaaactctcagttg

SEQ ID NO: 39579 - DNA, 20 bp, Artificial Sequence
  Description of Artificial Sequence: Synthetic oligonucleotide
  Target: ATXN1; (-) strand; PAM type: NRG; PAM sequence: GGG
cgtgttccaaactctcagtt

SEQ ID NO: 39580 - DNA, 20 bp, Artificial Sequence
  Description of Artificial Sequence: Synthetic oligonucleotide
  Target: ATXN1; (-) strand; PAM type: NRG; PAM sequence: TGG
ccgtgttccaaactctcagt

SEQ ID NO: 39581 - DNA, 20 bp, Artificial Sequence
  Description of Artificial Sequence: Synthetic oligonucleotide
  Target: ATXN1; (-) strand; PAM type: NRG; PAM sequence: CAG
tttgccgtgttccaaactct

SEQ ID NO: 39582 - DNA, 20 bp, Artificial Sequence
  Description of Artificial Sequence: Synthetic oligonucleotide
  Target: ATXN1; (-) strand; PAM type: NRG; PAM sequence: CAG
gctgtccggagagaaccagc

SEQ ID NO: 39583 - DNA, 20 bp, Artificial Sequence
  Description of Artificial Sequence: Synthetic oligonucleotide
  Target: ATXN1; (-) strand; PAM type: NRG; PAM sequence: CAG
tcctgctgtccggagagaac

SEQ ID NO: 39584 - DNA, 20 bp, Artificial Sequence
  Description of Artificial Sequence: Synthetic oligonucleotide
  Target: ATXN1; (-) strand; PAM type: NRG; PAM sequence: GAG
tggtcatcctgctgtccgga

SEQ ID NO: 39585 - DNA, 20 bp, Artificial Sequence
  Description of Artificial Sequence: Synthetic oligonucleotide
  Target: ATXN1; (-) strand; PAM type: NRG; PAM sequence: GAG
gctggtcatcctgctgtccg

SEQ ID NO: 39586 - DNA, 20 bp, Artificial Sequence
  Description of Artificial Sequence: Synthetic oligonucleotide
  Target: ATXN1; (-) strand; PAM type: NRG; PAM sequence: CGG
gggctggtcatcctgctgtc

SEQ ID NO: 39587 - DNA, 20 bp, Artificial Sequence
  Description of Artificial Sequence: Synthetic oligonucleotide
  Target: ATXN1; (-) strand; PAM type: NRG; PAM sequence: TGG
tttttgtgtttggacagggc

SEQ ID NO: 39588 - DNA, 20 bp, Artificial Sequence
  Description of Artificial Sequence: Synthetic oligonucleotide
  Target: ATXN1; (-) strand; PAM type: NRG; PAM sequence: GGG
cctttttttgtgtttggaca

SEQ ID NO: 39589 - DNA, 20 bp, Artificial Sequence
  Description of Artificial Sequence: Synthetic oligonucleotide
  Target: ATXN1; (-) strand; PAM type: NRG; PAM sequence: AGG
tcctttttttgtgtttggac

SEQ ID NO: 39590 - DNA, 20 bp, Artificial Sequence
  Description of Artificial Sequence: Synthetic oligonucleotide
  Target: ATXN1; (-) strand; PAM type: NRG; PAM sequence: CAG
atcctttttttgtgtttgga

SEQ ID NO: 39591 - DNA, 20 bp, Artificial Sequence
  Description of Artificial Sequence: Synthetic oligonucleotide
  Target: ATXN1; (-) strand; PAM type: NRG; PAM sequence: TGG
gagtatcctttttttgtgtt

SEQ ID NO: 39592 - DNA, 20 bp, Artificial Sequence
  Description of Artificial Sequence: Synthetic oligonucleotide
  Target: ATXN1; (-) strand; PAM type: NRG; PAM sequence: GAG
tcagcgttgaagttttggta

SEQ ID NO: 39593 - DNA, 20 bp, Artificial Sequence
  Description of Artificial Sequence: Synthetic oligonucleotide
  Target: ATXN1; (-) strand; PAM type: NRG; PAM sequence: TAG
ggtcagcgttgaagttttgg

SEQ ID NO: 39594 - DNA, 20 bp, Artificial Sequence
  Description of Artificial Sequence: Synthetic oligonucleotide
  Target: ATXN1; (-) strand; PAM type: NRG; PAM sequence: TGG
acaggtcagcgttgaagttt

SEQ ID NO: 39595 - DNA, 20 bp, Artificial Sequence
  Description of Artificial Sequence: Synthetic oligonucleotide
  Target: ATXN1; (-) strand; PAM type: NRG; PAM sequence: AAG
gtttccacaggtcagcgttg

SEQ ID NO: 39596 - DNA, 20 bp, Artificial Sequence
  Description of Artificial Sequence: Synthetic oligonucleotide
  Target: ATXN1; (-) strand; PAM type: NRG; PAM sequence: CAG
ctctccctgtttccacaggt

SEQ ID NO: 39597 - DNA, 20 bp, Artificial Sequence
  Description of Artificial Sequence: Synthetic oligonucleotide
  Target: ATXN1; (-) strand; PAM type: NRG; PAM sequence: AGG
ctgtctctccctgtttccac

SEQ ID NO: 39598 - DNA, 20 bp, Artificial Sequence
  Description of Artificial Sequence: Synthetic oligonucleotide
  Target: ATXN1; (-) strand; PAM type: NRG; PAM sequence: CAG
tctgtctctccctgtttcca

SEQ ID NO: 39599 - DNA, 20 bp, Artificial Sequence
  Description of Artificial Sequence: Synthetic oligonucleotide
  Target: ATXN1; (-) strand; PAM type: NRG; PAM sequence: AAG
gtgtgtgcataaaatcaaac

SEQ ID NO: 39600 - DNA, 20 bp, Artificial Sequence
  Description of Artificial Sequence: Synthetic oligonucleotide
  Target: ATXN1; (-) strand; PAM type: NRG; PAM sequence: GAG
cagcctgtgtgtgtctgtgt

SEQ ID NO: 39601 - DNA, 20 bp, Artificial Sequence
  Description of Artificial Sequence: Synthetic oligonucleotide
  Target: ATXN1; (-) strand; PAM type: NRG; PAM sequence: CAG
ctgagtcattttcccccatt

SEQ ID NO: 39602 - DNA, 20 bp, Artificial Sequence
  Description of Artificial Sequence: Synthetic oligonucleotide
  Target: ATXN1; (-) strand; PAM type: NRG; PAM sequence: GAG
gagagggaggtttgcaaact

SEQ ID NO: 39603 - DNA, 20 bp, Artificial Sequence
  Description of Artificial Sequence: Synthetic oligonucleotide
  Target: ATXN1; (-) strand; PAM type: NRG; PAM sequence: AGG
tgtgtggctgggggagaggg

SEQ ID NO: 39604 - DNA, 20 bp, Artificial Sequence
  Description of Artificial Sequence: Synthetic oligonucleotide
  Target: ATXN1; (-) strand; PAM type: NRG; PAM sequence: GAG
gtgtgtggctgggggagagg

SEQ ID NO: 39605 - DNA, 20 bp, Artificial Sequence
  Description of Artificial Sequence: Synthetic oligonucleotide
  Target: ATXN1; (-) strand; PAM type: NRG; PAM sequence: GGG
tagtgtgtggctgggggaga

SEQ ID NO: 39606 - DNA, 20 bp, Artificial Sequence
  Description of Artificial Sequence: Synthetic oligonucleotide
  Target: ATXN1; (-) strand; PAM type: NRG; PAM sequence: AGG
atagtgtgtggctgggggag

SEQ ID NO: 39607 - DNA, 20 bp, Artificial Sequence
  Description of Artificial Sequence: Synthetic oligonucleotide
  Target: ATXN1; (-) strand; PAM type: NRG; PAM sequence: GAG
tatagtgtgtggctggggga

SEQ ID NO: 39608 - DNA, 20 bp, Artificial Sequence
  Description of Artificial Sequence: Synthetic oligonucleotide
  Target: ATXN1; (-) strand; PAM type: NRG; PAM sequence: GAG
tttatagtgtgtggctgggg

SEQ ID NO: 39609 - DNA, 20 bp, Artificial Sequence
  Description of Artificial Sequence: Synthetic oligonucleotide
  Target: ATXN1; (-) strand; PAM type: NRG; PAM sequence: GGG
catttatagtgtgtggctgg

SEQ ID NO: 39610 - DNA, 20 bp, Artificial Sequence
  Description of Artificial Sequence: Synthetic oligonucleotide
  Target: ATXN1; (-) strand; PAM type: NRG; PAM sequence: GGG
tcatttatagtgtgtggctg

SEQ ID NO: 39611 - DNA, 20 bp, Artificial Sequence
  Description of Artificial Sequence: Synthetic oligonucleotide
  Target: ATXN1; (-) strand; PAM type: NRG; PAM sequence: GGG
ctcatttatagtgtgtggct

SEQ ID NO: 39612 - DNA, 20 bp, Artificial Sequence
  Description of Artificial Sequence: Synthetic oligonucleotide
  Target: ATXN1; (-) strand; PAM type: NRG; PAM sequence: TGG
cctcatttatagtgtgtggc

SEQ ID NO: 39613 - DNA, 20 bp, Artificial Sequence
  Description of Artificial Sequence: Synthetic oligonucleotide
  Target: ATXN1; (-) strand; PAM type: NRG; PAM sequence: TGG
agagcctcatttatagtgtg

SEQ ID NO: 39614 - DNA, 20 bp, Artificial Sequence
  Description of Artificial Sequence: Synthetic oligonucleotide
  Target: ATXN1; (-) strand; PAM type: NRG; PAM sequence: TAG
aaagagaagagcctcattta

SEQ ID NO: 39615 - DNA, 20 bp, Artificial Sequence
  Description of Artificial Sequence: Synthetic oligonucleotide
  Target: ATXN1; (-) strand; PAM type: NRG; PAM sequence: GAG
gaggtacaacccaaagagaa

SEQ ID NO: 39616 - DNA, 20 bp, Artificial Sequence
  Description of Artificial Sequence: Synthetic oligonucleotide
  Target: ATXN1; (-) strand; PAM type: NRG; PAM sequence: AAG
tagaggtacaacccaaagag

SEQ ID NO: 39617 - DNA, 20 bp, Artificial Sequence
  Description of Artificial Sequence: Synthetic oligonucleotide
  Target: ATXN1; (-) strand; PAM type: NRG; PAM sequence: GAG
aagtagaggtacaacccaaa

SEQ ID NO: 39618 - DNA, 20 bp, Artificial Sequence
  Description of Artificial Sequence: Synthetic oligonucleotide
  Target: ATXN1; (-) strand; PAM type: NRG; PAM sequence: AAG
gcaagtagaggtacaaccca

SEQ ID NO: 39619 - DNA, 20 bp, Artificial Sequence
  Description of Artificial Sequence: Synthetic oligonucleotide
  Target: ATXN1; (-) strand; PAM type: NRG; PAM sequence: AGG
cttctgcctatggcaagtag

SEQ ID NO: 39620 - DNA, 20 bp, Artificial Sequence
  Description of Artificial Sequence: Synthetic oligonucleotide
  Target: ATXN1; (-) strand; PAM type: NRG; PAM sequence: GAG
gcttctgcctatggcaagta

SEQ ID NO: 39621 - DNA, 20 bp, Artificial Sequence
  Description of Artificial Sequence: Synthetic oligonucleotide
  Target: ATXN1; (-) strand; PAM type: NRG; PAM sequence: TAG
tggcttctgcctatggcaag

SEQ ID NO: 39622 - DNA, 20 bp, Artificial Sequence
  Description of Artificial Sequence: Synthetic oligonucleotide
  Target: ATXN1; (-) strand; PAM type: NRG; PAM sequence: AAG
cactggcttctgcctatggc

SEQ ID NO: 39623 - DNA, 20 bp, Artificial Sequence
  Description of Artificial Sequence: Synthetic oligonucleotide
  Target: ATXN1; (-) strand; PAM type: NRG; PAM sequence: TGG
ttttcactggcttctgccta

SEQ ID NO: 39624 - DNA, 20 bp, Artificial Sequence
  Description of Artificial Sequence: Synthetic oligonucleotide
  Target: ATXN1; (-) strand; PAM type: NRG; PAM sequence: TGG
aatattgatgaccttttcac

SEQ ID NO: 39625 - DNA, 20 bp, Artificial Sequence
  Description of Artificial Sequence: Synthetic oligonucleotide
  Target: ATXN1; (-) strand; PAM type: NRG; PAM sequence: TGG
gctatagagctaacacttga

SEQ ID NO: 39626 - DNA, 20 bp, Artificial Sequence
  Description of Artificial Sequence: Synthetic oligonucleotide
  Target: ATXN1; (-) strand; PAM type: NRG; PAM sequence: GAG
tctaacagagaccagctata

SEQ ID NO: 39627 - DNA, 20 bp, Artificial Sequence
  Description of Artificial Sequence: Synthetic oligonucleotide
  Target: ATXN1; (-) strand; PAM type: NRG; PAM sequence: TAG
gttctaacagagaccagcta

SEQ ID NO: 39628 - DNA, 20 bp, Artificial Sequence
  Description of Artificial Sequence: Synthetic oligonucleotide
  Target: ATXN1; (-) strand; PAM type: NRG; PAM sequence: CAG
tgactggttctaacagagac

SEQ ID NO: 39629 - DNA, 20 bp, Artificial Sequence
  Description of Artificial Sequence: Synthetic oligonucleotide
  Target: ATXN1; (-) strand; PAM type: NRG; PAM sequence: GAG
tcgattgactggttctaaca

SEQ ID NO: 39630 - DNA, 20 bp, Artificial Sequence
  Description of Artificial Sequence: Synthetic oligonucleotide
  Target: ATXN1; (-) strand; PAM type: NRG; PAM sequence: CAG
gttcgattgactggttctaa

SEQ ID NO: 39631 - DNA, 20 bp, Artificial Sequence
  Description of Artificial Sequence: Synthetic oligonucleotide
  Target: ATXN1; (-) strand; PAM type: NRG; PAM sequence: TGG
attactggggttcgattgac

SEQ ID NO: 39632 - DNA, 20 bp, Artificial Sequence
  Description of Artificial Sequence: Synthetic oligonucleotide
  Target: ATXN1; (-) strand; PAM type: NRG; PAM sequence: GGG
tgggtgctctgtcattactg

SEQ ID NO: 39633 - DNA, 20 bp, Artificial Sequence
  Description of Artificial Sequence: Synthetic oligonucleotide
  Target: ATXN1; (-) strand; PAM type: NRG; PAM sequence: GGG
gtgggtgctctgtcattact

SEQ ID NO: 39634 - DNA, 20 bp, Artificial Sequence
  Description of Artificial Sequence: Synthetic oligonucleotide
  Target: ATXN1; (-) strand; PAM type: NRG; PAM sequence: TGG
agtgggtgctctgtcattac

SEQ ID NO: 39635 - DNA, 20 bp, Artificial Sequence
  Description of Artificial Sequence: Synthetic oligonucleotide
  Target: ATXN1; (-) strand; PAM type: NRG; PAM sequence: GGG
cttggtgctgaaagctaagt

SEQ ID NO: 39636 - DNA, 20 bp, Artificial Sequence
  Description of Artificial Sequence: Synthetic oligonucleotide
  Target: ATXN1; (-) strand; PAM type: NRG; PAM sequence: TGG
gcttggtgctgaaagctaag

SEQ ID NO: 39637 - DNA, 20 bp, Artificial Sequence
  Description of Artificial Sequence: Synthetic oligonucleotide
  Target: ATXN1; (-) strand; PAM type: NRG; PAM sequence: AAG
ctagcttggtgctgaaagct

SEQ ID NO: 39638 - DNA, 20 bp, Artificial Sequence
  Description of Artificial Sequence: Synthetic oligonucleotide
  Target: ATXN1; (-) strand; PAM type: NRG; PAM sequence: AAG
agagcctagcttggtgctga

SEQ ID NO: 39639 - DNA, 20 bp, Artificial Sequence
  Description of Artificial Sequence: Synthetic oligonucleotide
  Target: ATXN1; (-) strand; PAM type: NRG; PAM sequence: TGG
gccacctgcagagcctagct

SEQ ID NO: 39640 - DNA, 20 bp, Artificial Sequence
  Description of Artificial Sequence: Synthetic oligonucleotide
  Target: ATXN1; (-) strand; PAM type: NRG; PAM sequence: TAG
tgtgagccacctgcagagcc

SEQ ID NO: 39641 - DNA, 20 bp, Artificial Sequence
  Description of Artificial Sequence: Synthetic oligonucleotide
  Target: ATXN1; (-) strand; PAM type: NRG; PAM sequence: GAG
gggcttgtgagccacctgca

SEQ ID NO: 39642 - DNA, 20 bp, Artificial Sequence
  Description of Artificial Sequence: Synthetic oligonucleotide
  Target: ATXN1; (-) strand; PAM type: NRG; PAM sequence: CAG
ctgggcttgtgagccacctg

SEQ ID NO: 39643 - DNA, 20 bp, Artificial Sequence
  Description of Artificial Sequence: Synthetic oligonucleotide
  Target: ATXN1; (-) strand; PAM type: NRG; PAM sequence: GAG
taagaccgcgctgggcttgt

SEQ ID NO: 39644 - DNA, 20 bp, Artificial Sequence
  Description of Artificial Sequence: Synthetic oligonucleotide
  Target: ATXN1; (-) strand; PAM type: NRG; PAM sequence: GGG
ataaaatctaagaccgcgct

SEQ ID NO: 39645 - DNA, 20 bp, Artificial Sequence
  Description of Artificial Sequence: Synthetic oligonucleotide
  Target: ATXN1; (-) strand; PAM type: NRG; PAM sequence: TGG
cataaaatctaagaccgcgc

SEQ ID NO: 39646 - DNA, 20 bp, Artificial Sequence
  Description of Artificial Sequence: Synthetic oligonucleotide
  Target: ATXN1; (-) strand; PAM type: NRG; PAM sequence: AAG
ccattgagctcataaaatct

SEQ ID NO: 39647 - DNA, 20 bp, Artificial Sequence
  Description of Artificial Sequence: Synthetic oligonucleotide
  Target: ATXN1; (-) strand; PAM type: NRG; PAM sequence: GAG
gataatagcagttgtccatt

SEQ ID NO: 39648 - DNA, 20 bp, Artificial Sequence
  Description of Artificial Sequence: Synthetic oligonucleotide
  Target: ATXN1; (-) strand; PAM type: NRG; PAM sequence: CAG
cctgtcctgtatgataatag

SEQ ID NO: 39649 - DNA, 20 bp, Artificial Sequence
  Description of Artificial Sequence: Synthetic oligonucleotide
  Target: ATXN1; (-) strand; PAM type: NRG; PAM sequence: TAG
agtcctgtcctgtatgataa

SEQ ID NO: 39650 - DNA, 20 bp, Artificial Sequence
  Description of Artificial Sequence: Synthetic oligonucleotide
  Target: ATXN1; (-) strand; PAM type: NRG; PAM sequence: TAG
gtctcactctgatccatgtt

SEQ ID NO: 39651 - DNA, 20 bp, Artificial Sequence
  Description of Artificial Sequence: Synthetic oligonucleotide
  Target: ATXN1; (-) strand; PAM type: NRG; PAM sequence: CAG
tgcctgcttcttggaactca

SEQ ID NO: 39652 - DNA, 20 bp, Artificial Sequence
  Description of Artificial Sequence: Synthetic oligonucleotide
  Target: ATXN1; (-) strand; PAM type: NRG; PAM sequence: TGG
aacacactgtgcctgcttct

SEQ ID NO: 39653 - DNA, 20 bp, Artificial Sequence
  Description of Artificial Sequence: Synthetic oligonucleotide
  Target: ATXN1; (-) strand; PAM type: NRG; PAM sequence: CAG
ccttttaggggctggggact

SEQ ID NO: 39654 - DNA, 20 bp, Artificial Sequence
  Description of Artificial Sequence: Synthetic oligonucleotide
  Target: ATXN1; (-) strand; PAM type: NRG; PAM sequence: GGG
aagcatccttttaggggctg

SEQ ID NO: 39655 - DNA, 20 bp, Artificial Sequence
  Description of Artificial Sequence: Synthetic oligonucleotide
  Target: ATXN1; (-) strand; PAM type: NRG; PAM sequence: GGG
caagcatccttttaggggct

SEQ ID NO: 39656 - DNA, 20 bp, Artificial Sequence
  Description of Artificial Sequence: Synthetic oligonucleotide
  Target: ATXN1; (-) strand; PAM type: NRG; PAM sequence: TGG
ccaagcatccttttaggggc

SEQ ID NO: 39657 - DNA, 20 bp, Artificial Sequence
  Description of Artificial Sequence: Synthetic oligonucleotide
  Target: ATXN1; (-) strand; PAM type: NRG; PAM sequence: GGG
gccaccaagcatccttttag

SEQ ID NO: 39658 - DNA, 20 bp, Artificial Sequence
  Description of Artificial Sequence: Synthetic oligonucleotide
  Target: ATXN1; (-) strand; PAM type: NRG; PAM sequence: GGG
agccaccaagcatcctttta

SEQ ID NO: 39659 - DNA, 20 bp, Artificial Sequence
  Description of Artificial Sequence: Synthetic oligonucleotide
  Target: ATXN1; (-) strand; PAM type: NRG; PAM sequence: AGG
cagccaccaagcatcctttt

SEQ ID NO: 39660 - DNA, 20 bp, Artificial Sequence
  Description of Artificial Sequence: Synthetic oligonucleotide
  Target: ATXN1; (-) strand; PAM type: NRG; PAM sequence: TAG
ccagccaccaagcatccttt

SEQ ID NO: 39661 - DNA, 20 bp, Artificial Sequence
  Description of Artificial Sequence: Synthetic oligonucleotide
  Target: ATXN1; (-) strand; PAM type: NRG; PAM sequence: AAG
agccactgtgcccagccacc

SEQ ID NO: 39662 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccactgtgcc

SEQ ID NO: 39663 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 39664 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 39665 - DNA, 20 bp, Artificial Sequence
  Description of Artificial Sequence: Synthetic oligonucleotide
  Target: ATXN1; (-) strand; PAM type: NRG; PAM sequence: CAG
gtcccaaagtgctgggatta

SEQ ID NO: 39666 - DNA, 20 bp, Artificial Sequence
  Description of Artificial Sequence: Synthetic oligonucleotide
  Target: ATXN1; (-) strand; PAM type: NRG; PAM sequence: GGG
ccttggtgtcccaaagtgct

SEQ ID NO: 39667 - DNA, 20 bp, Artificial Sequence
  Description of Artificial Sequence: Synthetic oligonucleotide
  Target: ATXN1; (-) strand; PAM type: NRG; PAM sequence: TGG
accttggtgtcccaaagtgc

SEQ ID NO: 39668 - DNA, 20 bp, Artificial Sequence
  Description of Artificial Sequence: Synthetic oligonucleotide
  Target: ATXN1; (-) strand; PAM type: NRG; PAM sequence: AAG
ccacccaccttggtgtccca

SEQ ID NO: 39669 - DNA, 20 bp, Artificial Sequence
  Description of Artificial Sequence: Synthetic oligonucleotide
  Target: ATXN1; (-) strand; PAM type: NRG; PAM sequence: TGG
ctcaaatgatccacccacct

SEQ ID NO: 39670 - DNA, 20 bp, Artificial Sequence
  Description of Artificial Sequence: Synthetic oligonucleotide
  Target: ATXN1; (-) strand; PAM type: NRG; PAM sequence: TGG
tttccccatgttggccaggc

SEQ ID NO: 39671 - DNA, 20 bp, Artificial Sequence
  Description of Artificial Sequence: Synthetic oligonucleotide
  Target: ATXN1; (-) strand; PAM type: NRG; PAM sequence: AGG
ggggtttccccatgttggcc

SEQ ID NO: 39672 - DNA, 20 bp, Artificial Sequence
  Description of Artificial Sequence: Synthetic oligonucleotide
  Target: ATXN1; (-) strand; PAM type: NRG; PAM sequence: CAG
cggggtttccccatgttggc

SEQ ID NO: 39673 - DNA, 20 bp, Artificial Sequence
  Description of Artificial Sequence: Synthetic oligonucleotide
  Target: ATXN1; (-) strand; PAM type: NRG; PAM sequence: TGG
gagacggggtttccccatgt

SEQ ID NO: 39674 - DNA, 20 bp, Artificial Sequence
  Description of Artificial Sequence: Synthetic oligonucleotide
  Target: ATXN1; (-) strand; PAM type: NRG; PAM sequence: GGG
ttttatttttagtggagacg

SEQ ID NO: 39675 - DNA, 20 bp, Artificial Sequence
  Description of Artificial Sequence: Synthetic oligonucleotide
  Target: ATXN1; (-) strand; PAM type: NRG; PAM sequence: GGG
tttttatttttagtggagac

SEQ ID NO: 39676 - DNA, 20 bp, Artificial Sequence
  Description of Artificial Sequence: Synthetic oligonucleotide
  Target: ATXN1; (-) strand; PAM type: NRG; PAM sequence: CGG
ttttttatttttagtggaga

SEQ ID NO: 39677 - DNA, 20 bp, Artificial Sequence
  Description of Artificial Sequence: Synthetic oligonucleotide
  Target: ATXN1; (-) strand; PAM type: NRG; PAM sequence: GAG
ttttttttttatttttagtg

SEQ ID NO: 39678 - DNA, 20 bp, Artificial Sequence
  Description of Artificial Sequence: Synthetic oligonucleotide
  Target: ATXN1; (-) strand; PAM type: NRG; PAM sequence: TGG
ttttttttttttatttttag

SEQ ID NO: 39679 - DNA, 20 bp, Artificial Sequence
  Description of Artificial Sequence: Synthetic oligonucleotide
  Target: ATXN1; (-) strand; PAM type: NRG; PAM sequence: TAG
taattttttttttttatttt

SEQ ID NO: 39680 - DNA, 20 bp, Artificial Sequence
  Description of Artificial Sequence: Synthetic oligonucleotide
  Target: ATXN1; (-) strand; PAM type: NRG; PAM sequence: TGG
caggtgcccgccaccacgca

SEQ ID NO: 39681 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 39682 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 39683 - DNA, 20 bp, Artificial Sequence
  Description of Artificial Sequence: Synthetic oligonucleotide
  Target: ATXN1; (-) strand; PAM type: NRG; PAM sequence: GGG
tttcagcctcccaagtagct

SEQ ID NO: 39684 - DNA, 20 bp, Artificial Sequence
  Description of Artificial Sequence: Synthetic oligonucleotide
  Target: ATXN1; (-) strand; PAM type: NRG; PAM sequence: TGG
gtttcagcctcccaagtagc

SEQ ID NO: 39685 - DNA, 20 bp, Artificial Sequence
  Description of Artificial Sequence: Synthetic oligonucleotide
  Target: ATXN1; (-) strand; PAM type: NRG; PAM sequence: TAG
tagtgtttcagcctcccaag

SEQ ID NO: 39686 - DNA, 20 bp, Artificial Sequence
  Description of Artificial Sequence: Synthetic oligonucleotide
  Target: ATXN1; (-) strand; PAM type: NRG; PAM sequence: AAG
ttctagtgtttcagcctccc

SEQ ID NO: 39687 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctagtgttt

SEQ ID NO: 39688 - DNA, 20 bp, Artificial Sequence
  Description of Artificial Sequence: Synthetic oligonucleotide
  Target: ATXN1; (-) strand; PAM type: NRG; PAM sequence: TAG
ctcctgggttcaagtgattc

SEQ ID NO: 39689 - DNA, 20 bp, Artificial Sequence
  Description of Artificial Sequence: Synthetic oligonucleotide
  Target: ATXN1; (-) strand; PAM type: NRG; PAM sequence: AAG
aacatctgcctcctgggttc

SEQ ID NO: 39690 - DNA, 20 bp, Artificial Sequence
  Description of Artificial Sequence: Synthetic oligonucleotide
  Target: ATXN1; (-) strand; PAM type: NRG; PAM sequence: GGG
cgctgcaacatctgcctcct

SEQ ID NO: 39691 - DNA, 20 bp, Artificial Sequence
  Description of Artificial Sequence: Synthetic oligonucleotide
  Target: ATXN1; (-) strand; PAM type: NRG; PAM sequence: TGG
tcgctgcaacatctgcctcc

SEQ ID NO: 39692 - DNA, 20 bp, Artificial Sequence
  Description of Artificial Sequence: Synthetic oligonucleotide
  Target: ATXN1; (-) strand; PAM type: NRG; PAM sequence: CGG
atcgcccagtggcacgatct

SEQ ID NO: 39693 - DNA, 20 bp, Artificial Sequence
  Description of Artificial Sequence: Synthetic oligonucleotide
  Target: ATXN1; (-) strand; PAM type: NRG; PAM sequence: TGG
gcccaggctggatcgcccag

SEQ ID NO: 39694 - DNA, 20 bp, Artificial Sequence
  Description of Artificial Sequence: Synthetic oligonucleotide
  Target: ATXN1; (-) strand; PAM type: NRG; PAM sequence: CAG
gtggcccaggctggatcgcc

SEQ ID NO: 39695 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtggcccaggc

SEQ ID NO: 39696 - DNA, 20 bp, Artificial Sequence
  Description of Artificial Sequence: Synthetic oligonucleotide
  Target: ATXN1; (-) strand; PAM type: NRG; PAM sequence: AGG
ggagtctcactctgtggccc

SEQ ID NO: 39697 - DNA, 20 bp, Artificial Sequence
  Description of Artificial Sequence: Synthetic oligonucleotide
  Target: ATXN1; (-) strand; PAM type: NRG; PAM sequence: CAG
cggagtctcactctgtggcc

SEQ ID NO: 39698 - DNA, 20 bp, Artificial Sequence
  Description of Artificial Sequence: Synthetic oligonucleotide
  Target: ATXN1; (-) strand; PAM type: NRG; PAM sequence: TGG
tgagacggagtctcactctg

SEQ ID NO: 39699 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagacg

SEQ ID NO: 39700 - DNA, 20 bp, Artificial Sequence
  Description of Artificial Sequence: Synthetic oligonucleotide
  Target: ATXN1; (-) strand; PAM type: NRG; PAM sequence: CGG
ttttttttttttttttgaga

SEQ ID NO: 39701 - DNA, 20 bp, Artificial Sequence
  Description of Artificial Sequence: Synthetic oligonucleotide
  Target: ATXN1; (-) strand; PAM type: NRG; PAM sequence: GAG
gacttttttttttttttttt

SEQ ID NO: 39702 - DNA, 20 bp, Artificial Sequence
  Description of Artificial Sequence: Synthetic oligonucleotide
  Target: ATXN1; (-) strand; PAM type: NRG; PAM sequence: TGG
actacatctagaaaggacat

SEQ ID NO: 39703 - DNA, 20 bp, Artificial Sequence
  Description of Artificial Sequence: Synthetic oligonucleotide
  Target: ATXN1; (-) strand; PAM type: NRG; PAM sequence: AGG
ctagtctactacatctagaa

SEQ ID NO: 39704 - DNA, 20 bp, Artificial Sequence
  Description of Artificial Sequence: Synthetic oligonucleotide
  Target: ATXN1; (-) strand; PAM type: NRG; PAM sequence: AAG
cctagtctactacatctaga

SEQ ID NO: 39705 - DNA, 20 bp, Artificial Sequence
  Description of Artificial Sequence: Synthetic oligonucleotide
  Target: ATXN1; (-) strand; PAM type: NRG; PAM sequence: TAG
attacctagtctactacatc

SEQ ID NO: 39706 - DNA, 20 bp, Artificial Sequence
  Description of Artificial Sequence: Synthetic oligonucleotide
  Target: ATXN1; (-) strand; PAM type: NRG; PAM sequence: TAG
gagggttggtccaaattacc

SEQ ID NO: 39707 - DNA, 20 bp, Artificial Sequence
  Description of Artificial Sequence: Synthetic oligonucleotide
  Target: ATXN1; (-) strand; PAM type: NRG; PAM sequence: TGG
gttgtcctcagaaggagggt

SEQ ID NO: 39708 - DNA, 20 bp, Artificial Sequence
  Description of Artificial Sequence: Synthetic oligonucleotide
  Target: ATXN1; (-) strand; PAM type: NRG; PAM sequence: GGG
tttagttgtcctcagaagga

SEQ ID NO: 39709 - DNA, 20 bp, Artificial Sequence
  Description of Artificial Sequence: Synthetic oligonucleotide
  Target: ATXN1; (-) strand; PAM type: NRG; PAM sequence: AGG
ttttagttgtcctcagaagg

SEQ ID NO: 39710 - DNA, 20 bp, Artificial Sequence
  Description of Artificial Sequence: Synthetic oligonucleotide
  Target: ATXN1; (-) strand; PAM type: NRG; PAM sequence: GAG
tttttagttgtcctcagaag

SEQ ID NO: 39711 - DNA, 20 bp, Artificial Sequence
  Description of Artificial Sequence: Synthetic oligonucleotide
  Target: ATXN1; (-) strand; PAM type: NRG; PAM sequence: AGG
agtttttagttgtcctcaga

SEQ ID NO: 39712 - DNA, 20 bp, Artificial Sequence
  Description of Artificial Sequence: Synthetic oligonucleotide
  Target: ATXN1; (-) strand; PAM type: NRG; PAM sequence: AAG
gagtttttagttgtcctcag

SEQ ID NO: 39713 - DNA, 20 bp, Artificial Sequence
  Description of Artificial Sequence: Synthetic oligonucleotide
  Target: ATXN1; (-) strand; PAM type: NRG; PAM sequence: CAG
tcagagtttttagttgtcct

SEQ ID NO: 39714 - DNA, 20 bp, Artificial Sequence
  Description of Artificial Sequence: Synthetic oligonucleotide
  Target: ATXN1; (-) strand; PAM type: NRG; PAM sequence: TAG
atatttttgttcagagtttt

SEQ ID NO: 39715 - DNA, 20 bp, Artificial Sequence
  Description of Artificial Sequence: Synthetic oligonucleotide
  Target: ATXN1; (-) strand; PAM type: NRG; PAM sequence: GAG
tttgcttatatttttgttca

SEQ ID NO: 39716 - DNA, 20 bp, Artificial Sequence
  Description of Artificial Sequence: Synthetic oligonucleotide
  Target: ATXN1; (-) strand; PAM type: NRG; PAM sequence: CAG
tgtttgcttatatttttgtt

SEQ ID NO: 39717 - DNA, 20 bp, Artificial Sequence
  Description of Artificial Sequence: Synthetic oligonucleotide
  Target: ATXN1; (-) strand; PAM type: NRG; PAM sequence: GAG
aagtttaaacattttgtcca

SEQ ID NO: 39718 - DNA, 20 bp, Artificial Sequence
  Description of Artificial Sequence: Synthetic oligonucleotide
  Target: ATXN1; (-) strand; PAM type: NRG; PAM sequence: CAG
aaaagtttaaacattttgtc

SEQ ID NO: 39719 - DNA, 20 bp, Artificial Sequence
  Description of Artificial Sequence: Synthetic oligonucleotide
  Target: ATXN1; (-) strand; PAM type: NRG; PAM sequence: AAG
gtccagtactataagaaaaa

SEQ ID NO: 39720 - DNA, 20 bp, Artificial Sequence
  Description of Artificial Sequence: Synthetic oligonucleotide
  Target: ATXN1; (-) strand; PAM type: NRG; PAM sequence: AAG
tatttgctgtccagtactat

SEQ ID NO: 39721 - DNA, 20 bp, Artificial Sequence
  Description of Artificial Sequence: Synthetic oligonucleotide
  Target: ATXN1; (-) strand; PAM type: NRG; PAM sequence: CAG
ttactatcttatttgctgtc

SEQ ID NO: 39722 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccaccgcgcc

SEQ ID NO: 39723 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 39724 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 39725 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 39726 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 39727 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgc

SEQ ID NO: 39728 - DNA, 20 bp, Artificial Sequence
  Description of Artificial Sequence: Synthetic oligonucleotide
  Target: ATXN1; (-) strand; PAM type: NRG; PAM sequence: AAG
ccacgcgccttggcctccca

SEQ ID NO: 39729 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgatccacgcgcct

SEQ ID NO: 39730 - DNA, 20 bp, Artificial Sequence
  Description of Artificial Sequence: Synthetic oligonucleotide
  Target: ATXN1; (-) strand; PAM type: NRG; PAM sequence: AGG
ggtctcaaactcctgacctc

SEQ ID NO: 39731 - DNA, 20 bp, Artificial Sequence
  Description of Artificial Sequence: Synthetic oligonucleotide
  Target: ATXN1; (-) strand; PAM type: NRG; PAM sequence: CAG
tggtctcaaactcctgacct

SEQ ID NO: 39732 - DNA, 20 bp, Artificial Sequence
  Description of Artificial Sequence: Synthetic oligonucleotide
  Target: ATXN1; (-) strand; PAM type: NRG; PAM sequence: TGG
ttttgccatggtagccaggc

SEQ ID NO: 39733 - DNA, 20 bp, Artificial Sequence
  Description of Artificial Sequence: Synthetic oligonucleotide
  Target: ATXN1; (-) strand; PAM type: NRG; PAM sequence: AGG
ggggttttgccatggtagcc

SEQ ID NO: 39734 - DNA, 20 bp, Artificial Sequence
  Description of Artificial Sequence: Synthetic oligonucleotide
  Target: ATXN1; (-) strand; PAM type: NRG; PAM sequence: CAG
tggggttttgccatggtagc

SEQ ID NO: 39735 - DNA, 20 bp, Artificial Sequence
  Description of Artificial Sequence: Synthetic oligonucleotide
  Target: ATXN1; (-) strand; PAM type: NRG; PAM sequence: TAG
gagatggggttttgccatgg

SEQ ID NO: 39736 - DNA, 20 bp, Artificial Sequence
  Description of Artificial Sequence: Synthetic oligonucleotide
  Target: ATXN1; (-) strand; PAM type: NRG; PAM sequence: TGG
gtagagatggggttttgcca

SEQ ID NO: 39737 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 39738 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 39739 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 39740 - DNA, 20 bp, Artificial Sequence
  Description of Artificial Sequence: Synthetic oligonucleotide
  Target: ATXN1; (-) strand; PAM type: NRG; PAM sequence: GAG
taagttttgtatttttagta

SEQ ID NO: 39741 - DNA, 20 bp, Artificial Sequence
  Description of Artificial Sequence: Synthetic oligonucleotide
  Target: ATXN1; (-) strand; PAM type: NRG; PAM sequence: TAG
gctaagttttgtatttttag

SEQ ID NO: 39742 - DNA, 20 bp, Artificial Sequence
  Description of Artificial Sequence: Synthetic oligonucleotide
  Target: ATXN1; (-) strand; PAM type: NRG; PAM sequence: TAG
ctggctaagttttgtatttt

SEQ ID NO: 39743 - DNA, 20 bp, Artificial Sequence
  Description of Artificial Sequence: Synthetic oligonucleotide
  Target: ATXN1; (-) strand; PAM type: NRG; PAM sequence: AAG
gcccaccaccacacctggct

SEQ ID NO: 39744 - DNA, 20 bp, Artificial Sequence
  Description of Artificial Sequence: Synthetic oligonucleotide
  Target: ATXN1; (-) strand; PAM type: NRG; PAM sequence: TGG
taggggcccaccaccacacc

SEQ ID NO: 39745 - DNA, 20 bp, Artificial Sequence
  Description of Artificial Sequence: Synthetic oligonucleotide
  Target: ATXN1; (-) strand; PAM type: NRG; PAM sequence: GGG
ctgagtagctgggattatag

SEQ ID NO: 39746 - DNA, 20 bp, Artificial Sequence
  Description of Artificial Sequence: Synthetic oligonucleotide
  Target: ATXN1; (-) strand; PAM type: NRG; PAM sequence: GGG
cctgagtagctgggattata

SEQ ID NO: 39747 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggattat

SEQ ID NO: 39748 - DNA, 20 bp, Artificial Sequence
  Description of Artificial Sequence: Synthetic oligonucleotide
  Target: ATXN1; (-) strand; PAM type: NRG; PAM sequence: TAG
ctcctgagtagctgggatta

SEQ ID NO: 39749 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagct

SEQ ID NO: 39750 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtagc

SEQ ID NO: 39751 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 39752 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcct

SEQ ID NO: 39753 - DNA, 20 bp, Artificial Sequence
  Description of Artificial Sequence: Synthetic oligonucleotide
  Target: ATXN1; (-) strand; PAM type: NRG; PAM sequence: CAG
ctcaaacgattctcctgcct

SEQ ID NO: 39754 - DNA, 20 bp, Artificial Sequence
  Description of Artificial Sequence: Synthetic oligonucleotide
  Target: ATXN1; (-) strand; PAM type: NRG; PAM sequence: CGG
tcactgcaaccttcgtcccc

SEQ ID NO: 39755 - DNA, 20 bp, Artificial Sequence
  Description of Artificial Sequence: Synthetic oligonucleotide
  Target: ATXN1; (-) strand; PAM type: NRG; PAM sequence: TGG
agagtaaagtggcacgatct

SEQ ID NO: 39756 - DNA, 20 bp, Artificial Sequence
  Description of Artificial Sequence: Synthetic oligonucleotide
  Target: ATXN1; (-) strand; PAM type: NRG; PAM sequence: TGG
aggctggtctcagagtaaag

SEQ ID NO: 39757 - DNA, 20 bp, Artificial Sequence
  Description of Artificial Sequence: Synthetic oligonucleotide
  Target: ATXN1; (-) strand; PAM type: NRG; PAM sequence: AAG
gccaggctggtctcagagta

SEQ ID NO: 39758 - DNA, 20 bp, Artificial Sequence
  Description of Artificial Sequence: Synthetic oligonucleotide
  Target: ATXN1; (-) strand; PAM type: NRG; PAM sequence: GAG
tgctggccaggctggtctca

SEQ ID NO: 39759 - DNA, 20 bp, Artificial Sequence
  Description of Artificial Sequence: Synthetic oligonucleotide
  Target: ATXN1; (-) strand; PAM type: NRG; PAM sequence: CAG
catgctggccaggctggtct

SEQ ID NO: 39760 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgctggccaggc

SEQ ID NO: 39761 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccatgctggcc

SEQ ID NO: 39762 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccatgctggc

SEQ ID NO: 39763 - DNA, 20 bp, Artificial Sequence
  Description of Artificial Sequence: Synthetic oligonucleotide
  Target: ATXN1; (-) strand; PAM type: NRG; PAM sequence: TGG
gggacagggtttcaccatgc

SEQ ID NO: 39764 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagggaca

SEQ ID NO: 39765 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagggac

SEQ ID NO: 39766 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtaggga

SEQ ID NO: 39767 - DNA, 20 bp, Artificial Sequence
  Description of Artificial Sequence: Synthetic oligonucleotide
  Target: ATXN1; (-) strand; PAM type: NRG; PAM sequence: GGG
taatttttgtatttttagta

SEQ ID NO: 39768 - DNA, 20 bp, Artificial Sequence
  Description of Artificial Sequence: Synthetic oligonucleotide
  Target: ATXN1; (-) strand; PAM type: NRG; PAM sequence: AGG
ctaatttttgtatttttagt

SEQ ID NO: 39769 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 39770 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttttgtatttt

SEQ ID NO: 39771 - DNA, 20 bp, Artificial Sequence
  Description of Artificial Sequence: Synthetic oligonucleotide
  Target: ATXN1; (-) strand; PAM type: NRG; PAM sequence: TGG
taggcgcctgccaccacacc

SEQ ID NO: 39772 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggattat

SEQ ID NO: 39773 - DNA, 20 bp, Artificial Sequence
  Description of Artificial Sequence: Synthetic oligonucleotide
  Target: ATXN1; (-) strand; PAM type: NRG; PAM sequence: TAG
ctcctgagtagctgggatta

SEQ ID NO: 39774 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagct

SEQ ID NO: 39775 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtagc

SEQ ID NO: 39776 - DNA, 20 bp, Artificial Sequence
  Description of Artificial Sequence: Synthetic oligonucleotide
  Target: ATXN1; (-) strand; PAM type: NRG; PAM sequence: TAG
tcttgcctcagcctcctgag

SEQ ID NO: 39777 - DNA, 20 bp, Artificial Sequence
  Description of Artificial Sequence: Synthetic oligonucleotide
  Target: ATXN1; (-) strand; PAM type: NRG; PAM sequence: GAG
ttctcttgcctcagcctcct

SEQ ID NO: 39778 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcttgcct

SEQ ID NO: 39779 - DNA, 20 bp, Artificial Sequence
  Description of Artificial Sequence: Synthetic oligonucleotide
  Target: ATXN1; (-) strand; PAM type: NRG; PAM sequence: AAG
agcctccgcctcccgggttc

SEQ ID NO: 39780 - DNA, 20 bp, Artificial Sequence
  Description of Artificial Sequence: Synthetic oligonucleotide
  Target: ATXN1; (-) strand; PAM type: NRG; PAM sequence: GGG
cactgcagcctccgcctccc

SEQ ID NO: 39781 - DNA, 20 bp, Artificial Sequence
  Description of Artificial Sequence: Synthetic oligonucleotide
  Target: ATXN1; (-) strand; PAM type: NRG; PAM sequence: CGG
tcactgcagcctccgcctcc

SEQ ID NO: 39782 - DNA, 20 bp, Artificial Sequence
  Description of Artificial Sequence: Synthetic oligonucleotide
  Target: ATXN1; (-) strand; PAM type: NRG; PAM sequence: CAG
ggcatgatctcggttcactg

SEQ ID NO: 39783 - DNA, 20 bp, Artificial Sequence
  Description of Artificial Sequence: Synthetic oligonucleotide
  Target: ATXN1; (-) strand; PAM type: NRG; PAM sequence: CGG
ggagtgaagtggcatgatct

SEQ ID NO: 39784 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgaag

SEQ ID NO: 39785 - DNA, 20 bp, Artificial Sequence
  Description of Artificial Sequence: Synthetic oligonucleotide
  Target: ATXN1; (-) strand; PAM type: NRG; PAM sequence: AAG
ctgtcgcccaggctggagtg

SEQ ID NO: 39786 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcgcccaggctg

SEQ ID NO: 39787 - DNA, 20 bp, Artificial Sequence
  Description of Artificial Sequence: Synthetic oligonucleotide
  Target: ATXN1; (-) strand; PAM type: NRG; PAM sequence: TGG
tttcactctgtcgcccaggc

SEQ ID NO: 39788 - DNA, 20 bp, Artificial Sequence
  Description of Artificial Sequence: Synthetic oligonucleotide
  Target: ATXN1; (-) strand; PAM type: NRG; PAM sequence: AGG
ggagtttcactctgtcgccc

SEQ ID NO: 39789 - DNA, 20 bp, Artificial Sequence
  Description of Artificial Sequence: Synthetic oligonucleotide
  Target: ATXN1; (-) strand; PAM type: NRG; PAM sequence: CAG
cggagtttcactctgtcgcc

SEQ ID NO: 39790 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtgtgtgacg

SEQ ID NO: 39791 - DNA, 20 bp, Artificial Sequence
  Description of Artificial Sequence: Synthetic oligonucleotide
  Target: ATXN1; (-) strand; PAM type: NRG; PAM sequence: CGG
gtgtgtgtgtgtgtgtgtga

SEQ ID NO: 39792 - DNA, 20 bp, Artificial Sequence
  Description of Artificial Sequence: Synthetic oligonucleotide
  Target: ATXN1; (-) strand; PAM type: NRG; PAM sequence: AAG
ttttcctgatccaacccagg

SEQ ID NO: 39793 - DNA, 20 bp, Artificial Sequence
  Description of Artificial Sequence: Synthetic oligonucleotide
  Target: ATXN1; (-) strand; PAM type: NRG; PAM sequence: AGG
atcttttcctgatccaaccc

SEQ ID NO: 39794 - DNA, 20 bp, Artificial Sequence
  Description of Artificial Sequence: Synthetic oligonucleotide
  Target: ATXN1; (-) strand; PAM type: NRG; PAM sequence: CAG
catcttttcctgatccaacc

SEQ ID NO: 39795 - DNA, 20 bp, Artificial Sequence
  Description of Artificial Sequence: Synthetic oligonucleotide
  Target: ATXN1; (-) strand; PAM type: NRG; PAM sequence: GGG
aacaccagcttcacctctct

SEQ ID NO: 39796 - DNA, 20 bp, Artificial Sequence
  Description of Artificial Sequence: Synthetic oligonucleotide
  Target: ATXN1; (-) strand; PAM type: NRG; PAM sequence: TGG
caacaccagcttcacctctc

SEQ ID NO: 39797 - DNA, 20 bp, Artificial Sequence
  Description of Artificial Sequence: Synthetic oligonucleotide
  Target: ATXN1; (-) strand; PAM type: NRG; PAM sequence: CAG
agaaaacaggcccccaacac

SEQ ID NO: 39798 - DNA, 20 bp, Artificial Sequence
  Description of Artificial Sequence: Synthetic oligonucleotide
  Target: ATXN1; (-) strand; PAM type: NRG; PAM sequence: AGG
aagtgccttcaggagaaaac

SEQ ID NO: 39799 - DNA, 20 bp, Artificial Sequence
  Description of Artificial Sequence: Synthetic oligonucleotide
  Target: ATXN1; (-) strand; PAM type: NRG; PAM sequence: CAG
caagtgccttcaggagaaaa

SEQ ID NO: 39800 - DNA, 20 bp, Artificial Sequence
  Description of Artificial Sequence: Synthetic oligonucleotide
  Target: ATXN1; (-) strand; PAM type: NRG; PAM sequence: GAG
gaatgttcaagtgccttcag

SEQ ID NO: 39801 - DNA, 20 bp, Artificial Sequence
  Description of Artificial Sequence: Synthetic oligonucleotide
  Target: ATXN1; (-) strand; PAM type: NRG; PAM sequence: AGG
tggaatgttcaagtgccttc

SEQ ID NO: 39802 - DNA, 20 bp, Artificial Sequence
  Description of Artificial Sequence: Synthetic oligonucleotide
  Target: ATXN1; (-) strand; PAM type: NRG; PAM sequence: CAG
ttggaatgttcaagtgcctt

SEQ ID NO: 39803 - DNA, 20 bp, Artificial Sequence
  Description of Artificial Sequence: Synthetic oligonucleotide
  Target: ATXN1; (-) strand; PAM type: NRG; PAM sequence: AAG
tgctccactttggaatgttc

SEQ ID NO: 39804 - DNA, 20 bp, Artificial Sequence
  Description of Artificial Sequence: Synthetic oligonucleotide
  Target: ATXN1; (-) strand; PAM type: NRG; PAM sequence: TGG
gtttcccaactgctccactt

SEQ ID NO: 39805 - DNA, 20 bp, Artificial Sequence
  Description of Artificial Sequence: Synthetic oligonucleotide
  Target: ATXN1; (-) strand; PAM type: NRG; PAM sequence: TGG
aacactatcaaaagcccact

SEQ ID NO: 39806 - DNA, 20 bp, Artificial Sequence
  Description of Artificial Sequence: Synthetic oligonucleotide
  Target: ATXN1; (-) strand; PAM type: NRG; PAM sequence: AAG
tatgctcttaacactatcaa

SEQ ID NO: 39807 - DNA, 20 bp, Artificial Sequence
  Description of Artificial Sequence: Synthetic oligonucleotide
  Target: ATXN1; (-) strand; PAM type: NRG; PAM sequence: TGG
caccagagaacaccctccct

SEQ ID NO: 39808 - DNA, 20 bp, Artificial Sequence
  Description of Artificial Sequence: Synthetic oligonucleotide
  Target: ATXN1; (-) strand; PAM type: NRG; PAM sequence: GAG
caaaagaatggggctcacca

SEQ ID NO: 39809 - DNA, 20 bp, Artificial Sequence
  Description of Artificial Sequence: Synthetic oligonucleotide
  Target: ATXN1; (-) strand; PAM type: NRG; PAM sequence: CAG
ctcaaaagaatggggctcac

SEQ ID NO: 39810 - DNA, 20 bp, Artificial Sequence
  Description of Artificial Sequence: Synthetic oligonucleotide
  Target: ATXN1; (-) strand; PAM type: NRG; PAM sequence: GGG
ggtcacaactcaaaagaatg

SEQ ID NO: 39811 - DNA, 20 bp, Artificial Sequence
  Description of Artificial Sequence: Synthetic oligonucleotide
  Target: ATXN1; (-) strand; PAM type: NRG; PAM sequence: GGG
gggtcacaactcaaaagaat

SEQ ID NO: 39812 - DNA, 20 bp, Artificial Sequence
  Description of Artificial Sequence: Synthetic oligonucleotide
  Target: ATXN1; (-) strand; PAM type: NRG; PAM sequence: TGG
ggggtcacaactcaaaagaa

SEQ ID NO: 39813 - DNA, 20 bp, Artificial Sequence
  Description of Artificial Sequence: Synthetic oligonucleotide
  Target: ATXN1; (-) strand; PAM type: NRG; PAM sequence: AAG
gctttggggtcacaactcaa

SEQ ID NO: 39814 - DNA, 20 bp, Artificial Sequence
  Description of Artificial Sequence: Synthetic oligonucleotide
  Target: ATXN1; (-) strand; PAM type: NRG; PAM sequence: GGG
ctctaagggacagtgctttg

SEQ ID NO: 39815 - DNA, 20 bp, Artificial Sequence
  Description of Artificial Sequence: Synthetic oligonucleotide
  Target: ATXN1; (-) strand; PAM type: NRG; PAM sequence: GGG
cctctaagggacagtgcttt

SEQ ID NO: 39816 - DNA, 20 bp, Artificial Sequence
  Description of Artificial Sequence: Synthetic oligonucleotide
  Target: ATXN1; (-) strand; PAM type: NRG; PAM sequence: TGG
tcctctaagggacagtgctt

SEQ ID NO: 39817 - DNA, 20 bp, Artificial Sequence
  Description of Artificial Sequence: Synthetic oligonucleotide
  Target: ATXN1; (-) strand; PAM type: NRG; PAM sequence: CAG
tcactgtctcctctaaggga

SEQ ID NO: 39818 - DNA, 20 bp, Artificial Sequence
  Description of Artificial Sequence: Synthetic oligonucleotide
  Target: ATXN1; (-) strand; PAM type: NRG; PAM sequence: GGG
tggttcactgtctcctctaa

SEQ ID NO: 39819 - DNA, 20 bp, Artificial Sequence
  Description of Artificial Sequence: Synthetic oligonucleotide
  Target: ATXN1; (-) strand; PAM type: NRG; PAM sequence: AGG
gtggttcactgtctcctcta

SEQ ID NO: 39820 - DNA, 20 bp, Artificial Sequence
  Description of Artificial Sequence: Synthetic oligonucleotide
  Target: ATXN1; (-) strand; PAM type: NRG; PAM sequence: AAG
tgtggttcactgtctcctct

SEQ ID NO: 39821 - DNA, 20 bp, Artificial Sequence
  Description of Artificial Sequence: Synthetic oligonucleotide
  Target: ATXN1; (-) strand; PAM type: NRG; PAM sequence: TGG
ttgaaaggcctgttggcttg

SEQ ID NO: 39822 - DNA, 20 bp, Artificial Sequence
  Description of Artificial Sequence: Synthetic oligonucleotide
  Target: ATXN1; (-) strand; PAM type: NRG; PAM sequence: TGG
tcagaccttgaaaggcctgt

SEQ ID NO: 39823 - DNA, 20 bp, Artificial Sequence
  Description of Artificial Sequence: Synthetic oligonucleotide
  Target: ATXN1; (-) strand; PAM type: NRG; PAM sequence: AGG
tctgagcttcagaccttgaa

SEQ ID NO: 39824 - DNA, 20 bp, Artificial Sequence
  Description of Artificial Sequence: Synthetic oligonucleotide
  Target: ATXN1; (-) strand; PAM type: NRG; PAM sequence: AAG
atctgagcttcagaccttga

SEQ ID NO: 39825 - DNA, 20 bp, Artificial Sequence
  Description of Artificial Sequence: Synthetic oligonucleotide
  Target: ATXN1; (-) strand; PAM type: NRG; PAM sequence: CAG
agatgagtcaatctgagctt

SEQ ID NO: 39826 - DNA, 20 bp, Artificial Sequence
  Description of Artificial Sequence: Synthetic oligonucleotide
  Target: ATXN1; (-) strand; PAM type: NRG; PAM sequence: GAG
ggactcagatgagtcaatct

SEQ ID NO: 39827 - DNA, 20 bp, Artificial Sequence
  Description of Artificial Sequence: Synthetic oligonucleotide
  Target: ATXN1; (-) strand; PAM type: NRG; PAM sequence: GAG
ccagttttagggactcagat

SEQ ID NO: 39828 - DNA, 20 bp, Artificial Sequence
  Description of Artificial Sequence: Synthetic oligonucleotide
  Target: ATXN1; (-) strand; PAM type: NRG; PAM sequence: CAG
ttaatccagttttagggact

SEQ ID NO: 39829 - DNA, 20 bp, Artificial Sequence
  Description of Artificial Sequence: Synthetic oligonucleotide
  Target: ATXN1; (-) strand; PAM type: NRG; PAM sequence: GGG
aagaccttaatccagtttta

SEQ ID NO: 39830 - DNA, 20 bp, Artificial Sequence
  Description of Artificial Sequence: Synthetic oligonucleotide
  Target: ATXN1; (-) strand; PAM type: NRG; PAM sequence: AGG
caagaccttaatccagtttt

SEQ ID NO: 39831 - DNA, 20 bp, Artificial Sequence
  Description of Artificial Sequence: Synthetic oligonucleotide
  Target: ATXN1; (-) strand; PAM type: NRG; PAM sequence: TAG
tcaagaccttaatccagttt

SEQ ID NO: 39832 - DNA, 20 bp, Artificial Sequence
  Description of Artificial Sequence: Synthetic oligonucleotide
  Target: ATXN1; (-) strand; PAM type: NRG; PAM sequence: CAG
agtaattcaagaccttaatc

SEQ ID NO: 39833 - DNA, 20 bp, Artificial Sequence
  Description of Artificial Sequence: Synthetic oligonucleotide
  Target: ATXN1; (-) strand; PAM type: NRG; PAM sequence: AAG
caaaattgtgaaagtaattc

SEQ ID NO: 39834 - DNA, 20 bp, Artificial Sequence
  Description of Artificial Sequence: Synthetic oligonucleotide
  Target: ATXN1; (-) strand; PAM type: NRG; PAM sequence: AAG
ttttatttgcaaaattgtga

SEQ ID NO: 39835 - DNA, 20 bp, Artificial Sequence
  Description of Artificial Sequence: Synthetic oligonucleotide
  Target: ATXN1; (-) strand; PAM type: NRG; PAM sequence: TGG
tagtgcttatacaagctatc

SEQ ID NO: 39836 - DNA, 20 bp, Artificial Sequence
  Description of Artificial Sequence: Synthetic oligonucleotide
  Target: ATXN1; (-) strand; PAM type: NRG; PAM sequence: AAG
tattttgctagtgcttatac

SEQ ID NO: 39837 - DNA, 20 bp, Artificial Sequence
  Description of Artificial Sequence: Synthetic oligonucleotide
  Target: ATXN1; (-) strand; PAM type: NRG; PAM sequence: TAG
tttaagatctgatattttgc

SEQ ID NO: 39838 - DNA, 20 bp, Artificial Sequence
  Description of Artificial Sequence: Synthetic oligonucleotide
  Target: ATXN1; (-) strand; PAM type: NRG; PAM sequence: AAG
gccctggtgcatcctttttt

SEQ ID NO: 39839 - DNA, 20 bp, Artificial Sequence
  Description of Artificial Sequence: Synthetic oligonucleotide
  Target: ATXN1; (-) strand; PAM type: NRG; PAM sequence: TGG
tgactctatatgagaagccc

SEQ ID NO: 39840 - DNA, 20 bp, Artificial Sequence
  Description of Artificial Sequence: Synthetic oligonucleotide
  Target: ATXN1; (-) strand; PAM type: NRG; PAM sequence: AAG
tatgtatgactctatatgag

SEQ ID NO: 39841 - DNA, 20 bp, Artificial Sequence
  Description of Artificial Sequence: Synthetic oligonucleotide
  Target: ATXN1; (-) strand; PAM type: NRG; PAM sequence: GAG
ctatatgtatgactctatat

SEQ ID NO: 39842 - DNA, 20 bp, Artificial Sequence
  Description of Artificial Sequence: Synthetic oligonucleotide
  Target: ATXN1; (-) strand; PAM type: NRG; PAM sequence: AAG
ttgtaagcatagtctttgta

SEQ ID NO: 39843 - DNA, 20 bp, Artificial Sequence
  Description of Artificial Sequence: Synthetic oligonucleotide
  Target: ATXN1; (-) strand; PAM type: NRG; PAM sequence: TAG
cttcttaattattgtaagca

SEQ ID NO: 39844 - DNA, 20 bp, Artificial Sequence
  Description of Artificial Sequence: Synthetic oligonucleotide
  Target: ATXN1; (-) strand; PAM type: NRG; PAM sequence: AAG
ttaatcttcttaattattgt

SEQ ID NO: 39845 - DNA, 20 bp, Artificial Sequence
  Description of Artificial Sequence: Synthetic oligonucleotide
  Target: ATXN1; (-) strand; PAM type: NRG; PAM sequence: AAG
agtttcctatcaaaattctc

SEQ ID NO: 39846 - DNA, 20 bp, Artificial Sequence
  Description of Artificial Sequence: Synthetic oligonucleotide
  Target: ATXN1; (-) strand; PAM type: NRG; PAM sequence: TAG
gatcttttaaaaacagattc

SEQ ID NO: 39847 - DNA, 20 bp, Artificial Sequence
  Description of Artificial Sequence: Synthetic oligonucleotide
  Target: ATXN1; (-) strand; PAM type: NRG; PAM sequence: CAG
cttcatggatcttttaaaaa

SEQ ID NO: 39848 - DNA, 20 bp, Artificial Sequence
  Description of Artificial Sequence: Synthetic oligonucleotide
  Target: ATXN1; (-) strand; PAM type: NRG; PAM sequence: TGG
agccaccatgcctggcttca

SEQ ID NO: 39849 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccaccatgcc

SEQ ID NO: 39850 - DNA, 20 bp, Artificial Sequence
  Description of Artificial Sequence: Synthetic oligonucleotide
  Target: ATXN1; (-) strand; PAM type: NRG; PAM sequence: GAG
agtactgagattacaggcat

SEQ ID NO: 39851 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtactgagattac

SEQ ID NO: 39852 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtactgagatta

SEQ ID NO: 39853 - DNA, 20 bp, Artificial Sequence
  Description of Artificial Sequence: Synthetic oligonucleotide
  Target: ATXN1; (-) strand; PAM type: NRG; PAM sequence: GAG
tctcagcctcccaaagtact

SEQ ID NO: 39854 - DNA, 20 bp, Artificial Sequence
  Description of Artificial Sequence: Synthetic oligonucleotide
  Target: ATXN1; (-) strand; PAM type: NRG; PAM sequence: AAG
ctccctgtctcagcctccca

SEQ ID NO: 39855 - DNA, 20 bp, Artificial Sequence
  Description of Artificial Sequence: Synthetic oligonucleotide
  Target: ATXN1; (-) strand; PAM type: NRG; PAM sequence: CAG
tcaagtgatcctccctgtct

SEQ ID NO: 39856 - DNA, 20 bp, Artificial Sequence
  Description of Artificial Sequence: Synthetic oligonucleotide
  Target: ATXN1; (-) strand; PAM type: NRG; PAM sequence: AAG
ggtctgaaactcctggcctc

SEQ ID NO: 39857 - DNA, 20 bp, Artificial Sequence
  Description of Artificial Sequence: Synthetic oligonucleotide
  Target: ATXN1; (-) strand; PAM type: NRG; PAM sequence: TGG
ccagactggtctgaaactcc

SEQ ID NO: 39858 - DNA, 20 bp, Artificial Sequence
  Description of Artificial Sequence: Synthetic oligonucleotide
  Target: ATXN1; (-) strand; PAM type: NRG; PAM sequence: TGG
tctcattttgttgcccagac

SEQ ID NO: 39859 - DNA, 20 bp, Artificial Sequence
  Description of Artificial Sequence: Synthetic oligonucleotide
  Target: ATXN1; (-) strand; PAM type: NRG; PAM sequence: CAG
cggggtctcattttgttgcc

SEQ ID NO: 39860 - DNA, 20 bp, Artificial Sequence
  Description of Artificial Sequence: Synthetic oligonucleotide
  Target: ATXN1; (-) strand; PAM type: NRG; PAM sequence: GGG
tttaaatttctgtagaaacg

SEQ ID NO: 39861 - DNA, 20 bp, Artificial Sequence
  Description of Artificial Sequence: Synthetic oligonucleotide
  Target: ATXN1; (-) strand; PAM type: NRG; PAM sequence: GGG
ttttaaatttctgtagaaac

SEQ ID NO: 39862 - DNA, 20 bp, Artificial Sequence
  Description of Artificial Sequence: Synthetic oligonucleotide
  Target: ATXN1; (-) strand; PAM type: NRG; PAM sequence: CGG
tttttaaatttctgtagaaa

SEQ ID NO: 39863 - DNA, 20 bp, Artificial Sequence
  Description of Artificial Sequence: Synthetic oligonucleotide
  Target: ATXN1; (-) strand; PAM type: NRG; PAM sequence: TAG
tatttttttttaaatttctg

SEQ ID NO: 39864 - DNA, 20 bp, Artificial Sequence
  Description of Artificial Sequence: Synthetic oligonucleotide
  Target: ATXN1; (-) strand; PAM type: NRG; PAM sequence: AGG
caggcacgcatcaccacact

SEQ ID NO: 39865 - DNA, 20 bp, Artificial Sequence
  Description of Artificial Sequence: Synthetic oligonucleotide
  Target: ATXN1; (-) strand; PAM type: NRG; PAM sequence: TAG
acaggcacgcatcaccacac

SEQ ID NO: 39866 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagttgggactac

SEQ ID NO: 39867 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagttgggacta

SEQ ID NO: 39868 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagtt

SEQ ID NO: 39869 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtagt

SEQ ID NO: 39870 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 39871 - DNA, 20 bp, Artificial Sequence
  Description of Artificial Sequence: Synthetic oligonucleotide
  Target: ATXN1; (-) strand; PAM type: NRG; PAM sequence: GAG
tcctcctgcctcagcctcct

SEQ ID NO: 39872 - DNA, 20 bp, Artificial Sequence
  Description of Artificial Sequence: Synthetic oligonucleotide
  Target: ATXN1; (-) strand; PAM type: NRG; PAM sequence: CAG
ggctcaagatcctcctgcct

SEQ ID NO: 39873 - DNA, 20 bp, Artificial Sequence
  Description of Artificial Sequence: Synthetic oligonucleotide
  Target: ATXN1; (-) strand; PAM type: NRG; PAM sequence: AAG
aacctctaactcctgggctc

SEQ ID NO: 39874 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctaactcct

SEQ ID NO: 39875 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctctaactcc

SEQ ID NO: 39876 - DNA, 20 bp, Artificial Sequence
  Description of Artificial Sequence: Synthetic oligonucleotide
  Target: ATXN1; (-) strand; PAM type: NRG; PAM sequence: TAG
ggagtgcagtcttgtgatca

SEQ ID NO: 39877 - DNA, 20 bp, Artificial Sequence
  Description of Artificial Sequence: Synthetic oligonucleotide
  Target: ATXN1; (-) strand; PAM type: NRG; PAM sequence: CAG
ctgttgtccaggctggagtg

SEQ ID NO: 39878 - DNA, 20 bp, Artificial Sequence
  Description of Artificial Sequence: Synthetic oligonucleotide
  Target: ATXN1; (-) strand; PAM type: NRG; PAM sequence: GAG
tcactctgttgtccaggctg

SEQ ID NO: 39879 - DNA, 20 bp, Artificial Sequence
  Description of Artificial Sequence: Synthetic oligonucleotide
  Target: ATXN1; (-) strand; PAM type: NRG; PAM sequence: TGG
tctcactctgttgtccaggc

SEQ ID NO: 39880 - DNA, 20 bp, Artificial Sequence
  Description of Artificial Sequence: Synthetic oligonucleotide
  Target: ATXN1; (-) strand; PAM type: NRG; PAM sequence: AGG
agagtctcactctgttgtcc

SEQ ID NO: 39881 - DNA, 20 bp, Artificial Sequence
  Description of Artificial Sequence: Synthetic oligonucleotide
  Target: ATXN1; (-) strand; PAM type: NRG; PAM sequence: CAG
cagagtctcactctgttgtc

SEQ ID NO: 39882 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttagagaca

SEQ ID NO: 39883 - DNA, 20 bp, Artificial Sequence
  Description of Artificial Sequence: Synthetic oligonucleotide
  Target: ATXN1; (-) strand; PAM type: NRG; PAM sequence: CAG
attttttttttttttagaga

SEQ ID NO: 39884 - DNA, 20 bp, Artificial Sequence
  Description of Artificial Sequence: Synthetic oligonucleotide
  Target: ATXN1; (-) strand; PAM type: NRG; PAM sequence: GAG
atttatttttttttttttta

SEQ ID NO: 39885 - DNA, 20 bp, Artificial Sequence
  Description of Artificial Sequence: Synthetic oligonucleotide
  Target: ATXN1; (-) strand; PAM type: NRG; PAM sequence: TAG
ttatttattttttttttttt

SEQ ID NO: 39886 - DNA, 20 bp, Artificial Sequence
  Description of Artificial Sequence: Synthetic oligonucleotide
  Target: ATXN1; (-) strand; PAM type: NRG; PAM sequence: TAG
ttttaattctacaattctca

SEQ ID NO: 39887 - DNA, 20 bp, Artificial Sequence
  Description of Artificial Sequence: Synthetic oligonucleotide
  Target: ATXN1; (-) strand; PAM type: NRG; PAM sequence: TGG
cattgcattcttgatttcag

SEQ ID NO: 39888 - DNA, 20 bp, Artificial Sequence
  Description of Artificial Sequence: Synthetic oligonucleotide
  Target: ATXN1; (-) strand; PAM type: NRG; PAM sequence: CAG
gctcattgcattcttgattt

SEQ ID NO: 39889 - DNA, 20 bp, Artificial Sequence
  Description of Artificial Sequence: Synthetic oligonucleotide
  Target: ATXN1; (-) strand; PAM type: NRG; PAM sequence: AAG
tccatgtctattcaactgga

SEQ ID NO: 39890 - DNA, 20 bp, Artificial Sequence
  Description of Artificial Sequence: Synthetic oligonucleotide
  Target: ATXN1; (-) strand; PAM type: NRG; PAM sequence: TGG
ttaatccatgtctattcaac

SEQ ID NO: 39891 - DNA, 20 bp, Artificial Sequence
  Description of Artificial Sequence: Synthetic oligonucleotide
  Target: ATXN1; (-) strand; PAM type: NRG; PAM sequence: CAG
aaagctctaattagagaatc

SEQ ID NO: 39892 - DNA, 20 bp, Artificial Sequence
  Description of Artificial Sequence: Synthetic oligonucleotide
  Target: ATXN1; (-) strand; PAM type: NRG; PAM sequence: GAG
ctcttctaaagctctaatta

SEQ ID NO: 39893 - DNA, 20 bp, Artificial Sequence
  Description of Artificial Sequence: Synthetic oligonucleotide
  Target: ATXN1; (-) strand; PAM type: NRG; PAM sequence: TAG
gtctcttctaaagctctaat

SEQ ID NO: 39894 - DNA, 20 bp, Artificial Sequence
  Description of Artificial Sequence: Synthetic oligonucleotide
  Target: ATXN1; (-) strand; PAM type: NRG; PAM sequence: AAG
actctgtggagtctcttcta

SEQ ID NO: 39895 - DNA, 20 bp, Artificial Sequence
  Description of Artificial Sequence: Synthetic oligonucleotide
  Target: ATXN1; (-) strand; PAM type: NRG; PAM sequence: GAG
gtctctatgttcactctgtg

SEQ ID NO: 39896 - DNA, 20 bp, Artificial Sequence
  Description of Artificial Sequence: Synthetic oligonucleotide
  Target: ATXN1; (-) strand; PAM type: NRG; PAM sequence: TGG
ttgtctctatgttcactctg

SEQ ID NO: 39897 - DNA, 20 bp, Artificial Sequence
  Description of Artificial Sequence: Synthetic oligonucleotide
  Target: ATXN1; (-) strand; PAM type: NRG; PAM sequence: TAG
gattcaaattatgtgtctgt

SEQ ID NO: 39898 - DNA, 20 bp, Artificial Sequence
  Description of Artificial Sequence: Synthetic oligonucleotide
  Target: ATXN1; (-) strand; PAM type: NRG; PAM sequence: AGG
ctccctctcttcctcctcct

SEQ ID NO: 39899 - DNA, 20 bp, Artificial Sequence
  Description of Artificial Sequence: Synthetic oligonucleotide
  Target: ATXN1; (-) strand; PAM type: NRG; PAM sequence: TAG
tctccctctcttcctcctcc

SEQ ID NO: 39900 - DNA, 20 bp, Artificial Sequence
  Description of Artificial Sequence: Synthetic oligonucleotide
  Target: ATXN1; (-) strand; PAM type: NRG; PAM sequence: AAG
ttcttagccattacctcctc

SEQ ID NO: 39901 - DNA, 20 bp, Artificial Sequence
  Description of Artificial Sequence: Synthetic oligonucleotide
  Target: ATXN1; (-) strand; PAM type: NRG; PAM sequence: TAG
cttcagtttgggaaaattct

SEQ ID NO: 39902 - DNA, 20 bp, Artificial Sequence
  Description of Artificial Sequence: Synthetic oligonucleotide
  Target: ATXN1; (-) strand; PAM type: NRG; PAM sequence: GGG
ttattatccttcttcagttt

SEQ ID NO: 39903 - DNA, 20 bp, Artificial Sequence
  Description of Artificial Sequence: Synthetic oligonucleotide
  Target: ATXN1; (-) strand; PAM type: NRG; PAM sequence: TGG
cttattatccttcttcagtt

SEQ ID NO: 39904 - DNA, 20 bp, Artificial Sequence
  Description of Artificial Sequence: Synthetic oligonucleotide
  Target: ATXN1; (-) strand; PAM type: NRG; PAM sequence: CAG
actgtcttattatccttctt

SEQ ID NO: 39905 - DNA, 20 bp, Artificial Sequence
  Description of Artificial Sequence: Synthetic oligonucleotide
  Target: ATXN1; (-) strand; PAM type: NRG; PAM sequence: AGG
tatttttcctgtttggggct

SEQ ID NO: 39906 - DNA, 20 bp, Artificial Sequence
  Description of Artificial Sequence: Synthetic oligonucleotide
  Target: ATXN1; (-) strand; PAM type: NRG; PAM sequence: TAG
ttatttttcctgtttggggc

SEQ ID NO: 39907 - DNA, 20 bp, Artificial Sequence
  Description of Artificial Sequence: Synthetic oligonucleotide
  Target: ATXN1; (-) strand; PAM type: NRG; PAM sequence: GGG
ttgtttatttttcctgtttg

SEQ ID NO: 39908 - DNA, 20 bp, Artificial Sequence
  Description of Artificial Sequence: Synthetic oligonucleotide
  Target: ATXN1; (-) strand; PAM type: NRG; PAM sequence: GGG
tttgtttatttttcctgttt

SEQ ID NO: 39909 - DNA, 20 bp, Artificial Sequence
  Description of Artificial Sequence: Synthetic oligonucleotide
  Target: ATXN1; (-) strand; PAM type: NRG; PAM sequence: TGG
ttttgtttatttttcctgtt

SEQ ID NO: 39910 - DNA, 20 bp, Artificial Sequence
  Description of Artificial Sequence: Synthetic oligonucleotide
  Target: ATXN1; (-) strand; PAM type: NRG; PAM sequence: AGG
aattctcatctgcctcagtg

SEQ ID NO: 39911 - DNA, 20 bp, Artificial Sequence
  Description of Artificial Sequence: Synthetic oligonucleotide
  Target: ATXN1; (-) strand; PAM type: NRG; PAM sequence: GAG
taattctcatctgcctcagt

SEQ ID NO: 39912 - DNA, 20 bp, Artificial Sequence
  Description of Artificial Sequence: Synthetic oligonucleotide
  Target: ATXN1; (-) strand; PAM type: NRG; PAM sequence: CAG
agtttaattctcatctgcct

SEQ ID NO: 39913 - DNA, 20 bp, Artificial Sequence
  Description of Artificial Sequence: Synthetic oligonucleotide
  Target: ATXN1; (-) strand; PAM type: NRG; PAM sequence: CAG
aagatgtctttgatttatag

SEQ ID NO: 39914 - DNA, 20 bp, Artificial Sequence
  Description of Artificial Sequence: Synthetic oligonucleotide
  Target: ATXN1; (-) strand; PAM type: NRG; PAM sequence: TAG
tacaagatgtctttgattta

SEQ ID NO: 39915 - DNA, 20 bp, Artificial Sequence
  Description of Artificial Sequence: Synthetic oligonucleotide
  Target: ATXN1; (-) strand; PAM type: NRG; PAM sequence: AAG
ttttttcctgtttagtttac

SEQ ID NO: 39916 - DNA, 20 bp, Artificial Sequence
  Description of Artificial Sequence: Synthetic oligonucleotide
  Target: ATXN1; (-) strand; PAM type: NRG; PAM sequence: TAG
taacgatattttttcctgtt

SEQ ID NO: 39917 - DNA, 20 bp, Artificial Sequence
  Description of Artificial Sequence: Synthetic oligonucleotide
  Target: ATXN1; (-) strand; PAM type: NRG; PAM sequence: AGG
ccacacccagcctgttctag

SEQ ID NO: 39918 - DNA, 20 bp, Artificial Sequence
  Description of Artificial Sequence: Synthetic oligonucleotide
  Target: ATXN1; (-) strand; PAM type: NRG; PAM sequence: GAG
accacacccagcctgttcta

SEQ ID NO: 39919 - DNA, 20 bp, Artificial Sequence
  Description of Artificial Sequence: Synthetic oligonucleotide
  Target: ATXN1; (-) strand; PAM type: NRG; PAM sequence: TAG
ccaccacacccagcctgttc

SEQ ID NO: 39920 - DNA, 20 bp, Artificial Sequence
  Description of Artificial Sequence: Synthetic oligonucleotide
  Target: ATXN1; (-) strand; PAM type: NRG; PAM sequence: CAG
caggcaggagccaccacacc

SEQ ID NO: 39921 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcag

SEQ ID NO: 39922 - DNA, 20 bp, Artificial Sequence
  Description of Artificial Sequence: Synthetic oligonucleotide
  Target: ATXN1; (-) strand; PAM type: NRG; PAM sequence: AGG
aaagtgctgggattacaggc

SEQ ID NO: 39923 - DNA, 20 bp, Artificial Sequence
  Description of Artificial Sequence: Synthetic oligonucleotide
  Target: ATXN1; (-) strand; PAM type: NRG; PAM sequence: CAG
caaagtgctgggattacagg

SEQ ID NO: 39924 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 39925 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 39926 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 39927 - DNA, 20 bp, Artificial Sequence
  Description of Artificial Sequence: Synthetic oligonucleotide
  Target: ATXN1; (-) strand; PAM type: NRG; PAM sequence: TGG
acctcggcctcccaaagtgc

SEQ ID NO: 39928 - DNA, 20 bp, Artificial Sequence
  Description of Artificial Sequence: Synthetic oligonucleotide
  Target: ATXN1; (-) strand; PAM type: NRG; PAM sequence: AAG
ccacccacctcggcctccca

SEQ ID NO: 39929 - DNA, 20 bp, Artificial Sequence
  Description of Artificial Sequence: Synthetic oligonucleotide
  Target: ATXN1; (-) strand; PAM type: NRG; PAM sequence: CGG
ctcaggtaatccacccacct

SEQ ID NO: 39930 - DNA, 20 bp, Artificial Sequence
  Description of Artificial Sequence: Synthetic oligonucleotide
  Target: ATXN1; (-) strand; PAM type: NRG; PAM sequence: AGG
ggtctcaaactcctgacctc

SEQ ID NO: 39931 - DNA, 20 bp, Artificial Sequence
  Description of Artificial Sequence: Synthetic oligonucleotide
  Target: ATXN1; (-) strand; PAM type: NRG; PAM sequence: CAG
tggtctcaaactcctgacct

SEQ ID NO: 39932 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccagac

SEQ ID NO: 39933 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttggc

SEQ ID NO: 39934 - DNA, 20 bp, Artificial Sequence
  Description of Artificial Sequence: Synthetic oligonucleotide
  Target: ATXN1; (-) strand; PAM type: NRG; PAM sequence: TGG
gagatggggtttcaccatgt

SEQ ID NO: 39935 - DNA, 20 bp, Artificial Sequence
  Description of Artificial Sequence: Synthetic oligonucleotide
  Target: ATXN1; (-) strand; PAM type: NRG; PAM sequence: GGG
ttgcatttttagtagagatg

SEQ ID NO: 39936 - DNA, 20 bp, Artificial Sequence
  Description of Artificial Sequence: Synthetic oligonucleotide
  Target: ATXN1; (-) strand; PAM type: NRG; PAM sequence: GGG
tttgcatttttagtagagat

SEQ ID NO: 39937 - DNA, 20 bp, Artificial Sequence
  Description of Artificial Sequence: Synthetic oligonucleotide
  Target: ATXN1; (-) strand; PAM type: NRG; PAM sequence: TGG
ttttgcatttttagtagaga

SEQ ID NO: 39938 - DNA, 20 bp, Artificial Sequence
  Description of Artificial Sequence: Synthetic oligonucleotide
  Target: ATXN1; (-) strand; PAM type: NRG; PAM sequence: GAG
taatttttgcatttttagta

SEQ ID NO: 39939 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgcatttttag

SEQ ID NO: 39940 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgcatttt

SEQ ID NO: 39941 - DNA, 20 bp, Artificial Sequence
  Description of Artificial Sequence: Synthetic oligonucleotide
  Target: ATXN1; (-) strand; PAM type: NRG; PAM sequence: CAG
caggttcctgccaccatgcc

SEQ ID NO: 39942 - DNA, 20 bp, Artificial Sequence
  Description of Artificial Sequence: Synthetic oligonucleotide
  Target: ATXN1; (-) strand; PAM type: NRG; PAM sequence: AGG
ccccgagtagctgggattac

SEQ ID NO: 39943 - DNA, 20 bp, Artificial Sequence
  Description of Artificial Sequence: Synthetic oligonucleotide
  Target: ATXN1; (-) strand; PAM type: NRG; PAM sequence: CAG
cccccgagtagctgggatta

SEQ ID NO: 39944 - DNA, 20 bp, Artificial Sequence
  Description of Artificial Sequence: Synthetic oligonucleotide
  Target: ATXN1; (-) strand; PAM type: NRG; PAM sequence: GGG
cctcagccccccgagtagct

SEQ ID NO: 39945 - DNA, 20 bp, Artificial Sequence
  Description of Artificial Sequence: Synthetic oligonucleotide
  Target: ATXN1; (-) strand; PAM type: NRG; PAM sequence: TGG
gcctcagccccccgagtagc

SEQ ID NO: 39946 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagccccccgag

SEQ ID NO: 39947 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcccccc

SEQ ID NO: 39948 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 39949 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcccgggttc

SEQ ID NO: 39950 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccgcctccc

SEQ ID NO: 39951 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctccgcctcc

SEQ ID NO: 39952 - DNA, 20 bp, Artificial Sequence
  Description of Artificial Sequence: Synthetic oligonucleotide
  Target: ATXN1; (-) strand; PAM type: NRG; PAM sequence: TGG
ttggctcactgcaacgatct

SEQ ID NO: 39953 - DNA, 20 bp, Artificial Sequence
  Description of Artificial Sequence: Synthetic oligonucleotide
  Target: ATXN1; (-) strand; PAM type: NRG; PAM sequence: TGG
ttggctcactgcaacgatct

SEQ ID NO: 39954 - DNA, 20 bp, Artificial Sequence
  Description of Artificial Sequence: Synthetic oligonucleotide
  Target: ATXN1; (-) strand; PAM type: NRG; PAM sequence: TGG
agagtgtgatggaatgatct

SEQ ID NO: 39955 - DNA, 20 bp, Artificial Sequence
  Description of Artificial Sequence: Synthetic oligonucleotide
  Target: ATXN1; (-) strand; PAM type: NRG; PAM sequence: TGG
tcgcccagtctagagtgtga

SEQ ID NO: 39956 - DNA, 20 bp, Artificial Sequence
  Description of Artificial Sequence: Synthetic oligonucleotide
  Target: ATXN1; (-) strand; PAM type: NRG; PAM sequence: GAG
ctctattgtcgcccagtcta

SEQ ID NO: 39957 - DNA, 20 bp, Artificial Sequence
  Description of Artificial Sequence: Synthetic oligonucleotide
  Target: ATXN1; (-) strand; PAM type: NRG; PAM sequence: TAG
ttctctattgtcgcccagtc

SEQ ID NO: 39958 - DNA, 20 bp, Artificial Sequence
  Description of Artificial Sequence: Synthetic oligonucleotide
  Target: ATXN1; (-) strand; PAM type: NRG; PAM sequence: CAG
ggagtttctctattgtcgcc

SEQ ID NO: 39959 - DNA, 20 bp, Artificial Sequence
  Description of Artificial Sequence: Synthetic oligonucleotide
  Target: ATXN1; (-) strand; PAM type: NRG; PAM sequence: GAG
gaggctttttttttttaatg

SEQ ID NO: 39960 - DNA, 20 bp, Artificial Sequence
  Description of Artificial Sequence: Synthetic oligonucleotide
  Target: ATXN1; (-) strand; PAM type: NRG; PAM sequence: TGG
tagaggctttttttttttaa

SEQ ID NO: 39961 - DNA, 20 bp, Artificial Sequence
  Description of Artificial Sequence: Synthetic oligonucleotide
  Target: ATXN1; (-) strand; PAM type: NRG; PAM sequence: AGG
taatatgtattttgttctag

SEQ ID NO: 39962 - DNA, 20 bp, Artificial Sequence
  Description of Artificial Sequence: Synthetic oligonucleotide
  Target: ATXN1; (-) strand; PAM type: NRG; PAM sequence: GAG
ataatatgtattttgttcta

SEQ ID NO: 39963 - DNA, 20 bp, Artificial Sequence
  Description of Artificial Sequence: Synthetic oligonucleotide
  Target: ATXN1; (-) strand; PAM type: NRG; PAM sequence: TAG
agataatatgtattttgttc

SEQ ID NO: 39964 - DNA, 20 bp, Artificial Sequence
  Description of Artificial Sequence: Synthetic oligonucleotide
  Target: ATXN1; (-) strand; PAM type: NRG; PAM sequence: GAG
gttccattgttgcttatttg

SEQ ID NO: 39965 - DNA, 20 bp, Artificial Sequence
  Description of Artificial Sequence: Synthetic oligonucleotide
  Target: ATXN1; (-) strand; PAM type: NRG; PAM sequence: TGG
gagttccattgttgcttatt

SEQ ID NO: 39966 - DNA, 20 bp, Artificial Sequence
  Description of Artificial Sequence: Synthetic oligonucleotide
  Target: ATXN1; (-) strand; PAM type: NRG; PAM sequence: GAG
tttgttgagatgtaaactgt

SEQ ID NO: 39967 - DNA, 20 bp, Artificial Sequence
  Description of Artificial Sequence: Synthetic oligonucleotide
  Target: ATXN1; (-) strand; PAM type: NRG; PAM sequence: GAG
tggcttccattatttttgtt

SEQ ID NO: 39968 - DNA, 20 bp, Artificial Sequence
  Description of Artificial Sequence: Synthetic oligonucleotide
  Target: ATXN1; (-) strand; PAM type: NRG; PAM sequence: TGG
ccattgtctccattgtctac

SEQ ID NO: 39969 - DNA, 20 bp, Artificial Sequence
  Description of Artificial Sequence: Synthetic oligonucleotide
  Target: ATXN1; (-) strand; PAM type: NRG; PAM sequence: AAG
tctttttctttagcactgta

SEQ ID NO: 39970 - DNA, 20 bp, Artificial Sequence
  Description of Artificial Sequence: Synthetic oligonucleotide
  Target: ATXN1; (-) strand; PAM type: NRG; PAM sequence: TAG
cattgacaattctttttctt

SEQ ID NO: 39971 - DNA, 20 bp, Artificial Sequence
  Description of Artificial Sequence: Synthetic oligonucleotide
  Target: ATXN1; (-) strand; PAM type: NRG; PAM sequence: TAG
aaggatctttttgctccata

SEQ ID NO: 39972 - DNA, 20 bp, Artificial Sequence
  Description of Artificial Sequence: Synthetic oligonucleotide
  Target: ATXN1; (-) strand; PAM type: NRG; PAM sequence: AGG
tattttgccttcattctgga

SEQ ID NO: 39973 - DNA, 20 bp, Artificial Sequence
  Description of Artificial Sequence: Synthetic oligonucleotide
  Target: ATXN1; (-) strand; PAM type: NRG; PAM sequence: AAG
ctattttgccttcattctgg

SEQ ID NO: 39974 - DNA, 20 bp, Artificial Sequence
  Description of Artificial Sequence: Synthetic oligonucleotide
  Target: ATXN1; (-) strand; PAM type: NRG; PAM sequence: TGG
tctctattttgccttcattc

SEQ ID NO: 39975 - DNA, 20 bp, Artificial Sequence
  Description of Artificial Sequence: Synthetic oligonucleotide
  Target: ATXN1; (-) strand; PAM type: NRG; PAM sequence: TGG
ctataatgcagatctgttga

SEQ ID NO: 39976 - DNA, 20 bp, Artificial Sequence
  Description of Artificial Sequence: Synthetic oligonucleotide
  Target: ATXN1; (-) strand; PAM type: NRG; PAM sequence: CAG
ttttagtattttctataatg

SEQ ID NO: 39977 - DNA, 20 bp, Artificial Sequence
  Description of Artificial Sequence: Synthetic oligonucleotide
  Target: ATXN1; (-) strand; PAM type: NRG; PAM sequence: TAG
tctacctaaagaataccttt

SEQ ID NO: 39978 - DNA, 20 bp, Artificial Sequence
  Description of Artificial Sequence: Synthetic oligonucleotide
  Target: ATXN1; (-) strand; PAM type: NRG; PAM sequence: AAG
atttgttttttctctaccta

SEQ ID NO: 39979 - DNA, 20 bp, Artificial Sequence
  Description of Artificial Sequence: Synthetic oligonucleotide
  Target: ATXN1; (-) strand; PAM type: NRG; PAM sequence: TAG
tccctgtacaaacttcaatc

SEQ ID NO: 39980 - DNA, 20 bp, Artificial Sequence
  Description of Artificial Sequence: Synthetic oligonucleotide
  Target: ATXN1; (-) strand; PAM type: NRG; PAM sequence: CAG
acatatagccaatattcatt

SEQ ID NO: 39981 - DNA, 20 bp, Artificial Sequence
  Description of Artificial Sequence: Synthetic oligonucleotide
  Target: ATXN1; (-) strand; PAM type: NRG; PAM sequence: TAG
attttaaatattgttacata

SEQ ID NO: 39982 - DNA, 20 bp, Artificial Sequence
  Description of Artificial Sequence: Synthetic oligonucleotide
  Target: ATXN1; (-) strand; PAM type: NRG; PAM sequence: AAG
ccctctcacaaaaagaaaaa

SEQ ID NO: 39983 - DNA, 20 bp, Artificial Sequence
  Description of Artificial Sequence: Synthetic oligonucleotide
  Target: ATXN1; (-) strand; PAM type: NRG; PAM sequence: AAG
gcaagactccctctcacaaa

SEQ ID NO: 39984 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggcgacagagc

SEQ ID NO: 39985 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcgaca

SEQ ID NO: 39986 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcga

SEQ ID NO: 39987 - DNA, 20 bp, Artificial Sequence
  Description of Artificial Sequence: Synthetic oligonucleotide
  Target: ATXN1; (-) strand; PAM type: NRG; PAM sequence: GGG
gcgccactgcactccagcct

SEQ ID NO: 39988 - DNA, 20 bp, Artificial Sequence
  Description of Artificial Sequence: Synthetic oligonucleotide
  Target: ATXN1; (-) strand; PAM type: NRG; PAM sequence: TGG
cgcgccactgcactccagcc

SEQ ID NO: 39989 - DNA, 20 bp, Artificial Sequence
  Description of Artificial Sequence: Synthetic oligonucleotide
  Target: ATXN1; (-) strand; PAM type: NRG; PAM sequence: CAG
gagatcgcgccactgcactc

SEQ ID NO: 39990 - DNA, 20 bp, Artificial Sequence
  Description of Artificial Sequence: Synthetic oligonucleotide
  Target: ATXN1; (-) strand; PAM type: NRG; PAM sequence: GAG
ggcggagattgcagtgagcc

SEQ ID NO: 39991 - DNA, 20 bp, Artificial Sequence
  Description of Artificial Sequence: Synthetic oligonucleotide
  Target: ATXN1; (-) strand; PAM type: NRG; PAM sequence: GAG
cgggaggcggagattgcagt

SEQ ID NO: 39992 - DNA, 20 bp, Artificial Sequence
  Description of Artificial Sequence: Synthetic oligonucleotide
  Target: ATXN1; (-) strand; PAM type: NRG; PAM sequence: CAG
aacccgggaggcggagattg

SEQ ID NO: 39993 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccgggaggcg

SEQ ID NO: 39994 - DNA, 20 bp, Artificial Sequence
  Description of Artificial Sequence: Synthetic oligonucleotide
  Target: ATXN1; (-) strand; PAM type: NRG; PAM sequence: CGG
actcgcttgaacccgggagg

SEQ ID NO: 39995 - DNA, 20 bp, Artificial Sequence
  Description of Artificial Sequence: Synthetic oligonucleotide
  Target: ATXN1; (-) strand; PAM type: NRG; PAM sequence: AGG
gagactcgcttgaacccggg

SEQ ID NO: 39996 - DNA, 20 bp, Artificial Sequence
  Description of Artificial Sequence: Synthetic oligonucleotide
  Target: ATXN1; (-) strand; PAM type: NRG; PAM sequence: GAG
ggagactcgcttgaacccgg

SEQ ID NO: 39997 - DNA, 20 bp, Artificial Sequence
  Description of Artificial Sequence: Synthetic oligonucleotide
  Target: ATXN1; (-) strand; PAM type: NRG; PAM sequence: GGG
caggagactcgcttgaaccc

SEQ ID NO: 39998 - DNA, 20 bp, Artificial Sequence
  Description of Artificial Sequence: Synthetic oligonucleotide
  Target: ATXN1; (-) strand; PAM type: NRG; PAM sequence: CGG
gcaggagactcgcttgaacc

SEQ ID NO: 39999 - DNA, 20 bp, Artificial Sequence
  Description of Artificial Sequence: Synthetic oligonucleotide
  Target: ATXN1; (-) strand; PAM type: NRG; PAM sequence: GAG
tacttgggagtctgaggcag

SEQ ID NO: 40000 - DNA, 20 bp, Artificial Sequence
  Description of Artificial Sequence: Synthetic oligonucleotide
  Target: ATXN1; (-) strand; PAM type: NRG; PAM sequence: AGG
gctacttgggagtctgaggc

SEQ ID NO: 40001 - DNA, 20 bp, Artificial Sequence
  Description of Artificial Sequence: Synthetic oligonucleotide
  Target: ATXN1; (-) strand; PAM type: NRG; PAM sequence: CAG
agctacttgggagtctgagg

SEQ ID NO: 40002 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggagtctg

SEQ ID NO: 40003 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggagtct

SEQ ID NO: 40004 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctacttgg

SEQ ID NO: 40005 - DNA, 20 bp, Artificial Sequence
  Description of Artificial Sequence: Synthetic oligonucleotide
  Target: ATXN1; (-) strand; PAM type: NRG; PAM sequence: GGG
acctgtagtcccagctactt

SEQ ID NO: 40006 - DNA, 20 bp, Artificial Sequence
  Description of Artificial Sequence: Synthetic oligonucleotide
  Target: ATXN1; (-) strand; PAM type: NRG; PAM sequence: TGG
tacctgtagtcccagctact

SEQ ID NO: 40007 - DNA, 20 bp, Artificial Sequence
  Description of Artificial Sequence: Synthetic oligonucleotide
  Target: ATXN1; (-) strand; PAM type: NRG; PAM sequence: CAG
gtggtgcatacctgtagtcc

SEQ ID NO: 40008 - DNA, 20 bp, Artificial Sequence
  Description of Artificial Sequence: Synthetic oligonucleotide
  Target: ATXN1; (-) strand; PAM type: NRG; PAM sequence: TAG
gtggtggtggtgcatacctg

SEQ ID NO: 40009 - DNA, 20 bp, Artificial Sequence
  Description of Artificial Sequence: Synthetic oligonucleotide
  Target: ATXN1; (-) strand; PAM type: NRG; PAM sequence: TGG
gtagctgggcgtggtggtgg

SEQ ID NO: 40010 - DNA, 20 bp, Artificial Sequence
  Description of Artificial Sequence: Synthetic oligonucleotide
  Target: ATXN1; (-) strand; PAM type: NRG; PAM sequence: TGG
aaagtagctgggcgtggtgg

SEQ ID NO: 40011 - DNA, 20 bp, Artificial Sequence
  Description of Artificial Sequence: Synthetic oligonucleotide
  Target: ATXN1; (-) strand; PAM type: NRG; PAM sequence: TGG
caaaaagtagctgggcgtgg

SEQ ID NO: 40012 - DNA, 20 bp, Artificial Sequence
  Description of Artificial Sequence: Synthetic oligonucleotide
  Target: ATXN1; (-) strand; PAM type: NRG; PAM sequence: TGG
atacaaaaagtagctgggcg

SEQ ID NO: 40013 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaagtagct

SEQ ID NO: 40014 - DNA, 20 bp, Artificial Sequence
  Description of Artificial Sequence: Synthetic oligonucleotide
  Target: ATXN1; (-) strand; PAM type: NRG; PAM sequence: TGG
ctaaaaatacaaaaagtagc

SEQ ID NO: 40015 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatacaaaaag

SEQ ID NO: 40016 - DNA, 20 bp, Artificial Sequence
  Description of Artificial Sequence: Synthetic oligonucleotide
  Target: ATXN1; (-) strand; PAM type: NRG; PAM sequence: AAG
cactctactaaaaatacaaa

SEQ ID NO: 40017 - DNA, 20 bp, Artificial Sequence
  Description of Artificial Sequence: Synthetic oligonucleotide
  Target: ATXN1; (-) strand; PAM type: NRG; PAM sequence: AAG
ccatcctggccaacatggtg

SEQ ID NO: 40018 - DNA, 20 bp, Artificial Sequence
  Description of Artificial Sequence: Synthetic oligonucleotide
  Target: ATXN1; (-) strand; PAM type: NRG; PAM sequence: TGG
cgagaccatcctggccaaca

SEQ ID NO: 40019 - DNA, 20 bp, Artificial Sequence
  Description of Artificial Sequence: Synthetic oligonucleotide
  Target: ATXN1; (-) strand; PAM type: NRG; PAM sequence: TGG
tcaggatatcgagaccatcc

SEQ ID NO: 40020 - DNA, 20 bp, Artificial Sequence
  Description of Artificial Sequence: Synthetic oligonucleotide
  Target: ATXN1; (-) strand; PAM type: NRG; PAM sequence: GAG
gatcatgaggtcaggatatc

SEQ ID NO: 40021 - DNA, 20 bp, Artificial Sequence
  Description of Artificial Sequence: Synthetic oligonucleotide
  Target: ATXN1; (-) strand; PAM type: NRG; PAM sequence: AGG
ggcgggtggatcatgaggtc

SEQ ID NO: 40022 - DNA, 20 bp, Artificial Sequence
  Description of Artificial Sequence: Synthetic oligonucleotide
  Target: ATXN1; (-) strand; PAM type: NRG; PAM sequence: CAG
aggcgggtggatcatgaggt

SEQ ID NO: 40023 - DNA, 20 bp, Artificial Sequence
  Description of Artificial Sequence: Synthetic oligonucleotide
  Target: ATXN1; (-) strand; PAM type: NRG; PAM sequence: AGG
actgaggcgggtggatcatg

SEQ ID NO: 40024 - DNA, 20 bp, Artificial Sequence
  Description of Artificial Sequence: Synthetic oligonucleotide
  Target: ATXN1; (-) strand; PAM type: NRG; PAM sequence: GAG
gactgaggcgggtggatcat

SEQ ID NO: 40025 - DNA, 20 bp, Artificial Sequence
  Description of Artificial Sequence: Synthetic oligonucleotide
  Target: ATXN1; (-) strand; PAM type: NRG; PAM sequence: TGG
ctttgggagactgaggcggg

SEQ ID NO: 40026 - DNA, 20 bp, Artificial Sequence
  Description of Artificial Sequence: Synthetic oligonucleotide
  Target: ATXN1; (-) strand; PAM type: NRG; PAM sequence: GGG
gcactttgggagactgaggc

SEQ ID NO: 40027 - DNA, 20 bp, Artificial Sequence
  Description of Artificial Sequence: Synthetic oligonucleotide
  Target: ATXN1; (-) strand; PAM type: NRG; PAM sequence: CGG
agcactttgggagactgagg

SEQ ID NO: 40028 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggagactg

SEQ ID NO: 40029 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggagact

SEQ ID NO: 40030 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 40031 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 40032 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 40033 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 40034 - DNA, 20 bp, Artificial Sequence
  Description of Artificial Sequence: Synthetic oligonucleotide
  Target: ATXN1; (-) strand; PAM type: NRG; PAM sequence: TGG
ccaatggaggcctgacacgg

SEQ ID NO: 40035 - DNA, 20 bp, Artificial Sequence
  Description of Artificial Sequence: Synthetic oligonucleotide
  Target: ATXN1; (-) strand; PAM type: NRG; PAM sequence: CGG
aatccaatggaggcctgaca

SEQ ID NO: 40036 - DNA, 20 bp, Artificial Sequence
  Description of Artificial Sequence: Synthetic oligonucleotide
  Target: ATXN1; (-) strand; PAM type: NRG; PAM sequence: AGG
atgtgtataaaatccaatgg

SEQ ID NO: 40037 - DNA, 20 bp, Artificial Sequence
  Description of Artificial Sequence: Synthetic oligonucleotide
  Target: ATXN1; (-) strand; PAM type: NRG; PAM sequence: GAG
aatgtgtataaaatccaatg

SEQ ID NO: 40038 - DNA, 20 bp, Artificial Sequence
  Description of Artificial Sequence: Synthetic oligonucleotide
  Target: ATXN1; (-) strand; PAM type: NRG; PAM sequence: TGG
tgaatgtgtataaaatccaa

SEQ ID NO: 40039 - DNA, 20 bp, Artificial Sequence
  Description of Artificial Sequence: Synthetic oligonucleotide
  Target: ATXN1; (-) strand; PAM type: NRG; PAM sequence: TGG
tactacttttaaagtttttt

SEQ ID NO: 40040 - DNA, 20 bp, Artificial Sequence
  Description of Artificial Sequence: Synthetic oligonucleotide
  Target: ATXN1; (-) strand; PAM type: NRG; PAM sequence: AAG
gtggaaatctactactttta

SEQ ID NO: 40041 - DNA, 20 bp, Artificial Sequence
  Description of Artificial Sequence: Synthetic oligonucleotide
  Target: ATXN1; (-) strand; PAM type: NRG; PAM sequence: TGG
agtagaaaagcaacaatctg

SEQ ID NO: 40042 - DNA, 20 bp, Artificial Sequence
  Description of Artificial Sequence: Synthetic oligonucleotide
  Target: ATXN1; (-) strand; PAM type: NRG; PAM sequence: AAG
acaaagaagatgaagtagaa

SEQ ID NO: 40043 - DNA, 20 bp, Artificial Sequence
  Description of Artificial Sequence: Synthetic oligonucleotide
  Target: ATXN1; (-) strand; PAM type: NRG; PAM sequence: TAG
aggaaacaaagaagatgaag

SEQ ID NO: 40044 - DNA, 20 bp, Artificial Sequence
  Description of Artificial Sequence: Synthetic oligonucleotide
  Target: ATXN1; (-) strand; PAM type: NRG; PAM sequence: AAG
caaaggaaacaaagaagatg

SEQ ID NO: 40045 - DNA, 20 bp, Artificial Sequence
  Description of Artificial Sequence: Synthetic oligonucleotide
  Target: ATXN1; (-) strand; PAM type: NRG; PAM sequence: AAG
agttaacaaaggaaacaaag

SEQ ID NO: 40046 - DNA, 20 bp, Artificial Sequence
  Description of Artificial Sequence: Synthetic oligonucleotide
  Target: ATXN1; (-) strand; PAM type: NRG; PAM sequence: AAG
cagagttaacaaaggaaaca

SEQ ID NO: 40047 - DNA, 20 bp, Artificial Sequence
  Description of Artificial Sequence: Synthetic oligonucleotide
  Target: ATXN1; (-) strand; PAM type: NRG; PAM sequence: AGG
agatcaatcagagttaacaa

SEQ ID NO: 40048 - DNA, 20 bp, Artificial Sequence
  Description of Artificial Sequence: Synthetic oligonucleotide
  Target: ATXN1; (-) strand; PAM type: NRG; PAM sequence: AAG
tagatcaatcagagttaaca

SEQ ID NO: 40049 - DNA, 20 bp, Artificial Sequence
  Description of Artificial Sequence: Synthetic oligonucleotide
  Target: ATXN1; (-) strand; PAM type: NRG; PAM sequence: GAG
tatcagaactagatcaatca

SEQ ID NO: 40050 - DNA, 20 bp, Artificial Sequence
  Description of Artificial Sequence: Synthetic oligonucleotide
  Target: ATXN1; (-) strand; PAM type: NRG; PAM sequence: CAG
tgtatcagaactagatcaat

SEQ ID NO: 40051 - DNA, 20 bp, Artificial Sequence
  Description of Artificial Sequence: Synthetic oligonucleotide
  Target: ATXN1; (-) strand; PAM type: NRG; PAM sequence: TAG
ttctagaaatgtatcagaac

SEQ ID NO: 40052 - DNA, 20 bp, Artificial Sequence
  Description of Artificial Sequence: Synthetic oligonucleotide
  Target: ATXN1; (-) strand; PAM type: NRG; PAM sequence: CAG
ctgtcattctagaaatgtat

SEQ ID NO: 40053 - DNA, 20 bp, Artificial Sequence
  Description of Artificial Sequence: Synthetic oligonucleotide
  Target: ATXN1; (-) strand; PAM type: NRG; PAM sequence: TAG
tccagtaaagtctgtcattc

SEQ ID NO: 40054 - DNA, 20 bp, Artificial Sequence
  Description of Artificial Sequence: Synthetic oligonucleotide
  Target: ATXN1; (-) strand; PAM type: NRG; PAM sequence: AAG
tgccttgtatggatccagta

SEQ ID NO: 40055 - DNA, 20 bp, Artificial Sequence
  Description of Artificial Sequence: Synthetic oligonucleotide
  Target: ATXN1; (-) strand; PAM type: NRG; PAM sequence: CAG
aaatatgccttgtatggatc

SEQ ID NO: 40056 - DNA, 20 bp, Artificial Sequence
  Description of Artificial Sequence: Synthetic oligonucleotide
  Target: ATXN1; (-) strand; PAM type: NRG; PAM sequence: TGG
ttctaaaaatatgccttgta

SEQ ID NO: 40057 - DNA, 20 bp, Artificial Sequence
  Description of Artificial Sequence: Synthetic oligonucleotide
  Target: ATXN1; (-) strand; PAM type: NRG; PAM sequence: AAG
gctgccatatgaatgtactc

SEQ ID NO: 40058 - DNA, 20 bp, Artificial Sequence
  Description of Artificial Sequence: Synthetic oligonucleotide
  Target: ATXN1; (-) strand; PAM type: NRG; PAM sequence: AAG
gagaaggggttcatgcttac

SEQ ID NO: 40059 - DNA, 20 bp, Artificial Sequence
  Description of Artificial Sequence: Synthetic oligonucleotide
  Target: ATXN1; (-) strand; PAM type: NRG; PAM sequence: GGG
agtaatacacacaggagaag

SEQ ID NO: 40060 - DNA, 20 bp, Artificial Sequence
  Description of Artificial Sequence: Synthetic oligonucleotide
  Target: ATXN1; (-) strand; PAM type: NRG; PAM sequence: GGG
cagtaatacacacaggagaa

SEQ ID NO: 40061 - DNA, 20 bp, Artificial Sequence
  Description of Artificial Sequence: Synthetic oligonucleotide
  Target: ATXN1; (-) strand; PAM type: NRG; PAM sequence: AGG
ccagtaatacacacaggaga

SEQ ID NO: 40062 - DNA, 20 bp, Artificial Sequence
  Description of Artificial Sequence: Synthetic oligonucleotide
  Target: ATXN1; (-) strand; PAM type: NRG; PAM sequence: AAG
cccagtaatacacacaggag

SEQ ID NO: 40063 - DNA, 20 bp, Artificial Sequence
  Description of Artificial Sequence: Synthetic oligonucleotide
  Target: ATXN1; (-) strand; PAM type: NRG; PAM sequence: GAG
tcccccagtaatacacacag

SEQ ID NO: 40064 - DNA, 20 bp, Artificial Sequence
  Description of Artificial Sequence: Synthetic oligonucleotide
  Target: ATXN1; (-) strand; PAM type: NRG; PAM sequence: AGG
tttcccccagtaatacacac

SEQ ID NO: 40065 - DNA, 20 bp, Artificial Sequence
  Description of Artificial Sequence: Synthetic oligonucleotide
  Target: ATXN1; (-) strand; PAM type: NRG; PAM sequence: CAG
ctttcccccagtaatacaca

SEQ ID NO: 40066 - DNA, 20 bp, Artificial Sequence
  Description of Artificial Sequence: Synthetic oligonucleotide
  Target: ATXN1; (-) strand; PAM type: NRG; PAM sequence: CAG
agaacaatgaaactttcccc

SEQ ID NO: 40067 - DNA, 20 bp, Artificial Sequence
  Description of Artificial Sequence: Synthetic oligonucleotide
  Target: ATXN1; (-) strand; PAM type: NRG; PAM sequence: CAG
ttcacattataaaaatagcc

SEQ ID NO: 40068 - DNA, 20 bp, Artificial Sequence
  Description of Artificial Sequence: Synthetic oligonucleotide
  Target: ATXN1; (-) strand; PAM type: NRG; PAM sequence: TAG
cttgcttcacattataaaaa

SEQ ID NO: 40069 - DNA, 20 bp, Artificial Sequence
  Description of Artificial Sequence: Synthetic oligonucleotide
  Target: ATXN1; (-) strand; PAM type: NRG; PAM sequence: TAG
agtaggcactcaaaaacttt

SEQ ID NO: 40070 - DNA, 20 bp, Artificial Sequence
  Description of Artificial Sequence: Synthetic oligonucleotide
  Target: ATXN1; (-) strand; PAM type: NRG; PAM sequence: AGG
ctgagagcttgacagagagt

SEQ ID NO: 40071 - DNA, 20 bp, Artificial Sequence
  Description of Artificial Sequence: Synthetic oligonucleotide
  Target: ATXN1; (-) strand; PAM type: NRG; PAM sequence: TAG
cctgagagcttgacagagag

SEQ ID NO: 40072 - DNA, 20 bp, Artificial Sequence
  Description of Artificial Sequence: Synthetic oligonucleotide
  Target: ATXN1; (-) strand; PAM type: NRG; PAM sequence: GAG
gtacctgagagcttgacaga

SEQ ID NO: 40073 - DNA, 20 bp, Artificial Sequence
  Description of Artificial Sequence: Synthetic oligonucleotide
  Target: ATXN1; (-) strand; PAM type: NRG; PAM sequence: GAG
ttgtacctgagagcttgaca

SEQ ID NO: 40074 - DNA, 20 bp, Artificial Sequence
  Description of Artificial Sequence: Synthetic oligonucleotide
  Target: ATXN1; (-) strand; PAM type: NRG; PAM sequence: CAG
gtttgtacctgagagcttga

SEQ ID NO: 40075 - DNA, 20 bp, Artificial Sequence
  Description of Artificial Sequence: Synthetic oligonucleotide
  Target: ATXN1; (-) strand; PAM type: NRG; PAM sequence: GAG
tttgtaaagtttgtacctga

SEQ ID NO: 40076 - DNA, 20 bp, Artificial Sequence
  Description of Artificial Sequence: Synthetic oligonucleotide
  Target: ATXN1; (-) strand; PAM type: NRG; PAM sequence: GAG
tttttgtaaagtttgtacct

SEQ ID NO: 40077 - DNA, 20 bp, Artificial Sequence
  Description of Artificial Sequence: Synthetic oligonucleotide
  Target: ATXN1; (-) strand; PAM type: NRG; PAM sequence: AAG
taaacaaaatactttttgta

SEQ ID NO: 40078 - DNA, 20 bp, Artificial Sequence
  Description of Artificial Sequence: Synthetic oligonucleotide
  Target: ATXN1; (-) strand; PAM type: NRG; PAM sequence: GAG
taaaatttacaaaattggaa

SEQ ID NO: 40079 - DNA, 20 bp, Artificial Sequence
  Description of Artificial Sequence: Synthetic oligonucleotide
  Target: ATXN1; (-) strand; PAM type: NRG; PAM sequence: AAG
cgtaaaatttacaaaattgg

SEQ ID NO: 40080 - DNA, 20 bp, Artificial Sequence
  Description of Artificial Sequence: Synthetic oligonucleotide
  Target: ATXN1; (-) strand; PAM type: NRG; PAM sequence: TGG
attcgtaaaatttacaaaat

SEQ ID NO: 40081 - DNA, 20 bp, Artificial Sequence
  Description of Artificial Sequence: Synthetic oligonucleotide
  Target: ATXN1; (-) strand; PAM type: NRG; PAM sequence: AAG
taatagctatgacattaggc

SEQ ID NO: 40082 - DNA, 20 bp, Artificial Sequence
  Description of Artificial Sequence: Synthetic oligonucleotide
  Target: ATXN1; (-) strand; PAM type: NRG; PAM sequence: AGG
tagctaatagctatgacatt

SEQ ID NO: 40083 - DNA, 20 bp, Artificial Sequence
  Description of Artificial Sequence: Synthetic oligonucleotide
  Target: ATXN1; (-) strand; PAM type: NRG; PAM sequence: TAG
ttagctaatagctatgacat

SEQ ID NO: 40084 - DNA, 20 bp, Artificial Sequence
  Description of Artificial Sequence: Synthetic oligonucleotide
  Target: ATXN1; (-) strand; PAM type: NRG; PAM sequence: TAG
atcctaaacccattagctaa

SEQ ID NO: 40085 - DNA, 20 bp, Artificial Sequence
  Description of Artificial Sequence: Synthetic oligonucleotide
  Target: ATXN1; (-) strand; PAM type: NRG; PAM sequence: TAG
ggataaaatcctaaacccat

SEQ ID NO: 40086 - DNA, 20 bp, Artificial Sequence
  Description of Artificial Sequence: Synthetic oligonucleotide
  Target: ATXN1; (-) strand; PAM type: NRG; PAM sequence: GGG
gggtttgggggccaatgact

SEQ ID NO: 40087 - DNA, 20 bp, Artificial Sequence
  Description of Artificial Sequence: Synthetic oligonucleotide
  Target: ATXN1; (-) strand; PAM type: NRG; PAM sequence: TGG
tgggtttgggggccaatgac

SEQ ID NO: 40088 - DNA, 20 bp, Artificial Sequence
  Description of Artificial Sequence: Synthetic oligonucleotide
  Target: ATXN1; (-) strand; PAM type: NRG; PAM sequence: GGG
aaaaaagaaaatgggtttgg

SEQ ID NO: 40089 - DNA, 20 bp, Artificial Sequence
  Description of Artificial Sequence: Synthetic oligonucleotide
  Target: ATXN1; (-) strand; PAM type: NRG; PAM sequence: GGG
gaaaaaagaaaatgggtttg

SEQ ID NO: 40090 - DNA, 20 bp, Artificial Sequence
  Description of Artificial Sequence: Synthetic oligonucleotide
  Target: ATXN1; (-) strand; PAM type: NRG; PAM sequence: GGG
agaaaaaagaaaatgggttt

SEQ ID NO: 40091 - DNA, 20 bp, Artificial Sequence
  Description of Artificial Sequence: Synthetic oligonucleotide
  Target: ATXN1; (-) strand; PAM type: NRG; PAM sequence: TGG
cagaaaaaagaaaatgggtt

SEQ ID NO: 40092 - DNA, 20 bp, Artificial Sequence
  Description of Artificial Sequence: Synthetic oligonucleotide
  Target: ATXN1; (-) strand; PAM type: NRG; PAM sequence: GGG
aggcacagaaaaaagaaaat

SEQ ID NO: 40093 - DNA, 20 bp, Artificial Sequence
  Description of Artificial Sequence: Synthetic oligonucleotide
  Target: ATXN1; (-) strand; PAM type: NRG; PAM sequence: TGG
gaggcacagaaaaaagaaaa

SEQ ID NO: 40094 - DNA, 20 bp, Artificial Sequence
  Description of Artificial Sequence: Synthetic oligonucleotide
  Target: ATXN1; (-) strand; PAM type: NRG; PAM sequence: AAG
aggtcaggaggcacagaaaa

SEQ ID NO: 40095 - DNA, 20 bp, Artificial Sequence
  Description of Artificial Sequence: Synthetic oligonucleotide
  Target: ATXN1; (-) strand; PAM type: NRG; PAM sequence: CAG
agggtagaggtcaggaggca

SEQ ID NO: 40096 - DNA, 20 bp, Artificial Sequence
  Description of Artificial Sequence: Synthetic oligonucleotide
  Target: ATXN1; (-) strand; PAM type: NRG; PAM sequence: AGG
tcacaagggtagaggtcagg

SEQ ID NO: 40097 - DNA, 20 bp, Artificial Sequence
  Description of Artificial Sequence: Synthetic oligonucleotide
  Target: ATXN1; (-) strand; PAM type: NRG; PAM sequence: GAG
ctcacaagggtagaggtcag

SEQ ID NO: 40098 - DNA, 20 bp, Artificial Sequence
  Description of Artificial Sequence: Synthetic oligonucleotide
  Target: ATXN1; (-) strand; PAM type: NRG; PAM sequence: AGG
tgctcacaagggtagaggtc

SEQ ID NO: 40099 - DNA, 20 bp, Artificial Sequence
  Description of Artificial Sequence: Synthetic oligonucleotide
  Target: ATXN1; (-) strand; PAM type: NRG; PAM sequence: CAG
ttgctcacaagggtagaggt

SEQ ID NO: 40100 - DNA, 20 bp, Artificial Sequence
  Description of Artificial Sequence: Synthetic oligonucleotide
  Target: ATXN1; (-) strand; PAM type: NRG; PAM sequence: AGG
gtctttgctcacaagggtag

SEQ ID NO: 40101 - DNA, 20 bp, Artificial Sequence
  Description of Artificial Sequence: Synthetic oligonucleotide
  Target: ATXN1; (-) strand; PAM type: NRG; PAM sequence: GAG
tgtctttgctcacaagggta

SEQ ID NO: 40102 - DNA, 20 bp, Artificial Sequence
  Description of Artificial Sequence: Synthetic oligonucleotide
  Target: ATXN1; (-) strand; PAM type: NRG; PAM sequence: TAG
aatgtctttgctcacaaggg

SEQ ID NO: 40103 - DNA, 20 bp, Artificial Sequence
  Description of Artificial Sequence: Synthetic oligonucleotide
  Target: ATXN1; (-) strand; PAM type: NRG; PAM sequence: GGG
tgtaatgtctttgctcacaa

SEQ ID NO: 40104 - DNA, 20 bp, Artificial Sequence
  Description of Artificial Sequence: Synthetic oligonucleotide
  Target: ATXN1; (-) strand; PAM type: NRG; PAM sequence: AGG
ttgtaatgtctttgctcaca

SEQ ID NO: 40105 - DNA, 20 bp, Artificial Sequence
  Description of Artificial Sequence: Synthetic oligonucleotide
  Target: ATXN1; (-) strand; PAM type: NRG; PAM sequence: AAG
attgtaatgtctttgctcac

SEQ ID NO: 40106 - DNA, 20 bp, Artificial Sequence
  Description of Artificial Sequence: Synthetic oligonucleotide
  Target: ATXN1; (-) strand; PAM type: NRG; PAM sequence: TGG
gcttagttcatctcttttgg

SEQ ID NO: 40107 - DNA, 20 bp, Artificial Sequence
  Description of Artificial Sequence: Synthetic oligonucleotide
  Target: ATXN1; (-) strand; PAM type: NRG; PAM sequence: TGG
aatgcttagttcatctcttt

SEQ ID NO: 40108 - DNA, 20 bp, Artificial Sequence
  Description of Artificial Sequence: Synthetic oligonucleotide
  Target: ATXN1; (-) strand; PAM type: NRG; PAM sequence: TAG
tggggggtagcaggaatgct

SEQ ID NO: 40109 - DNA, 20 bp, Artificial Sequence
  Description of Artificial Sequence: Synthetic oligonucleotide
  Target: ATXN1; (-) strand; PAM type: NRG; PAM sequence: AGG
caccactgttggggggtagc

SEQ ID NO: 40110 - DNA, 20 bp, Artificial Sequence
  Description of Artificial Sequence: Synthetic oligonucleotide
  Target: ATXN1; (-) strand; PAM type: NRG; PAM sequence: CAG
tcaccactgttggggggtag

SEQ ID NO: 40111 - DNA, 20 bp, Artificial Sequence
  Description of Artificial Sequence: Synthetic oligonucleotide
  Target: ATXN1; (-) strand; PAM type: NRG; PAM sequence: TAG
tattcaccactgttgggggg

SEQ ID NO: 40112 - DNA, 20 bp, Artificial Sequence
  Description of Artificial Sequence: Synthetic oligonucleotide
  Target: ATXN1; (-) strand; PAM type: NRG; PAM sequence: GGG
caatattcaccactgttggg

SEQ ID NO: 40113 - DNA, 20 bp, Artificial Sequence
  Description of Artificial Sequence: Synthetic oligonucleotide
  Target: ATXN1; (-) strand; PAM type: NRG; PAM sequence: GGG
tcaatattcaccactgttgg

SEQ ID NO: 40114 - DNA, 20 bp, Artificial Sequence
  Description of Artificial Sequence: Synthetic oligonucleotide
  Target: ATXN1; (-) strand; PAM type: NRG; PAM sequence: GGG
gtcaatattcaccactgttg

SEQ ID NO: 40115 - DNA, 20 bp, Artificial Sequence
  Description of Artificial Sequence: Synthetic oligonucleotide
  Target: ATXN1; (-) strand; PAM type: NRG; PAM sequence: GGG
agtcaatattcaccactgtt

SEQ ID NO: 40116 - DNA, 20 bp, Artificial Sequence
  Description of Artificial Sequence: Synthetic oligonucleotide
  Target: ATXN1; (-) strand; PAM type: NRG; PAM sequence: TGG
cagtcaatattcaccactgt

SEQ ID NO: 40117 - DNA, 20 bp, Artificial Sequence
  Description of Artificial Sequence: Synthetic oligonucleotide
  Target: ATXN1; (-) strand; PAM type: NRG; PAM sequence: CAG
cctttggatcctacttattt

SEQ ID NO: 40118 - DNA, 20 bp, Artificial Sequence
  Description of Artificial Sequence: Synthetic oligonucleotide
  Target: ATXN1; (-) strand; PAM type: NRG; PAM sequence: TGG
agcccatgagctcatgcctt

SEQ ID NO: 40119 - DNA, 20 bp, Artificial Sequence
  Description of Artificial Sequence: Synthetic oligonucleotide
  Target: ATXN1; (-) strand; PAM type: NRG; PAM sequence: GAG
gtaccatggaacaagcccat

SEQ ID NO: 40120 - DNA, 20 bp, Artificial Sequence
  Description of Artificial Sequence: Synthetic oligonucleotide
  Target: ATXN1; (-) strand; PAM type: NRG; PAM sequence: AAG
aattatctgtaccatggaac

SEQ ID NO: 40121 - DNA, 20 bp, Artificial Sequence
  Description of Artificial Sequence: Synthetic oligonucleotide
  Target: ATXN1; (-) strand; PAM type: NRG; PAM sequence: TGG
catcacaattatctgtacca

SEQ ID NO: 40122 - DNA, 20 bp, Artificial Sequence
  Description of Artificial Sequence: Synthetic oligonucleotide
  Target: ATXN1; (-) strand; PAM type: NRG; PAM sequence: AGG
gaattgtatgagtggctata

SEQ ID NO: 40123 - DNA, 20 bp, Artificial Sequence
  Description of Artificial Sequence: Synthetic oligonucleotide
  Target: ATXN1; (-) strand; PAM type: NRG; PAM sequence: AAG
agaattgtatgagtggctat

SEQ ID NO: 40124 - DNA, 20 bp, Artificial Sequence
  Description of Artificial Sequence: Synthetic oligonucleotide
  Target: ATXN1; (-) strand; PAM type: NRG; PAM sequence: TGG
ggtaactagaattgtatgag

SEQ ID NO: 40125 - DNA, 20 bp, Artificial Sequence
  Description of Artificial Sequence: Synthetic oligonucleotide
  Target: ATXN1; (-) strand; PAM type: NRG; PAM sequence: GAG
cagggtaactagaattgtat

SEQ ID NO: 40126 - DNA, 20 bp, Artificial Sequence
  Description of Artificial Sequence: Synthetic oligonucleotide
  Target: ATXN1; (-) strand; PAM type: NRG; PAM sequence: TAG
acacacttgtacagggtaac

SEQ ID NO: 40127 - DNA, 20 bp, Artificial Sequence
  Description of Artificial Sequence: Synthetic oligonucleotide
  Target: ATXN1; (-) strand; PAM type: NRG; PAM sequence: GGG
tagtgtcacacacttgtaca

SEQ ID NO: 40128 - DNA, 20 bp, Artificial Sequence
  Description of Artificial Sequence: Synthetic oligonucleotide
  Target: ATXN1; (-) strand; PAM type: NRG; PAM sequence: AGG
atagtgtcacacacttgtac

SEQ ID NO: 40129 - DNA, 20 bp, Artificial Sequence
  Description of Artificial Sequence: Synthetic oligonucleotide
  Target: ATXN1; (-) strand; PAM type: NRG; PAM sequence: CAG
aatagtgtcacacacttgta

SEQ ID NO: 40130 - DNA, 20 bp, Artificial Sequence
  Description of Artificial Sequence: Synthetic oligonucleotide
  Target: ATXN1; (-) strand; PAM type: NRG; PAM sequence: TAG
aatgtagttttgaaaccaaa

SEQ ID NO: 40131 - DNA, 20 bp, Artificial Sequence
  Description of Artificial Sequence: Synthetic oligonucleotide
  Target: ATXN1; (-) strand; PAM type: NRG; PAM sequence: TAG
ttctgtgtgtgatgtaaatg

SEQ ID NO: 40132 - DNA, 20 bp, Artificial Sequence
  Description of Artificial Sequence: Synthetic oligonucleotide
  Target: ATXN1; (-) strand; PAM type: NRG; PAM sequence: AAG
catctgatacagtcacttgt

SEQ ID NO: 40133 - DNA, 20 bp, Artificial Sequence
  Description of Artificial Sequence: Synthetic oligonucleotide
  Target: ATXN1; (-) strand; PAM type: NRG; PAM sequence: CAG
gtgggtatccccatctgata

SEQ ID NO: 40134 - DNA, 20 bp, Artificial Sequence
  Description of Artificial Sequence: Synthetic oligonucleotide
  Target: ATXN1; (-) strand; PAM type: NRG; PAM sequence: GGG
cctcctacttagaatacagt

SEQ ID NO: 40135 - DNA, 20 bp, Artificial Sequence
  Description of Artificial Sequence: Synthetic oligonucleotide
  Target: ATXN1; (-) strand; PAM type: NRG; PAM sequence: TGG
tcctcctacttagaatacag

SEQ ID NO: 40136 - DNA, 20 bp, Artificial Sequence
  Description of Artificial Sequence: Synthetic oligonucleotide
  Target: ATXN1; (-) strand; PAM type: NRG; PAM sequence: CAG
tggtcctcctacttagaata

SEQ ID NO: 40137 - DNA, 20 bp, Artificial Sequence
  Description of Artificial Sequence: Synthetic oligonucleotide
  Target: ATXN1; (-) strand; PAM type: NRG; PAM sequence: TAG
tccagattggtcctcctact

SEQ ID NO: 40138 - DNA, 20 bp, Artificial Sequence
  Description of Artificial Sequence: Synthetic oligonucleotide
  Target: ATXN1; (-) strand; PAM type: NRG; PAM sequence: TGG
ctatggagccagttccagat

SEQ ID NO: 40139 - DNA, 20 bp, Artificial Sequence
  Description of Artificial Sequence: Synthetic oligonucleotide
  Target: ATXN1; (-) strand; PAM type: NRG; PAM sequence: CAG
aggatctatggagccagttc

SEQ ID NO: 40140 - DNA, 20 bp, Artificial Sequence
  Description of Artificial Sequence: Synthetic oligonucleotide
  Target: ATXN1; (-) strand; PAM type: NRG; PAM sequence: CAG
tgcaagaggatctatggagc

SEQ ID NO: 40141 - DNA, 20 bp, Artificial Sequence
  Description of Artificial Sequence: Synthetic oligonucleotide
  Target: ATXN1; (-) strand; PAM type: NRG; PAM sequence: GAG
ggtttgcaagaggatctatg

SEQ ID NO: 40142 - DNA, 20 bp, Artificial Sequence
  Description of Artificial Sequence: Synthetic oligonucleotide
  Target: ATXN1; (-) strand; PAM type: NRG; PAM sequence: TGG
gaggtttgcaagaggatcta

SEQ ID NO: 40143 - DNA, 20 bp, Artificial Sequence
  Description of Artificial Sequence: Synthetic oligonucleotide
  Target: ATXN1; (-) strand; PAM type: NRG; PAM sequence: AGG
gactctaagaggtttgcaag

SEQ ID NO: 40144 - DNA, 20 bp, Artificial Sequence
  Description of Artificial Sequence: Synthetic oligonucleotide
  Target: ATXN1; (-) strand; PAM type: NRG; PAM sequence: GAG
tgactctaagaggtttgcaa

SEQ ID NO: 40145 - DNA, 20 bp, Artificial Sequence
  Description of Artificial Sequence: Synthetic oligonucleotide
  Target: ATXN1; (-) strand; PAM type: NRG; PAM sequence: AAG
aatgactctaagaggtttgc

SEQ ID NO: 40146 - DNA, 20 bp, Artificial Sequence
  Description of Artificial Sequence: Synthetic oligonucleotide
  Target: ATXN1; (-) strand; PAM type: NRG; PAM sequence: AGG
atgttgttaatgactctaag

SEQ ID NO: 40147 - DNA, 20 bp, Artificial Sequence
  Description of Artificial Sequence: Synthetic oligonucleotide
  Target: ATXN1; (-) strand; PAM type: NRG; PAM sequence: GAG
tatgttgttaatgactctaa

SEQ ID NO: 40148 - DNA, 20 bp, Artificial Sequence
  Description of Artificial Sequence: Synthetic oligonucleotide
  Target: ATXN1; (-) strand; PAM type: NRG; PAM sequence: AAG
tttatgttgttaatgactct

SEQ ID NO: 40149 - DNA, 20 bp, Artificial Sequence
  Description of Artificial Sequence: Synthetic oligonucleotide
  Target: ATXN1; (-) strand; PAM type: NRG; PAM sequence: CAG
gggattggtttccttctgtt

SEQ ID NO: 40150 - DNA, 20 bp, Artificial Sequence
  Description of Artificial Sequence: Synthetic oligonucleotide
  Target: ATXN1; (-) strand; PAM type: NRG; PAM sequence: TGG
atctccacttgatgtgggat

SEQ ID NO: 40151 - DNA, 20 bp, Artificial Sequence
  Description of Artificial Sequence: Synthetic oligonucleotide
  Target: ATXN1; (-) strand; PAM type: NRG; PAM sequence: GGG
aaacaatctccacttgatgt

SEQ ID NO: 40152 - DNA, 20 bp, Artificial Sequence
  Description of Artificial Sequence: Synthetic oligonucleotide
  Target: ATXN1; (-) strand; PAM type: NRG; PAM sequence: TGG
aaaacaatctccacttgatg

SEQ ID NO: 40153 - DNA, 20 bp, Artificial Sequence
  Description of Artificial Sequence: Synthetic oligonucleotide
  Target: ATXN1; (-) strand; PAM type: NRG; PAM sequence: CAG
atttttatgacttggatttg

SEQ ID NO: 40154 - DNA, 20 bp, Artificial Sequence
  Description of Artificial Sequence: Synthetic oligonucleotide
  Target: ATXN1; (-) strand; PAM type: NRG; PAM sequence: TGG
agagttttatttttatgact

SEQ ID NO: 40155 - DNA, 20 bp, Artificial Sequence
  Description of Artificial Sequence: Synthetic oligonucleotide
  Target: ATXN1; (-) strand; PAM type: NRG; PAM sequence: GAG
agacagatgttaacacctga

SEQ ID NO: 40156 - DNA, 20 bp, Artificial Sequence
  Description of Artificial Sequence: Synthetic oligonucleotide
  Target: ATXN1; (-) strand; PAM type: NRG; PAM sequence: GAG
cgagacagatgttaacacct

SEQ ID NO: 40157 - DNA, 20 bp, Artificial Sequence
  Description of Artificial Sequence: Synthetic oligonucleotide
  Target: ATXN1; (-) strand; PAM type: NRG; PAM sequence: CAG
tggtagagagtcttacgaga

SEQ ID NO: 40158 - DNA, 20 bp, Artificial Sequence
  Description of Artificial Sequence: Synthetic oligonucleotide
  Target: ATXN1; (-) strand; PAM type: NRG; PAM sequence: GAG
actctggtagagagtcttac

SEQ ID NO: 40159 - DNA, 20 bp, Artificial Sequence
  Description of Artificial Sequence: Synthetic oligonucleotide
  Target: ATXN1; (-) strand; PAM type: NRG; PAM sequence: GAG
caaaccgcaactctggtaga

SEQ ID NO: 40160 - DNA, 20 bp, Artificial Sequence
  Description of Artificial Sequence: Synthetic oligonucleotide
  Target: ATXN1; (-) strand; PAM type: NRG; PAM sequence: GAG
agcaaaccgcaactctggta

SEQ ID NO: 40161 - DNA, 20 bp, Artificial Sequence
  Description of Artificial Sequence: Synthetic oligonucleotide
  Target: ATXN1; (-) strand; PAM type: NRG; PAM sequence: TAG
taagcaaaccgcaactctgg

SEQ ID NO: 40162 - DNA, 20 bp, Artificial Sequence
  Description of Artificial Sequence: Synthetic oligonucleotide
  Target: ATXN1; (-) strand; PAM type: NRG; PAM sequence: TGG
gaataagcaaaccgcaactc

SEQ ID NO: 40163 - DNA, 20 bp, Artificial Sequence
  Description of Artificial Sequence: Synthetic oligonucleotide
  Target: ATXN1; (-) strand; PAM type: NRG; PAM sequence: AAG
gcctggtgttgggcaagaat

SEQ ID NO: 40164 - DNA, 20 bp, Artificial Sequence
  Description of Artificial Sequence: Synthetic oligonucleotide
  Target: ATXN1; (-) strand; PAM type: NRG; PAM sequence: AAG
acctctgcctggtgttgggc

SEQ ID NO: 40165 - DNA, 20 bp, Artificial Sequence
  Description of Artificial Sequence: Synthetic oligonucleotide
  Target: ATXN1; (-) strand; PAM type: NRG; PAM sequence: GGG
cattacctctgcctggtgtt

SEQ ID NO: 40166 - DNA, 20 bp, Artificial Sequence
  Description of Artificial Sequence: Synthetic oligonucleotide
  Target: ATXN1; (-) strand; PAM type: NRG; PAM sequence: TGG
acattacctctgcctggtgt

SEQ ID NO: 40167 - DNA, 20 bp, Artificial Sequence
  Description of Artificial Sequence: Synthetic oligonucleotide
  Target: ATXN1; (-) strand; PAM type: NRG; PAM sequence: TGG
aatgtcacattacctctgcc

SEQ ID NO: 40168 - DNA, 20 bp, Artificial Sequence
  Description of Artificial Sequence: Synthetic oligonucleotide
  Target: ATXN1; (-) strand; PAM type: NRG; PAM sequence: TGG
atgtttggaactaaggcttc

SEQ ID NO: 40169 - DNA, 20 bp, Artificial Sequence
  Description of Artificial Sequence: Synthetic oligonucleotide
  Target: ATXN1; (-) strand; PAM type: NRG; PAM sequence: AGG
ggctgacatgtttggaacta

SEQ ID NO: 40170 - DNA, 20 bp, Artificial Sequence
  Description of Artificial Sequence: Synthetic oligonucleotide
  Target: ATXN1; (-) strand; PAM type: NRG; PAM sequence: AAG
aggctgacatgtttggaact

SEQ ID NO: 40171 - DNA, 20 bp, Artificial Sequence
  Description of Artificial Sequence: Synthetic oligonucleotide
  Target: ATXN1; (-) strand; PAM type: NRG; PAM sequence: TGG
agaaaagaggctgacatgtt

SEQ ID NO: 40172 - DNA, 20 bp, Artificial Sequence
  Description of Artificial Sequence: Synthetic oligonucleotide
  Target: ATXN1; (-) strand; PAM type: NRG; PAM sequence: AGG
aacacgcagaaccagaaaag

SEQ ID NO: 40173 - DNA, 20 bp, Artificial Sequence
  Description of Artificial Sequence: Synthetic oligonucleotide
  Target: ATXN1; (-) strand; PAM type: NRG; PAM sequence: GAG
gaacacgcagaaccagaaaa

SEQ ID NO: 40174 - DNA, 20 bp, Artificial Sequence
  Description of Artificial Sequence: Synthetic oligonucleotide
  Target: ATXN1; (-) strand; PAM type: NRG; PAM sequence: AAG
gggaacacgcagaaccagaa

SEQ ID NO: 40175 - DNA, 20 bp, Artificial Sequence
  Description of Artificial Sequence: Synthetic oligonucleotide
  Target: ATXN1; (-) strand; PAM type: NRG; PAM sequence: CAG
tatccgggaacacgcagaac

SEQ ID NO: 40176 - DNA, 20 bp, Artificial Sequence
  Description of Artificial Sequence: Synthetic oligonucleotide
  Target: ATXN1; (-) strand; PAM type: NRG; PAM sequence: CAG
gggagttatccgggaacacg

SEQ ID NO: 40177 - DNA, 20 bp, Artificial Sequence
  Description of Artificial Sequence: Synthetic oligonucleotide
  Target: ATXN1; (-) strand; PAM type: NRG; PAM sequence: GGG
aaggagacagggagttatcc

SEQ ID NO: 40178 - DNA, 20 bp, Artificial Sequence
  Description of Artificial Sequence: Synthetic oligonucleotide
  Target: ATXN1; (-) strand; PAM type: NRG; PAM sequence: CGG
caaggagacagggagttatc

SEQ ID NO: 40179 - DNA, 20 bp, Artificial Sequence
  Description of Artificial Sequence: Synthetic oligonucleotide
  Target: ATXN1; (-) strand; PAM type: NRG; PAM sequence: GAG
tctgccagcaaggagacagg

SEQ ID NO: 40180 - DNA, 20 bp, Artificial Sequence
  Description of Artificial Sequence: Synthetic oligonucleotide
  Target: ATXN1; (-) strand; PAM type: NRG; PAM sequence: GGG
catctgccagcaaggagaca

SEQ ID NO: 40181 - DNA, 20 bp, Artificial Sequence
  Description of Artificial Sequence: Synthetic oligonucleotide
  Target: ATXN1; (-) strand; PAM type: NRG; PAM sequence: AGG
ccatctgccagcaaggagac

SEQ ID NO: 40182 - DNA, 20 bp, Artificial Sequence
  Description of Artificial Sequence: Synthetic oligonucleotide
  Target: ATXN1; (-) strand; PAM type: NRG; PAM sequence: CAG
gccatctgccagcaaggaga

SEQ ID NO: 40183 - DNA, 20 bp, Artificial Sequence
  Description of Artificial Sequence: Synthetic oligonucleotide
  Target: ATXN1; (-) strand; PAM type: NRG; PAM sequence: GAG
tccggccatctgccagcaag

SEQ ID NO: 40184 - DNA, 20 bp, Artificial Sequence
  Description of Artificial Sequence: Synthetic oligonucleotide
  Target: ATXN1; (-) strand; PAM type: NRG; PAM sequence: AGG
tgtccggccatctgccagca

SEQ ID NO: 40185 - DNA, 20 bp, Artificial Sequence
  Description of Artificial Sequence: Synthetic oligonucleotide
  Target: ATXN1; (-) strand; PAM type: NRG; PAM sequence: AAG
gtgtccggccatctgccagc

SEQ ID NO: 40186 - DNA, 20 bp, Artificial Sequence
  Description of Artificial Sequence: Synthetic oligonucleotide
  Target: ATXN1; (-) strand; PAM type: NRG; PAM sequence: CAG
gtaggtgtccggccatctgc

SEQ ID NO: 40187 - DNA, 20 bp, Artificial Sequence
  Description of Artificial Sequence: Synthetic oligonucleotide
  Target: ATXN1; (-) strand; PAM type: NRG; PAM sequence: CGG
cctctccatgggtaggtgtc

SEQ ID NO: 40188 - DNA, 20 bp, Artificial Sequence
  Description of Artificial Sequence: Synthetic oligonucleotide
  Target: ATXN1; (-) strand; PAM type: NRG; PAM sequence: AGG
ccaagggcctctccatgggt

SEQ ID NO: 40189 - DNA, 20 bp, Artificial Sequence
  Description of Artificial Sequence: Synthetic oligonucleotide
  Target: ATXN1; (-) strand; PAM type: NRG; PAM sequence: TAG
accaagggcctctccatggg

SEQ ID NO: 40190 - DNA, 20 bp, Artificial Sequence
  Description of Artificial Sequence: Synthetic oligonucleotide
  Target: ATXN1; (-) strand; PAM type: NRG; PAM sequence: GGG
cacaccaagggcctctccat

SEQ ID NO: 40191 - DNA, 20 bp, Artificial Sequence
  Description of Artificial Sequence: Synthetic oligonucleotide
  Target: ATXN1; (-) strand; PAM type: NRG; PAM sequence: TGG
acacaccaagggcctctcca

SEQ ID NO: 40192 - DNA, 20 bp, Artificial Sequence
  Description of Artificial Sequence: Synthetic oligonucleotide
  Target: ATXN1; (-) strand; PAM type: NRG; PAM sequence: GGG
taatgtggctcacacaccaa

SEQ ID NO: 40193 - DNA, 20 bp, Artificial Sequence
  Description of Artificial Sequence: Synthetic oligonucleotide
  Target: ATXN1; (-) strand; PAM type: NRG; PAM sequence: AGG
ataatgtggctcacacacca

SEQ ID NO: 40194 - DNA, 20 bp, Artificial Sequence
  Description of Artificial Sequence: Synthetic oligonucleotide
  Target: ATXN1; (-) strand; PAM type: NRG; PAM sequence: AAG
tataatgtggctcacacacc

SEQ ID NO: 40195 - DNA, 20 bp, Artificial Sequence
  Description of Artificial Sequence: Synthetic oligonucleotide
  Target: ATXN1; (-) strand; PAM type: NRG; PAM sequence: TGG
cctgtgaagtgtgtataatg

SEQ ID NO: 40196 - DNA, 20 bp, Artificial Sequence
  Description of Artificial Sequence: Synthetic oligonucleotide
  Target: ATXN1; (-) strand; PAM type: NRG; PAM sequence: AAG
taaatattgcctgccctgtg

SEQ ID NO: 40197 - DNA, 20 bp, Artificial Sequence
  Description of Artificial Sequence: Synthetic oligonucleotide
  Target: ATXN1; (-) strand; PAM type: NRG; PAM sequence: CAG
aacacagtagatgttatttt

SEQ ID NO: 40198 - DNA, 20 bp, Artificial Sequence
  Description of Artificial Sequence: Synthetic oligonucleotide
  Target: ATXN1; (-) strand; PAM type: NRG; PAM sequence: TAG
gtttacctatgagaacacag

SEQ ID NO: 40199 - DNA, 20 bp, Artificial Sequence
  Description of Artificial Sequence: Synthetic oligonucleotide
  Target: ATXN1; (-) strand; PAM type: NRG; PAM sequence: CAG
taagtttacctatgagaaca

SEQ ID NO: 40200 - DNA, 20 bp, Artificial Sequence
  Description of Artificial Sequence: Synthetic oligonucleotide
  Target: ATXN1; (-) strand; PAM type: NRG; PAM sequence: GAG
cctcagataagtttacctat

SEQ ID NO: 40201 - DNA, 20 bp, Artificial Sequence
  Description of Artificial Sequence: Synthetic oligonucleotide
  Target: ATXN1; (-) strand; PAM type: NRG; PAM sequence: AAG
taacgtggaaatcctcagat

SEQ ID NO: 40202 - DNA, 20 bp, Artificial Sequence
  Description of Artificial Sequence: Synthetic oligonucleotide
  Target: ATXN1; (-) strand; PAM type: NRG; PAM sequence: CAG
cttggtaacgtggaaatcct

SEQ ID NO: 40203 - DNA, 20 bp, Artificial Sequence
  Description of Artificial Sequence: Synthetic oligonucleotide
  Target: ATXN1; (-) strand; PAM type: NRG; PAM sequence: TGG
tctacagatacttggtaacg

SEQ ID NO: 40204 - DNA, 20 bp, Artificial Sequence
  Description of Artificial Sequence: Synthetic oligonucleotide
  Target: ATXN1; (-) strand; PAM type: NRG; PAM sequence: TGG
ttaatgagtctacagatact

SEQ ID NO: 40205 - DNA, 20 bp, Artificial Sequence
  Description of Artificial Sequence: Synthetic oligonucleotide
  Target: ATXN1; (-) strand; PAM type: NRG; PAM sequence: CAG
gacatttcttaatgagtcta

SEQ ID NO: 40206 - DNA, 20 bp, Artificial Sequence
  Description of Artificial Sequence: Synthetic oligonucleotide
  Target: ATXN1; (-) strand; PAM type: NRG; PAM sequence: GAG
gcttgtagacatttcttaat

SEQ ID NO: 40207 - DNA, 20 bp, Artificial Sequence
  Description of Artificial Sequence: Synthetic oligonucleotide
  Target: ATXN1; (-) strand; PAM type: NRG; PAM sequence: TAG
tacctgttataaagggcttg

SEQ ID NO: 40208 - DNA, 20 bp, Artificial Sequence
  Description of Artificial Sequence: Synthetic oligonucleotide
  Target: ATXN1; (-) strand; PAM type: NRG; PAM sequence: GGG
attatagtacctgttataaa

SEQ ID NO: 40209 - DNA, 20 bp, Artificial Sequence
  Description of Artificial Sequence: Synthetic oligonucleotide
  Target: ATXN1; (-) strand; PAM type: NRG; PAM sequence: AGG
aattatagtacctgttataa

SEQ ID NO: 40210 - DNA, 20 bp, Artificial Sequence
  Description of Artificial Sequence: Synthetic oligonucleotide
  Target: ATXN1; (-) strand; PAM type: NRG; PAM sequence: AAG
caattatagtacctgttata

SEQ ID NO: 40211 - DNA, 20 bp, Artificial Sequence
  Description of Artificial Sequence: Synthetic oligonucleotide
  Target: ATXN1; (-) strand; PAM type: NRG; PAM sequence: TAG
acttttgcactaatcaatta

SEQ ID NO: 40212 - DNA, 20 bp, Artificial Sequence
  Description of Artificial Sequence: Synthetic oligonucleotide
  Target: ATXN1; (-) strand; PAM type: NRG; PAM sequence: GGG
aacattatgaagtctttaga

SEQ ID NO: 40213 - DNA, 20 bp, Artificial Sequence
  Description of Artificial Sequence: Synthetic oligonucleotide
  Target: ATXN1; (-) strand; PAM type: NRG; PAM sequence: AGG
taacattatgaagtctttag

SEQ ID NO: 40214 - DNA, 20 bp, Artificial Sequence
  Description of Artificial Sequence: Synthetic oligonucleotide
  Target: ATXN1; (-) strand; PAM type: NRG; PAM sequence: GAG
ataacattatgaagtcttta

SEQ ID NO: 40215 - DNA, 20 bp, Artificial Sequence
  Description of Artificial Sequence: Synthetic oligonucleotide
  Target: ATXN1; (-) strand; PAM type: NRG; PAM sequence: TAG
caataacattatgaagtctt

SEQ ID NO: 40216 - DNA, 20 bp, Artificial Sequence
  Description of Artificial Sequence: Synthetic oligonucleotide
  Target: ATXN1; (-) strand; PAM type: NRG; PAM sequence: AAG
aaatgtccaataacattatg

SEQ ID NO: 40217 - DNA, 20 bp, Artificial Sequence
  Description of Artificial Sequence: Synthetic oligonucleotide
  Target: ATXN1; (-) strand; PAM type: NRG; PAM sequence: AGG
tgagatgcggaaataatgaa

SEQ ID NO: 40218 - DNA, 20 bp, Artificial Sequence
  Description of Artificial Sequence: Synthetic oligonucleotide
  Target: ATXN1; (-) strand; PAM type: NRG; PAM sequence: AAG
ttgagatgcggaaataatga

SEQ ID NO: 40219 - DNA, 20 bp, Artificial Sequence
  Description of Artificial Sequence: Synthetic oligonucleotide
  Target: ATXN1; (-) strand; PAM type: NRG; PAM sequence: CGG
gtctttggagttttgagatg

SEQ ID NO: 40220 - DNA, 20 bp, Artificial Sequence
  Description of Artificial Sequence: Synthetic oligonucleotide
  Target: ATXN1; (-) strand; PAM type: NRG; PAM sequence: GAG
agtggtgtctttggagtttt

SEQ ID NO: 40221 - DNA, 20 bp, Artificial Sequence
  Description of Artificial Sequence: Synthetic oligonucleotide
  Target: ATXN1; (-) strand; PAM type: NRG; PAM sequence: GAG
ttacaagagtggtgtctttg

SEQ ID NO: 40222 - DNA, 20 bp, Artificial Sequence
  Description of Artificial Sequence: Synthetic oligonucleotide
  Target: ATXN1; (-) strand; PAM type: NRG; PAM sequence: TGG
gattacaagagtggtgtctt

SEQ ID NO: 40223 - DNA, 20 bp, Artificial Sequence
  Description of Artificial Sequence: Synthetic oligonucleotide
  Target: ATXN1; (-) strand; PAM type: NRG; PAM sequence: TGG
aagtgctgggattacaagag

SEQ ID NO: 40224 - DNA, 20 bp, Artificial Sequence
  Description of Artificial Sequence: Synthetic oligonucleotide
  Target: ATXN1; (-) strand; PAM type: NRG; PAM sequence: GAG
ccaaagtgctgggattacaa

SEQ ID NO: 40225 - DNA, 20 bp, Artificial Sequence
  Description of Artificial Sequence: Synthetic oligonucleotide
  Target: ATXN1; (-) strand; PAM type: NRG; PAM sequence: AAG
tcccaaagtgctgggattac

SEQ ID NO: 40226 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 40227 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccaaagtgc

SEQ ID NO: 40228 - DNA, 20 bp, Artificial Sequence
  Description of Artificial Sequence: Synthetic oligonucleotide
  Target: ATXN1; (-) strand; PAM type: NRG; PAM sequence: AAG
aattgtacctcagcctccca

SEQ ID NO: 40229 - DNA, 20 bp, Artificial Sequence
  Description of Artificial Sequence: Synthetic oligonucleotide
  Target: ATXN1; (-) strand; PAM type: NRG; PAM sequence: CAG
gctatttcacaattgtacct

SEQ ID NO: 40230 - DNA, 20 bp, Artificial Sequence
  Description of Artificial Sequence: Synthetic oligonucleotide
  Target: ATXN1; (-) strand; PAM type: NRG; PAM sequence: TAG
cctttaaacaaaaatggagt

SEQ ID NO: 40231 - DNA, 20 bp, Artificial Sequence
  Description of Artificial Sequence: Synthetic oligonucleotide
  Target: ATXN1; (-) strand; PAM type: NRG; PAM sequence: GAG
aaaccctttaaacaaaaatg

SEQ ID NO: 40232 - DNA, 20 bp, Artificial Sequence
  Description of Artificial Sequence: Synthetic oligonucleotide
  Target: ATXN1; (-) strand; PAM type: NRG; PAM sequence: TGG
taaaaccctttaaacaaaaa

SEQ ID NO: 40233 - DNA, 20 bp, Artificial Sequence
  Description of Artificial Sequence: Synthetic oligonucleotide
  Target: ATXN1; (-) strand; PAM type: NRG; PAM sequence: GGG
cctagcctacgtgcaggaaa

SEQ ID NO: 40234 - DNA, 20 bp, Artificial Sequence
  Description of Artificial Sequence: Synthetic oligonucleotide
  Target: ATXN1; (-) strand; PAM type: NRG; PAM sequence: AGG
tcctagcctacgtgcaggaa

SEQ ID NO: 40235 - DNA, 20 bp, Artificial Sequence
  Description of Artificial Sequence: Synthetic oligonucleotide
  Target: ATXN1; (-) strand; PAM type: NRG; PAM sequence: AAG
atcctagcctacgtgcagga

SEQ ID NO: 40236 - DNA, 20 bp, Artificial Sequence
  Description of Artificial Sequence: Synthetic oligonucleotide
  Target: ATXN1; (-) strand; PAM type: NRG; PAM sequence: AGG
aattatcctagcctacgtgc

SEQ ID NO: 40237 - DNA, 20 bp, Artificial Sequence
  Description of Artificial Sequence: Synthetic oligonucleotide
  Target: ATXN1; (-) strand; PAM type: NRG; PAM sequence: CAG
aaattatcctagcctacgtg

SEQ ID NO: 40238 - DNA, 20 bp, Artificial Sequence
  Description of Artificial Sequence: Synthetic oligonucleotide
  Target: ATXN1; (-) strand; PAM type: NRG; PAM sequence: TAG
tcggtgccataaaattatcc

SEQ ID NO: 40239 - DNA, 20 bp, Artificial Sequence
  Description of Artificial Sequence: Synthetic oligonucleotide
  Target: ATXN1; (-) strand; PAM type: NRG; PAM sequence: CGG
gttgtttgtgtatattatct

SEQ ID NO: 40240 - DNA, 20 bp, Artificial Sequence
  Description of Artificial Sequence: Synthetic oligonucleotide
  Target: ATXN1; (-) strand; PAM type: NRG; PAM sequence: AAG
atcccagagttagtttctaa

SEQ ID NO: 40241 - DNA, 20 bp, Artificial Sequence
  Description of Artificial Sequence: Synthetic oligonucleotide
  Target: ATXN1; (-) strand; PAM type: NRG; PAM sequence: TAG
ttcccctttaatcccagagt

SEQ ID NO: 40242 - DNA, 20 bp, Artificial Sequence
  Description of Artificial Sequence: Synthetic oligonucleotide
  Target: ATXN1; (-) strand; PAM type: NRG; PAM sequence: GAG
atacttcccctttaatccca

SEQ ID NO: 40243 - DNA, 20 bp, Artificial Sequence
  Description of Artificial Sequence: Synthetic oligonucleotide
  Target: ATXN1; (-) strand; PAM type: NRG; PAM sequence: CAG
atatacttcccctttaatcc

SEQ ID NO: 40244 - DNA, 20 bp, Artificial Sequence
  Description of Artificial Sequence: Synthetic oligonucleotide
  Target: ATXN1; (-) strand; PAM type: NRG; PAM sequence: TAG
agtctttaacaatatatagt

SEQ ID NO: 40245 - DNA, 20 bp, Artificial Sequence
  Description of Artificial Sequence: Synthetic oligonucleotide
  Target: ATXN1; (-) strand; PAM type: NRG; PAM sequence: TAG
tatcagtctttaacaatata

SEQ ID NO: 40246 - DNA, 20 bp, Artificial Sequence
  Description of Artificial Sequence: Synthetic oligonucleotide
  Target: ATXN1; (-) strand; PAM type: NRG; PAM sequence: CAG
ccgtgcccagccactcctat

SEQ ID NO: 40247 - DNA, 20 bp, Artificial Sequence
  Description of Artificial Sequence: Synthetic oligonucleotide
  Target: ATXN1; (-) strand; PAM type: NRG; PAM sequence: CAG
caggcgtgagccaccgtgcc

SEQ ID NO: 40248 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 40249 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 40250 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 40251 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 40252 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 40253 - DNA, 20 bp, Artificial Sequence
  Description of Artificial Sequence: Synthetic oligonucleotide
  Target: ATXN1; (-) strand; PAM type: NRG; PAM sequence: AAG
ccgcccgcctcggcctccca

SEQ ID NO: 40254 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatccgcccgcct

SEQ ID NO: 40255 - DNA, 20 bp, Artificial Sequence
  Description of Artificial Sequence: Synthetic oligonucleotide
  Target: ATXN1; (-) strand; PAM type: NRG; PAM sequence: AGG
ggtctctaactcctgacctc

SEQ ID NO: 40256 - DNA, 20 bp, Artificial Sequence
  Description of Artificial Sequence: Synthetic oligonucleotide
  Target: ATXN1; (-) strand; PAM type: NRG; PAM sequence: CAG
tggtctctaactcctgacct

SEQ ID NO: 40257 - DNA, 20 bp, Artificial Sequence
  Description of Artificial Sequence: Synthetic oligonucleotide
  Target: ATXN1; (-) strand; PAM type: NRG; PAM sequence: TGG
tttcaccatattggccagac

SEQ ID NO: 40258 - DNA, 20 bp, Artificial Sequence
  Description of Artificial Sequence: Synthetic oligonucleotide
  Target: ATXN1; (-) strand; PAM type: NRG; PAM sequence: CAG
gagggtttcaccatattggc

SEQ ID NO: 40259 - DNA, 20 bp, Artificial Sequence
  Description of Artificial Sequence: Synthetic oligonucleotide
  Target: ATXN1; (-) strand; PAM type: NRG; PAM sequence: TGG
aatagagggtttcaccatat

SEQ ID NO: 40260 - DNA, 20 bp, Artificial Sequence
  Description of Artificial Sequence: Synthetic oligonucleotide
  Target: ATXN1; (-) strand; PAM type: NRG; PAM sequence: GGG
tctttagtatttttaataga

SEQ ID NO: 40261 - DNA, 20 bp, Artificial Sequence
  Description of Artificial Sequence: Synthetic oligonucleotide
  Target: ATXN1; (-) strand; PAM type: NRG; PAM sequence: AGG
gtctttagtatttttaatag

SEQ ID NO: 40262 - DNA, 20 bp, Artificial Sequence
  Description of Artificial Sequence: Synthetic oligonucleotide
  Target: ATXN1; (-) strand; PAM type: NRG; PAM sequence: GAG
agtctttagtatttttaata

SEQ ID NO: 40263 - DNA, 20 bp, Artificial Sequence
  Description of Artificial Sequence: Synthetic oligonucleotide
  Target: ATXN1; (-) strand; PAM type: NRG; PAM sequence: TAG
tcagtctttagtatttttaa

SEQ ID NO: 40264 - DNA, 20 bp, Artificial Sequence
  Description of Artificial Sequence: Synthetic oligonucleotide
  Target: ATXN1; (-) strand; PAM type: NRG; PAM sequence: TAG
cataatgctccttcagtctt

SEQ ID NO: 40265 - DNA, 20 bp, Artificial Sequence
  Description of Artificial Sequence: Synthetic oligonucleotide
  Target: ATXN1; (-) strand; PAM type: NRG; PAM sequence: CAG
gtcaggtcataatgctcctt

SEQ ID NO: 40266 - DNA, 20 bp, Artificial Sequence
  Description of Artificial Sequence: Synthetic oligonucleotide
  Target: ATXN1; (-) strand; PAM type: NRG; PAM sequence: AGG
gaacttctttgtccttggtc

SEQ ID NO: 40267 - DNA, 20 bp, Artificial Sequence
  Description of Artificial Sequence: Synthetic oligonucleotide
  Target: ATXN1; (-) strand; PAM type: NRG; PAM sequence: CAG
agaacttctttgtccttggt

SEQ ID NO: 40268 - DNA, 20 bp, Artificial Sequence
  Description of Artificial Sequence: Synthetic oligonucleotide
  Target: ATXN1; (-) strand; PAM type: NRG; PAM sequence: TGG
gttgagaacttctttgtcct

SEQ ID NO: 40269 - DNA, 20 bp, Artificial Sequence
  Description of Artificial Sequence: Synthetic oligonucleotide
  Target: ATXN1; (-) strand; PAM type: NRG; PAM sequence: GAG
agtgagggttcaagaaggtt

SEQ ID NO: 40270 - DNA, 20 bp, Artificial Sequence
  Description of Artificial Sequence: Synthetic oligonucleotide
  Target: ATXN1; (-) strand; PAM type: NRG; PAM sequence: AGG
gcaccagtgagggttcaaga

SEQ ID NO: 40271 - DNA, 20 bp, Artificial Sequence
  Description of Artificial Sequence: Synthetic oligonucleotide
  Target: ATXN1; (-) strand; PAM type: NRG; PAM sequence: AAG
ggcaccagtgagggttcaag

SEQ ID NO: 40272 - DNA, 20 bp, Artificial Sequence
  Description of Artificial Sequence: Synthetic oligonucleotide
  Target: ATXN1; (-) strand; PAM type: NRG; PAM sequence: AAG
ttgggcaccagtgagggttc

SEQ ID NO: 40273 - DNA, 20 bp, Artificial Sequence
  Description of Artificial Sequence: Synthetic oligonucleotide
  Target: ATXN1; (-) strand; PAM type: NRG; PAM sequence: GGG
agacatttgggcaccagtga

SEQ ID NO: 40274 - DNA, 20 bp, Artificial Sequence
  Description of Artificial Sequence: Synthetic oligonucleotide
  Target: ATXN1; (-) strand; PAM type: NRG; PAM sequence: AGG
tagacatttgggcaccagtg

SEQ ID NO: 40275 - DNA, 20 bp, Artificial Sequence
  Description of Artificial Sequence: Synthetic oligonucleotide
  Target: ATXN1; (-) strand; PAM type: NRG; PAM sequence: GAG
atagacatttgggcaccagt

SEQ ID NO: 40276 - DNA, 20 bp, Artificial Sequence
  Description of Artificial Sequence: Synthetic oligonucleotide
  Target: ATXN1; (-) strand; PAM type: NRG; PAM sequence: CAG
gaccatagacatttgggcac

SEQ ID NO: 40277 - DNA, 20 bp, Artificial Sequence
  Description of Artificial Sequence: Synthetic oligonucleotide
  Target: ATXN1; (-) strand; PAM type: NRG; PAM sequence: GGG
actgaggaccatagacattt

SEQ ID NO: 40278 - DNA, 20 bp, Artificial Sequence
  Description of Artificial Sequence: Synthetic oligonucleotide
  Target: ATXN1; (-) strand; PAM type: NRG; PAM sequence: TGG
gactgaggaccatagacatt

SEQ ID NO: 40279 - DNA, 20 bp, Artificial Sequence
  Description of Artificial Sequence: Synthetic oligonucleotide
  Target: ATXN1; (-) strand; PAM type: NRG; PAM sequence: TAG
atcgaggagactgaggacca

SEQ ID NO: 40280 - DNA, 20 bp, Artificial Sequence
  Description of Artificial Sequence: Synthetic oligonucleotide
  Target: ATXN1; (-) strand; PAM type: NRG; PAM sequence: AGG
ggttagtatcgaggagactg

SEQ ID NO: 40281 - DNA, 20 bp, Artificial Sequence
  Description of Artificial Sequence: Synthetic oligonucleotide
  Target: ATXN1; (-) strand; PAM type: NRG; PAM sequence: GAG
gggttagtatcgaggagact

SEQ ID NO: 40282 - DNA, 20 bp, Artificial Sequence
  Description of Artificial Sequence: Synthetic oligonucleotide
  Target: ATXN1; (-) strand; PAM type: NRG; PAM sequence: GAG
acgaaggggttagtatcgag

SEQ ID NO: 40283 - DNA, 20 bp, Artificial Sequence
  Description of Artificial Sequence: Synthetic oligonucleotide
  Target: ATXN1; (-) strand; PAM type: NRG; PAM sequence: AGG
agacgaaggggttagtatcg

SEQ ID NO: 40284 - DNA, 20 bp, Artificial Sequence
  Description of Artificial Sequence: Synthetic oligonucleotide
  Target: ATXN1; (-) strand; PAM type: NRG; PAM sequence: GAG
gagacgaaggggttagtatc

SEQ ID NO: 40285 - DNA, 20 bp, Artificial Sequence
  Description of Artificial Sequence: Synthetic oligonucleotide
  Target: ATXN1; (-) strand; PAM type: NRG; PAM sequence: TAG
atggggggagacgaaggggt

SEQ ID NO: 40286 - DNA, 20 bp, Artificial Sequence
  Description of Artificial Sequence: Synthetic oligonucleotide
  Target: ATXN1; (-) strand; PAM type: NRG; PAM sequence: GGG
gggtatggggggagacgaag

SEQ ID NO: 40287 - DNA, 20 bp, Artificial Sequence
  Description of Artificial Sequence: Synthetic oligonucleotide
  Target: ATXN1; (-) strand; PAM type: NRG; PAM sequence: GGG
ggggtatggggggagacgaa

SEQ ID NO: 40288 - DNA, 20 bp, Artificial Sequence
  Description of Artificial Sequence: Synthetic oligonucleotide
  Target: ATXN1; (-) strand; PAM type: NRG; PAM sequence: AGG
gggggtatggggggagacga

SEQ ID NO: 40289 - DNA, 20 bp, Artificial Sequence
  Description of Artificial Sequence: Synthetic oligonucleotide
  Target: ATXN1; (-) strand; PAM type: NRG; PAM sequence: AAG
ggggggtatggggggagacg

SEQ ID NO: 40290 - DNA, 20 bp, Artificial Sequence
  Description of Artificial Sequence: Synthetic oligonucleotide
  Target: ATXN1; (-) strand; PAM type: NRG; PAM sequence: GAG
atgggaggggggtatggggg

SEQ ID NO: 40291 - DNA, 20 bp, Artificial Sequence
  Description of Artificial Sequence: Synthetic oligonucleotide
  Target: ATXN1; (-) strand; PAM type: NRG; PAM sequence: GGG
ttatgggaggggggtatggg

SEQ ID NO: 40292 - DNA, 20 bp, Artificial Sequence
  Description of Artificial Sequence: Synthetic oligonucleotide
  Target: ATXN1; (-) strand; PAM type: NRG; PAM sequence: GGG
tttatgggaggggggtatgg

SEQ ID NO: 40293 - DNA, 20 bp, Artificial Sequence
  Description of Artificial Sequence: Synthetic oligonucleotide
  Target: ATXN1; (-) strand; PAM type: NRG; PAM sequence: GGG
ttttatgggaggggggtatg

SEQ ID NO: 40294 - DNA, 20 bp, Artificial Sequence
  Description of Artificial Sequence: Synthetic oligonucleotide
  Target: ATXN1; (-) strand; PAM type: NRG; PAM sequence: GGG
tttttatgggaggggggtat

SEQ ID NO: 40295 - DNA, 20 bp, Artificial Sequence
  Description of Artificial Sequence: Synthetic oligonucleotide
  Target: ATXN1; (-) strand; PAM type: NRG; PAM sequence: TGG
gtttttatgggaggggggta

SEQ ID NO: 40296 - DNA, 20 bp, Artificial Sequence
  Description of Artificial Sequence: Synthetic oligonucleotide
  Target: ATXN1; (-) strand; PAM type: NRG; PAM sequence: GGG
ggagggtttttatgggaggg

SEQ ID NO: 40297 - DNA, 20 bp, Artificial Sequence
  Description of Artificial Sequence: Synthetic oligonucleotide
  Target: ATXN1; (-) strand; PAM type: NRG; PAM sequence: GGG
tggagggtttttatgggagg

SEQ ID NO: 40298 - DNA, 20 bp, Artificial Sequence
  Description of Artificial Sequence: Synthetic oligonucleotide
  Target: ATXN1; (-) strand; PAM type: NRG; PAM sequence: GGG
ttggagggtttttatgggag

SEQ ID NO: 40299 - DNA, 20 bp, Artificial Sequence
  Description of Artificial Sequence: Synthetic oligonucleotide
  Target: ATXN1; (-) strand; PAM type: NRG; PAM sequence: GGG
gttggagggtttttatggga

SEQ ID NO: 40300 - DNA, 20 bp, Artificial Sequence
  Description of Artificial Sequence: Synthetic oligonucleotide
  Target: ATXN1; (-) strand; PAM type: NRG; PAM sequence: AGG
ggttggagggtttttatggg

SEQ ID NO: 40301 - DNA, 20 bp, Artificial Sequence
  Description of Artificial Sequence: Synthetic oligonucleotide
  Target: ATXN1; (-) strand; PAM type: NRG; PAM sequence: GAG
tggttggagggtttttatgg

SEQ ID NO: 40302 - DNA, 20 bp, Artificial Sequence
  Description of Artificial Sequence: Synthetic oligonucleotide
  Target: ATXN1; (-) strand; PAM type: NRG; PAM sequence: GGG
gctggttggagggtttttat

SEQ ID NO: 40303 - DNA, 20 bp, Artificial Sequence
  Description of Artificial Sequence: Synthetic oligonucleotide
  Target: ATXN1; (-) strand; PAM type: NRG; PAM sequence: TGG
ggctggttggagggttttta

SEQ ID NO: 40304 - DNA, 20 bp, Artificial Sequence
  Description of Artificial Sequence: Synthetic oligonucleotide
  Target: ATXN1; (-) strand; PAM type: NRG; PAM sequence: GGG
aattttttaggctggttgga

SEQ ID NO: 40305 - DNA, 20 bp, Artificial Sequence
  Description of Artificial Sequence: Synthetic oligonucleotide
  Target: ATXN1; (-) strand; PAM type: NRG; PAM sequence: AGG
caattttttaggctggttgg

SEQ ID NO: 40306 - DNA, 20 bp, Artificial Sequence
  Description of Artificial Sequence: Synthetic oligonucleotide
  Target: ATXN1; (-) strand; PAM type: NRG; PAM sequence: GAG
ccaattttttaggctggttg

SEQ ID NO: 40307 - DNA, 20 bp, Artificial Sequence
  Description of Artificial Sequence: Synthetic oligonucleotide
  Target: ATXN1; (-) strand; PAM type: NRG; PAM sequence: TGG
ctccaattttttaggctggt

SEQ ID NO: 40308 - DNA, 20 bp, Artificial Sequence
  Description of Artificial Sequence: Synthetic oligonucleotide
  Target: ATXN1; (-) strand; PAM type: NRG; PAM sequence: TGG
aaatctccaattttttaggc

SEQ ID NO: 40309 - DNA, 20 bp, Artificial Sequence
  Description of Artificial Sequence: Synthetic oligonucleotide
  Target: ATXN1; (-) strand; PAM type: NRG; PAM sequence: AGG
agtaaaatctccaatttttt

SEQ ID NO: 40310 - DNA, 20 bp, Artificial Sequence
  Description of Artificial Sequence: Synthetic oligonucleotide
  Target: ATXN1; (-) strand; PAM type: NRG; PAM sequence: TAG
aagtaaaatctccaattttt

SEQ ID NO: 40311 - DNA, 20 bp, Artificial Sequence
  Description of Artificial Sequence: Synthetic oligonucleotide
  Target: ATXN1; (-) strand; PAM type: NRG; PAM sequence: AAG
ataataattttgtaaaaatt

SEQ ID NO: 40312 - DNA, 20 bp, Artificial Sequence
  Description of Artificial Sequence: Synthetic oligonucleotide
  Target: ATXN1; (-) strand; PAM type: NRG; PAM sequence: AAG
ggcaacagagaatccatctc

SEQ ID NO: 40313 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcaaca

SEQ ID NO: 40314 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcaa

SEQ ID NO: 40315 - DNA, 20 bp, Artificial Sequence
  Description of Artificial Sequence: Synthetic oligonucleotide
  Target: ATXN1; (-) strand; PAM type: NRG; PAM sequence: GGG
gtaccactgcactccagcct

SEQ ID NO: 40316 - DNA, 20 bp, Artificial Sequence
  Description of Artificial Sequence: Synthetic oligonucleotide
  Target: ATXN1; (-) strand; PAM type: NRG; PAM sequence: TGG
tgtaccactgcactccagcc

SEQ ID NO: 40317 - DNA, 20 bp, Artificial Sequence
  Description of Artificial Sequence: Synthetic oligonucleotide
  Target: ATXN1; (-) strand; PAM type: NRG; PAM sequence: CAG
gagattgtaccactgcactc

SEQ ID NO: 40318 - DNA, 20 bp, Artificial Sequence
  Description of Artificial Sequence: Synthetic oligonucleotide
  Target: ATXN1; (-) strand; PAM type: NRG; PAM sequence: GAG
agcagaggttgcagtgagcc

SEQ ID NO: 40319 - DNA, 20 bp, Artificial Sequence
  Description of Artificial Sequence: Synthetic oligonucleotide
  Target: ATXN1; (-) strand; PAM type: NRG; PAM sequence: GAG
taggaagcagaggttgcagt

SEQ ID NO: 40320 - DNA, 20 bp, Artificial Sequence
  Description of Artificial Sequence: Synthetic oligonucleotide
  Target: ATXN1; (-) strand; PAM type: NRG; PAM sequence: CAG
aacctaggaagcagaggttg

SEQ ID NO: 40321 - DNA, 20 bp, Artificial Sequence
  Description of Artificial Sequence: Synthetic oligonucleotide
  Target: ATXN1; (-) strand; PAM type: NRG; PAM sequence: AGG
agcttgaacctaggaagcag

SEQ ID NO: 40322 - DNA, 20 bp, Artificial Sequence
  Description of Artificial Sequence: Synthetic oligonucleotide
  Target: ATXN1; (-) strand; PAM type: NRG; PAM sequence: GAG
tagcttgaacctaggaagca

SEQ ID NO: 40323 - DNA, 20 bp, Artificial Sequence
  Description of Artificial Sequence: Synthetic oligonucleotide
  Target: ATXN1; (-) strand; PAM type: NRG; PAM sequence: CAG
aatagcttgaacctaggaag

SEQ ID NO: 40324 - DNA, 20 bp, Artificial Sequence
  Description of Artificial Sequence: Synthetic oligonucleotide
  Target: ATXN1; (-) strand; PAM type: NRG; PAM sequence: AAG
gagaatagcttgaacctagg

SEQ ID NO: 40325 - DNA, 20 bp, Artificial Sequence
  Description of Artificial Sequence: Synthetic oligonucleotide
  Target: ATXN1; (-) strand; PAM type: NRG; PAM sequence: AGG
caggagaatagcttgaacct

SEQ ID NO: 40326 - DNA, 20 bp, Artificial Sequence
  Description of Artificial Sequence: Synthetic oligonucleotide
  Target: ATXN1; (-) strand; PAM type: NRG; PAM sequence: TAG
acaggagaatagcttgaacc

SEQ ID NO: 40327 - DNA, 20 bp, Artificial Sequence
  Description of Artificial Sequence: Synthetic oligonucleotide
  Target: ATXN1; (-) strand; PAM type: NRG; PAM sequence: TAG
aggaggctgagacaggagaa

SEQ ID NO: 40328 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgagacag

SEQ ID NO: 40329 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgagac

SEQ ID NO: 40330 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgaga

SEQ ID NO: 40331 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 40332 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctactcagg

SEQ ID NO: 40333 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctactcag

SEQ ID NO: 40334 - DNA, 20 bp, Artificial Sequence
  Description of Artificial Sequence: Synthetic oligonucleotide
  Target: ATXN1; (-) strand; PAM type: NRG; PAM sequence: AGG
gcctgtagtcccagctactc

SEQ ID NO: 40335 - DNA, 20 bp, Artificial Sequence
  Description of Artificial Sequence: Synthetic oligonucleotide
  Target: ATXN1; (-) strand; PAM type: NRG; PAM sequence: CAG
tgcctgtagtcccagctact

SEQ ID NO: 40336 - DNA, 20 bp, Artificial Sequence
  Description of Artificial Sequence: Synthetic oligonucleotide
  Target: ATXN1; (-) strand; PAM type: NRG; PAM sequence: CAG
gtggcacatgcctgtagtcc

SEQ ID NO: 40337 - DNA, 20 bp, Artificial Sequence
  Description of Artificial Sequence: Synthetic oligonucleotide
  Target: ATXN1; (-) strand; PAM type: NRG; PAM sequence: TAG
ggtgtggtggcacatgcctg

SEQ ID NO: 40338 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccaggtgtgg

SEQ ID NO: 40339 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagccaggtg

SEQ ID NO: 40340 - DNA, 20 bp, Artificial Sequence
  Description of Artificial Sequence: Synthetic oligonucleotide
  Target: ATXN1; (-) strand; PAM type: NRG; PAM sequence: AGG
aaaaaatacaaaaattagcc

SEQ ID NO: 40341 - DNA, 20 bp, Artificial Sequence
  Description of Artificial Sequence: Synthetic oligonucleotide
  Target: ATXN1; (-) strand; PAM type: NRG; PAM sequence: CAG
taaaaaatacaaaaattagc

SEQ ID NO: 40342 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaaatacaaaaat

SEQ ID NO: 40343 - DNA, 20 bp, Artificial Sequence
  Description of Artificial Sequence: Synthetic oligonucleotide
  Target: ATXN1; (-) strand; PAM type: NRG; PAM sequence: TGG
gagaccagcctgacccacaa

SEQ ID NO: 40344 - DNA, 20 bp, Artificial Sequence
  Description of Artificial Sequence: Synthetic oligonucleotide
  Target: ATXN1; (-) strand; PAM type: NRG; PAM sequence: CAG
taaggtcaggagtttgagac

SEQ ID NO: 40345 - DNA, 20 bp, Artificial Sequence
  Description of Artificial Sequence: Synthetic oligonucleotide
  Target: ATXN1; (-) strand; PAM type: NRG; PAM sequence: GAG
tcacctaaggtcaggagttt

SEQ ID NO: 40346 - DNA, 20 bp, Artificial Sequence
  Description of Artificial Sequence: Synthetic oligonucleotide
  Target: ATXN1; (-) strand; PAM type: NRG; PAM sequence: GAG
ggcggatcacctaaggtcag

SEQ ID NO: 40347 - DNA, 20 bp, Artificial Sequence
  Description of Artificial Sequence: Synthetic oligonucleotide
  Target: ATXN1; (-) strand; PAM type: NRG; PAM sequence: AGG
caggcggatcacctaaggtc

SEQ ID NO: 40348 - DNA, 20 bp, Artificial Sequence
  Description of Artificial Sequence: Synthetic oligonucleotide
  Target: ATXN1; (-) strand; PAM type: NRG; PAM sequence: CAG
gcaggcggatcacctaaggt

SEQ ID NO: 40349 - DNA, 20 bp, Artificial Sequence
  Description of Artificial Sequence: Synthetic oligonucleotide
  Target: ATXN1; (-) strand; PAM type: NRG; PAM sequence: AGG
caaggcaggcggatcaccta

SEQ ID NO: 40350 - DNA, 20 bp, Artificial Sequence
  Description of Artificial Sequence: Synthetic oligonucleotide
  Target: ATXN1; (-) strand; PAM type: NRG; PAM sequence: AAG
ccaaggcaggcggatcacct

SEQ ID NO: 40351 - DNA, 20 bp, Artificial Sequence
  Description of Artificial Sequence: Synthetic oligonucleotide
  Target: ATXN1; (-) strand; PAM type: NRG; PAM sequence: CGG
ctttgggatgccaaggcagg

SEQ ID NO: 40352 - DNA, 20 bp, Artificial Sequence
  Description of Artificial Sequence: Synthetic oligonucleotide
  Target: ATXN1; (-) strand; PAM type: NRG; PAM sequence: AGG
gcactttgggatgccaaggc

SEQ ID NO: 40353 - DNA, 20 bp, Artificial Sequence
  Description of Artificial Sequence: Synthetic oligonucleotide
  Target: ATXN1; (-) strand; PAM type: NRG; PAM sequence: CAG
agcactttgggatgccaagg

SEQ ID NO: 40354 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggatgcca

SEQ ID NO: 40355 - DNA, 20 bp, Artificial Sequence
  Description of Artificial Sequence: Synthetic oligonucleotide
  Target: ATXN1; (-) strand; PAM type: NRG; PAM sequence: AAG
tcccagcactttgggatgcc

SEQ ID NO: 40356 - DNA, 20 bp, Artificial Sequence
  Description of Artificial Sequence: Synthetic oligonucleotide
  Target: ATXN1; (-) strand; PAM type: NRG; PAM sequence: GGG
atctgtaatcccagcacttt

SEQ ID NO: 40357 - DNA, 20 bp, Artificial Sequence
  Description of Artificial Sequence: Synthetic oligonucleotide
  Target: ATXN1; (-) strand; PAM type: NRG; PAM sequence: TGG
catctgtaatcccagcactt

SEQ ID NO: 40358 - DNA, 20 bp, Artificial Sequence
  Description of Artificial Sequence: Synthetic oligonucleotide
  Target: ATXN1; (-) strand; PAM type: NRG; PAM sequence: CAG
gtagctcacatctgtaatcc

SEQ ID NO: 40359 - DNA, 20 bp, Artificial Sequence
  Description of Artificial Sequence: Synthetic oligonucleotide
  Target: ATXN1; (-) strand; PAM type: NRG; PAM sequence: TAG
catctccaggccaggcatgg

SEQ ID NO: 40360 - DNA, 20 bp, Artificial Sequence
  Description of Artificial Sequence: Synthetic oligonucleotide
  Target: ATXN1; (-) strand; PAM type: NRG; PAM sequence: TGG
taccatctccaggccaggca

SEQ ID NO: 40361 - DNA, 20 bp, Artificial Sequence
  Description of Artificial Sequence: Synthetic oligonucleotide
  Target: ATXN1; (-) strand; PAM type: NRG; PAM sequence: AGG
taaagtaccatctccaggcc

SEQ ID NO: 40362 - DNA, 20 bp, Artificial Sequence
  Description of Artificial Sequence: Synthetic oligonucleotide
  Target: ATXN1; (-) strand; PAM type: NRG; PAM sequence: CAG
ctaaagtaccatctccaggc

SEQ ID NO: 40363 - DNA, 20 bp, Artificial Sequence
  Description of Artificial Sequence: Synthetic oligonucleotide
  Target: ATXN1; (-) strand; PAM type: NRG; PAM sequence: AGG
ccttctaaagtaccatctcc

SEQ ID NO: 40364 - DNA, 20 bp, Artificial Sequence
  Description of Artificial Sequence: Synthetic oligonucleotide
  Target: ATXN1; (-) strand; PAM type: NRG; PAM sequence: CAG
gccttctaaagtaccatctc

SEQ ID NO: 40365 - DNA, 20 bp, Artificial Sequence
  Description of Artificial Sequence: Synthetic oligonucleotide
  Target: ATXN1; (-) strand; PAM type: NRG; PAM sequence: AAG
gatgatgagctagccttcta

SEQ ID NO: 40366 - DNA, 20 bp, Artificial Sequence
  Description of Artificial Sequence: Synthetic oligonucleotide
  Target: ATXN1; (-) strand; PAM type: NRG; PAM sequence: TAG
aaattgagaagatgatgagc

SEQ ID NO: 40367 - DNA, 20 bp, Artificial Sequence
  Description of Artificial Sequence: Synthetic oligonucleotide
  Target: ATXN1; (-) strand; PAM type: NRG; PAM sequence: GAG
agagaaattgagaagatgat

SEQ ID NO: 40368 - DNA, 20 bp, Artificial Sequence
  Description of Artificial Sequence: Synthetic oligonucleotide
  Target: ATXN1; (-) strand; PAM type: NRG; PAM sequence: AAG
ggaaagccagagaaattgag

SEQ ID NO: 40369 - DNA, 20 bp, Artificial Sequence
  Description of Artificial Sequence: Synthetic oligonucleotide
  Target: ATXN1; (-) strand; PAM type: NRG; PAM sequence: GAG
ttgggaaagccagagaaatt

SEQ ID NO: 40370 - DNA, 20 bp, Artificial Sequence
  Description of Artificial Sequence: Synthetic oligonucleotide
  Target: ATXN1; (-) strand; PAM type: NRG; PAM sequence: GAG
caggtttattgggaaagcca

SEQ ID NO: 40371 - DNA, 20 bp, Artificial Sequence
  Description of Artificial Sequence: Synthetic oligonucleotide
  Target: ATXN1; (-) strand; PAM type: NRG; PAM sequence: CAG
agcaggtttattgggaaagc

SEQ ID NO: 40372 - DNA, 20 bp, Artificial Sequence
  Description of Artificial Sequence: Synthetic oligonucleotide
  Target: ATXN1; (-) strand; PAM type: NRG; PAM sequence: AAG
gaaaagcaggtttattggga

SEQ ID NO: 40373 - DNA, 20 bp, Artificial Sequence
  Description of Artificial Sequence: Synthetic oligonucleotide
  Target: ATXN1; (-) strand; PAM type: NRG; PAM sequence: GGG
agaggaaaagcaggtttatt

SEQ ID NO: 40374 - DNA, 20 bp, Artificial Sequence
  Description of Artificial Sequence: Synthetic oligonucleotide
  Target: ATXN1; (-) strand; PAM type: NRG; PAM sequence: TGG
gagaggaaaagcaggtttat

SEQ ID NO: 40375 - DNA, 20 bp, Artificial Sequence
  Description of Artificial Sequence: Synthetic oligonucleotide
  Target: ATXN1; (-) strand; PAM type: NRG; PAM sequence: AGG
aggttggtgagaggaaaagc

SEQ ID NO: 40376 - DNA, 20 bp, Artificial Sequence
  Description of Artificial Sequence: Synthetic oligonucleotide
  Target: ATXN1; (-) strand; PAM type: NRG; PAM sequence: CAG
gaggttggtgagaggaaaag

SEQ ID NO: 40377 - DNA, 20 bp, Artificial Sequence
  Description of Artificial Sequence: Synthetic oligonucleotide
  Target: ATXN1; (-) strand; PAM type: NRG; PAM sequence: AAG
gatgaggttggtgagaggaa

SEQ ID NO: 40378 - DNA, 20 bp, Artificial Sequence
  Description of Artificial Sequence: Synthetic oligonucleotide
  Target: ATXN1; (-) strand; PAM type: NRG; PAM sequence: AGG
cgagagatgaggttggtgag

SEQ ID NO: 40379 - DNA, 20 bp, Artificial Sequence
  Description of Artificial Sequence: Synthetic oligonucleotide
  Target: ATXN1; (-) strand; PAM type: NRG; PAM sequence: GAG
acgagagatgaggttggtga

SEQ ID NO: 40380 - DNA, 20 bp, Artificial Sequence
  Description of Artificial Sequence: Synthetic oligonucleotide
  Target: ATXN1; (-) strand; PAM type: NRG; PAM sequence: GAG
atacgagagatgaggttggt

SEQ ID NO: 40381 - DNA, 20 bp, Artificial Sequence
  Description of Artificial Sequence: Synthetic oligonucleotide
  Target: ATXN1; (-) strand; PAM type: NRG; PAM sequence: TGG
ccaaatacgagagatgaggt

SEQ ID NO: 40382 - DNA, 20 bp, Artificial Sequence
  Description of Artificial Sequence: Synthetic oligonucleotide
  Target: ATXN1; (-) strand; PAM type: NRG; PAM sequence: AGG
aaagccaaatacgagagatg

SEQ ID NO: 40383 - DNA, 20 bp, Artificial Sequence
  Description of Artificial Sequence: Synthetic oligonucleotide
  Target: ATXN1; (-) strand; PAM type: NRG; PAM sequence: GAG
aaaagccaaatacgagagat

SEQ ID NO: 40384 - DNA, 20 bp, Artificial Sequence
  Description of Artificial Sequence: Synthetic oligonucleotide
  Target: ATXN1; (-) strand; PAM type: NRG; PAM sequence: GAG
cactcaaaagccaaatacga

SEQ ID NO: 40385 - DNA, 20 bp, Artificial Sequence
  Description of Artificial Sequence: Synthetic oligonucleotide
  Target: ATXN1; (-) strand; PAM type: NRG; PAM sequence: GAG
accactcaaaagccaaatac

SEQ ID NO: 40386 - DNA, 20 bp, Artificial Sequence
  Description of Artificial Sequence: Synthetic oligonucleotide
  Target: ATXN1; (-) strand; PAM type: NRG; PAM sequence: AAG
tttggctgctcaccactcaa

SEQ ID NO: 40387 - DNA, 20 bp, Artificial Sequence
  Description of Artificial Sequence: Synthetic oligonucleotide
  Target: ATXN1; (-) strand; PAM type: NRG; PAM sequence: TGG
tctgtaactgaacttaggtt

SEQ ID NO: 40388 - DNA, 20 bp, Artificial Sequence
  Description of Artificial Sequence: Synthetic oligonucleotide
  Target: ATXN1; (-) strand; PAM type: NRG; PAM sequence: AGG
gcacctctgtaactgaactt

SEQ ID NO: 40389 - DNA, 20 bp, Artificial Sequence
  Description of Artificial Sequence: Synthetic oligonucleotide
  Target: ATXN1; (-) strand; PAM type: NRG; PAM sequence: TAG
cgcacctctgtaactgaact

SEQ ID NO: 40390 - DNA, 20 bp, Artificial Sequence
  Description of Artificial Sequence: Synthetic oligonucleotide
  Target: ATXN1; (-) strand; PAM type: NRG; PAM sequence: GAG
ctggagtggtgcagtagctc

SEQ ID NO: 40391 - DNA, 20 bp, Artificial Sequence
  Description of Artificial Sequence: Synthetic oligonucleotide
  Target: ATXN1; (-) strand; PAM type: NRG; PAM sequence: TAG
cacaggctggagtggtgcag

SEQ ID NO: 40392 - DNA, 20 bp, Artificial Sequence
  Description of Artificial Sequence: Synthetic oligonucleotide
  Target: ATXN1; (-) strand; PAM type: NRG; PAM sequence: CAG
gcacacaggctggagtggtg

SEQ ID NO: 40393 - DNA, 20 bp, Artificial Sequence
  Description of Artificial Sequence: Synthetic oligonucleotide
  Target: ATXN1; (-) strand; PAM type: NRG; PAM sequence: TGG
ctctggcacacaggctggag

SEQ ID NO: 40394 - DNA, 20 bp, Artificial Sequence
  Description of Artificial Sequence: Synthetic oligonucleotide
  Target: ATXN1; (-) strand; PAM type: NRG; PAM sequence: GAG
ttgctctggcacacaggctg

SEQ ID NO: 40395 - DNA, 20 bp, Artificial Sequence
  Description of Artificial Sequence: Synthetic oligonucleotide
  Target: ATXN1; (-) strand; PAM type: NRG; PAM sequence: TGG
tcttgctctggcacacaggc

SEQ ID NO: 40396 - DNA, 20 bp, Artificial Sequence
  Description of Artificial Sequence: Synthetic oligonucleotide
  Target: ATXN1; (-) strand; PAM type: NRG; PAM sequence: AGG
agagtcttgctctggcacac

SEQ ID NO: 40397 - DNA, 20 bp, Artificial Sequence
  Description of Artificial Sequence: Synthetic oligonucleotide
  Target: ATXN1; (-) strand; PAM type: NRG; PAM sequence: CAG
cagagtcttgctctggcaca

SEQ ID NO: 40398 - DNA, 20 bp, Artificial Sequence
  Description of Artificial Sequence: Synthetic oligonucleotide
  Target: ATXN1; (-) strand; PAM type: NRG; PAM sequence: TGG
ttagagacagagtcttgctc

SEQ ID NO: 40399 - DNA, 20 bp, Artificial Sequence
  Description of Artificial Sequence: Synthetic oligonucleotide
  Target: ATXN1; (-) strand; PAM type: NRG; PAM sequence: GAG
tggtttggtttttagagaca

SEQ ID NO: 40400 - DNA, 20 bp, Artificial Sequence
  Description of Artificial Sequence: Synthetic oligonucleotide
  Target: ATXN1; (-) strand; PAM type: NRG; PAM sequence: CAG
tttggtttggtttttagaga

SEQ ID NO: 40401 - DNA, 20 bp, Artificial Sequence
  Description of Artificial Sequence: Synthetic oligonucleotide
  Target: ATXN1; (-) strand; PAM type: NRG; PAM sequence: GAG
ttggtttggtttggttttta

SEQ ID NO: 40402 - DNA, 20 bp, Artificial Sequence
  Description of Artificial Sequence: Synthetic oligonucleotide
  Target: ATXN1; (-) strand; PAM type: NRG; PAM sequence: TAG
gtttggtttggtttggtttt

SEQ ID NO: 40403 - DNA, 20 bp, Artificial Sequence
  Description of Artificial Sequence: Synthetic oligonucleotide
  Target: ATXN1; (-) strand; PAM type: NRG; PAM sequence: TGG
gagtttggtttggtttggtt

SEQ ID NO: 40404 - DNA, 20 bp, Artificial Sequence
  Description of Artificial Sequence: Synthetic oligonucleotide
  Target: ATXN1; (-) strand; PAM type: NRG; PAM sequence: TGG
atttggagtttggtttggtt

SEQ ID NO: 40405 - DNA, 20 bp, Artificial Sequence
  Description of Artificial Sequence: Synthetic oligonucleotide
  Target: ATXN1; (-) strand; PAM type: NRG; PAM sequence: TGG
tggagatttggagtttggtt

SEQ ID NO: 40406 - DNA, 20 bp, Artificial Sequence
  Description of Artificial Sequence: Synthetic oligonucleotide
  Target: ATXN1; (-) strand; PAM type: NRG; PAM sequence: TGG
gtctttggagatttggagtt

SEQ ID NO: 40407 - DNA, 20 bp, Artificial Sequence
  Description of Artificial Sequence: Synthetic oligonucleotide
  Target: ATXN1; (-) strand; PAM type: NRG; PAM sequence: GAG
ggcctgtctttggagatttg

SEQ ID NO: 40408 - DNA, 20 bp, Artificial Sequence
  Description of Artificial Sequence: Synthetic oligonucleotide
  Target: ATXN1; (-) strand; PAM type: NRG; PAM sequence: TGG
aaggcctgtctttggagatt

SEQ ID NO: 40409 - DNA, 20 bp, Artificial Sequence
  Description of Artificial Sequence: Synthetic oligonucleotide
  Target: ATXN1; (-) strand; PAM type: NRG; PAM sequence: GAG
aattctaaggcctgtctttg

SEQ ID NO: 40410 - DNA, 20 bp, Artificial Sequence
  Description of Artificial Sequence: Synthetic oligonucleotide
  Target: ATXN1; (-) strand; PAM type: NRG; PAM sequence: TGG
ttaattctaaggcctgtctt

SEQ ID NO: 40411 - DNA, 20 bp, Artificial Sequence
  Description of Artificial Sequence: Synthetic oligonucleotide
  Target: ATXN1; (-) strand; PAM type: NRG; PAM sequence: AGG
caccacagcatttaattcta

SEQ ID NO: 40412 - DNA, 20 bp, Artificial Sequence
  Description of Artificial Sequence: Synthetic oligonucleotide
  Target: ATXN1; (-) strand; PAM type: NRG; PAM sequence: AAG
acaccacagcatttaattct

SEQ ID NO: 40413 - DNA, 20 bp, Artificial Sequence
  Description of Artificial Sequence: Synthetic oligonucleotide
  Target: ATXN1; (-) strand; PAM type: NRG; PAM sequence: CAG
tctagctatggttcacacca

SEQ ID NO: 40414 - DNA, 20 bp, Artificial Sequence
  Description of Artificial Sequence: Synthetic oligonucleotide
  Target: ATXN1; (-) strand; PAM type: NRG; PAM sequence: TGG
tcggcaggctgttctagcta

SEQ ID NO: 40415 - DNA, 20 bp, Artificial Sequence
  Description of Artificial Sequence: Synthetic oligonucleotide
  Target: ATXN1; (-) strand; PAM type: NRG; PAM sequence: TAG
aatttttcggcaggctgttc

SEQ ID NO: 40416 - DNA, 20 bp, Artificial Sequence
  Description of Artificial Sequence: Synthetic oligonucleotide
  Target: ATXN1; (-) strand; PAM type: NRG; PAM sequence: AGG
tctctcgtgaatttttcggc

SEQ ID NO: 40417 - DNA, 20 bp, Artificial Sequence
  Description of Artificial Sequence: Synthetic oligonucleotide
  Target: ATXN1; (-) strand; PAM type: NRG; PAM sequence: CAG
ttctctcgtgaatttttcgg

SEQ ID NO: 40418 - DNA, 20 bp, Artificial Sequence
  Description of Artificial Sequence: Synthetic oligonucleotide
  Target: ATXN1; (-) strand; PAM type: NRG; PAM sequence: CGG
cttttctctcgtgaattttt

SEQ ID NO: 40419 - DNA, 20 bp, Artificial Sequence
  Description of Artificial Sequence: Synthetic oligonucleotide
  Target: ATXN1; (-) strand; PAM type: NRG; PAM sequence: TAG
ccattaacgtcatcttgttt

SEQ ID NO: 40420 - DNA, 20 bp, Artificial Sequence
  Description of Artificial Sequence: Synthetic oligonucleotide
  Target: ATXN1; (-) strand; PAM type: NRG; PAM sequence: GAG
tccaacctgggtgacagagc

SEQ ID NO: 40421 - DNA, 20 bp, Artificial Sequence
  Description of Artificial Sequence: Synthetic oligonucleotide
  Target: ATXN1; (-) strand; PAM type: NRG; PAM sequence: GAG
gcactccaacctgggtgaca

SEQ ID NO: 40422 - DNA, 20 bp, Artificial Sequence
  Description of Artificial Sequence: Synthetic oligonucleotide
  Target: ATXN1; (-) strand; PAM type: NRG; PAM sequence: CAG
ctgcactccaacctgggtga

SEQ ID NO: 40423 - DNA, 20 bp, Artificial Sequence
  Description of Artificial Sequence: Synthetic oligonucleotide
  Target: ATXN1; (-) strand; PAM type: NRG; PAM sequence: GGG
gtgccactgcactccaacct

SEQ ID NO: 40424 - DNA, 20 bp, Artificial Sequence
  Description of Artificial Sequence: Synthetic oligonucleotide
  Target: ATXN1; (-) strand; PAM type: NRG; PAM sequence: TGG
ggtgccactgcactccaacc

SEQ ID NO: 40425 - DNA, 20 bp, Artificial Sequence
  Description of Artificial Sequence: Synthetic oligonucleotide
  Target: ATXN1; (-) strand; PAM type: NRG; PAM sequence: TGG
gagattgcagtgagctgaga

SEQ ID NO: 40426 - DNA, 20 bp, Artificial Sequence
  Description of Artificial Sequence: Synthetic oligonucleotide
  Target: ATXN1; (-) strand; PAM type: NRG; PAM sequence: GAG
ggcagagattgcagtgagct

SEQ ID NO: 40427 - DNA, 20 bp, Artificial Sequence
  Description of Artificial Sequence: Synthetic oligonucleotide
  Target: ATXN1; (-) strand; PAM type: NRG; PAM sequence: GAG
caggaggcagagattgcagt

SEQ ID NO: 40428 - DNA, 20 bp, Artificial Sequence
  Description of Artificial Sequence: Synthetic oligonucleotide
  Target: ATXN1; (-) strand; PAM type: NRG; PAM sequence: CAG
aatccaggaggcagagattg

SEQ ID NO: 40429 - DNA, 20 bp, Artificial Sequence
  Description of Artificial Sequence: Synthetic oligonucleotide
  Target: ATXN1; (-) strand; PAM type: NRG; PAM sequence: GAG
tcgctcgaatccaggaggca

SEQ ID NO: 40430 - DNA, 20 bp, Artificial Sequence
  Description of Artificial Sequence: Synthetic oligonucleotide
  Target: ATXN1; (-) strand; PAM type: NRG; PAM sequence: CAG
aatcgctcgaatccaggagg

SEQ ID NO: 40431 - DNA, 20 bp, Artificial Sequence
  Description of Artificial Sequence: Synthetic oligonucleotide
  Target: ATXN1; (-) strand; PAM type: NRG; PAM sequence: AGG
gagaatcgctcgaatccagg

SEQ ID NO: 40432 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgctcgaatccag

SEQ ID NO: 40433 - DNA, 20 bp, Artificial Sequence
  Description of Artificial Sequence: Synthetic oligonucleotide
  Target: ATXN1; (-) strand; PAM type: NRG; PAM sequence: AGG
caggagaatcgctcgaatcc

SEQ ID NO: 40434 - DNA, 20 bp, Artificial Sequence
  Description of Artificial Sequence: Synthetic oligonucleotide
  Target: ATXN1; (-) strand; PAM type: NRG; PAM sequence: CAG
gcaggagaatcgctcgaatc

SEQ ID NO: 40435 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcag

SEQ ID NO: 40436 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggctgaggc

SEQ ID NO: 40437 - DNA, 20 bp, Artificial Sequence
  Description of Artificial Sequence: Synthetic oligonucleotide
  Target: ATXN1; (-) strand; PAM type: NRG; PAM sequence: CAG
tgctacttgggaggctgagg

SEQ ID NO: 40438 - DNA, 20 bp, Artificial Sequence
  Description of Artificial Sequence: Synthetic oligonucleotide
  Target: ATXN1; (-) strand; PAM type: NRG; PAM sequence: AGG
ccctgctacttgggaggctg

SEQ ID NO: 40439 - DNA, 20 bp, Artificial Sequence
  Description of Artificial Sequence: Synthetic oligonucleotide
  Target: ATXN1; (-) strand; PAM type: NRG; PAM sequence: GAG
tccctgctacttgggaggct

SEQ ID NO: 40440 - DNA, 20 bp, Artificial Sequence
  Description of Artificial Sequence: Synthetic oligonucleotide
  Target: ATXN1; (-) strand; PAM type: NRG; PAM sequence: AGG
tgtaatccctgctacttggg

SEQ ID NO: 40441 - DNA, 20 bp, Artificial Sequence
  Description of Artificial Sequence: Synthetic oligonucleotide
  Target: ATXN1; (-) strand; PAM type: NRG; PAM sequence: GAG
ctgtaatccctgctacttgg

SEQ ID NO: 40442 - DNA, 20 bp, Artificial Sequence
  Description of Artificial Sequence: Synthetic oligonucleotide
  Target: ATXN1; (-) strand; PAM type: NRG; PAM sequence: GGG
acctgtaatccctgctactt

SEQ ID NO: 40443 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatccctgctact

SEQ ID NO: 40444 - DNA, 20 bp, Artificial Sequence
  Description of Artificial Sequence: Synthetic oligonucleotide
  Target: ATXN1; (-) strand; PAM type: NRG; PAM sequence: GGG
aattagccaggggtggtggt

SEQ ID NO: 40445 - DNA, 20 bp, Artificial Sequence
  Description of Artificial Sequence: Synthetic oligonucleotide
  Target: ATXN1; (-) strand; PAM type: NRG; PAM sequence: TGG
aaattagccaggggtggtgg

SEQ ID NO: 40446 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggggtgg

SEQ ID NO: 40447 - DNA, 20 bp, Artificial Sequence
  Description of Artificial Sequence: Synthetic oligonucleotide
  Target: ATXN1; (-) strand; PAM type: NRG; PAM sequence: TGG
tataaaaaattagccagggg

SEQ ID NO: 40448 - DNA, 20 bp, Artificial Sequence
  Description of Artificial Sequence: Synthetic oligonucleotide
  Target: ATXN1; (-) strand; PAM type: NRG; PAM sequence: GGG
aaatataaaaaattagccag

SEQ ID NO: 40449 - DNA, 20 bp, Artificial Sequence
  Description of Artificial Sequence: Synthetic oligonucleotide
  Target: ATXN1; (-) strand; PAM type: NRG; PAM sequence: GGG
aaaatataaaaaattagcca

SEQ ID NO: 40450 - DNA, 20 bp, Artificial Sequence
  Description of Artificial Sequence: Synthetic oligonucleotide
  Target: ATXN1; (-) strand; PAM type: NRG; PAM sequence: AGG
aaaaatataaaaaattagcc

SEQ ID NO: 40451 - DNA, 20 bp, Artificial Sequence
  Description of Artificial Sequence: Synthetic oligonucleotide
  Target: ATXN1; (-) strand; PAM type: NRG; PAM sequence: CAG
taaaaatataaaaaattagc

SEQ ID NO: 40452 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatataaaaaat

SEQ ID NO: 40453 - DNA, 20 bp, Artificial Sequence
  Description of Artificial Sequence: Synthetic oligonucleotide
  Target: ATXN1; (-) strand; PAM type: NRG; PAM sequence: TGG
caagactagcttggccaaca

SEQ ID NO: 40454 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcaagactagct

SEQ ID NO: 40455 - DNA, 20 bp, Artificial Sequence
  Description of Artificial Sequence: Synthetic oligonucleotide
  Target: ATXN1; (-) strand; PAM type: NRG; PAM sequence: TAG
tgagatcaggagttcaagac

SEQ ID NO: 40456 - DNA, 20 bp, Artificial Sequence
  Description of Artificial Sequence: Synthetic oligonucleotide
  Target: ATXN1; (-) strand; PAM type: NRG; PAM sequence: AAG
tcgcctgagatcaggagttc

SEQ ID NO: 40457 - DNA, 20 bp, Artificial Sequence
  Description of Artificial Sequence: Synthetic oligonucleotide
  Target: ATXN1; (-) strand; PAM type: NRG; PAM sequence: GAG
ggcagatcgcctgagatcag

SEQ ID NO: 40458 - DNA, 20 bp, Artificial Sequence
  Description of Artificial Sequence: Synthetic oligonucleotide
  Target: ATXN1; (-) strand; PAM type: NRG; PAM sequence: AGG
cgggcagatcgcctgagatc

SEQ ID NO: 40459 - DNA, 20 bp, Artificial Sequence
  Description of Artificial Sequence: Synthetic oligonucleotide
  Target: ATXN1; (-) strand; PAM type: NRG; PAM sequence: CAG
gcgggcagatcgcctgagat

SEQ ID NO: 40460 - DNA, 20 bp, Artificial Sequence
  Description of Artificial Sequence: Synthetic oligonucleotide
  Target: ATXN1; (-) strand; PAM type: NRG; PAM sequence: GAG
ctgtggcgggcagatcgcct

SEQ ID NO: 40461 - DNA, 20 bp, Artificial Sequence
  Description of Artificial Sequence: Synthetic oligonucleotide
  Target: ATXN1; (-) strand; PAM type: NRG; PAM sequence: CAG
ttttgggaggctgtggcggg

SEQ ID NO: 40462 - DNA, 20 bp, Artificial Sequence
  Description of Artificial Sequence: Synthetic oligonucleotide
  Target: ATXN1; (-) strand; PAM type: NRG; PAM sequence: GGG
gcattttgggaggctgtggc

SEQ ID NO: 40463 - DNA, 20 bp, Artificial Sequence
  Description of Artificial Sequence: Synthetic oligonucleotide
  Target: ATXN1; (-) strand; PAM type: NRG; PAM sequence: CGG
agcattttgggaggctgtgg

SEQ ID NO: 40464 - DNA, 20 bp, Artificial Sequence
  Description of Artificial Sequence: Synthetic oligonucleotide
  Target: ATXN1; (-) strand; PAM type: NRG; PAM sequence: TGG
cctagcattttgggaggctg

SEQ ID NO: 40465 - DNA, 20 bp, Artificial Sequence
  Description of Artificial Sequence: Synthetic oligonucleotide
  Target: ATXN1; (-) strand; PAM type: NRG; PAM sequence: AGG
tgtaatcctagcattttggg

SEQ ID NO: 40466 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcctagcattttgg

SEQ ID NO: 40467 - DNA, 20 bp, Artificial Sequence
  Description of Artificial Sequence: Synthetic oligonucleotide
  Target: ATXN1; (-) strand; PAM type: NRG; PAM sequence: GGG
ttctgtaatcctagcatttt

SEQ ID NO: 40468 - DNA, 20 bp, Artificial Sequence
  Description of Artificial Sequence: Synthetic oligonucleotide
  Target: ATXN1; (-) strand; PAM type: NRG; PAM sequence: TGG
cttctgtaatcctagcattt

SEQ ID NO: 40469 - DNA, 20 bp, Artificial Sequence
  Description of Artificial Sequence: Synthetic oligonucleotide
  Target: ATXN1; (-) strand; PAM type: NRG; PAM sequence: TAG
gtgactcacttctgtaatcc

SEQ ID NO: 40470 - DNA, 20 bp, Artificial Sequence
  Description of Artificial Sequence: Synthetic oligonucleotide
  Target: ATXN1; (-) strand; PAM type: NRG; PAM sequence: CGG
attaacaggccaggtgggcg

SEQ ID NO: 40471 - DNA, 20 bp, Artificial Sequence
  Description of Artificial Sequence: Synthetic oligonucleotide
  Target: ATXN1; (-) strand; PAM type: NRG; PAM sequence: GGG
atttcattaacaggccaggt

SEQ ID NO: 40472 - DNA, 20 bp, Artificial Sequence
  Description of Artificial Sequence: Synthetic oligonucleotide
  Target: ATXN1; (-) strand; PAM type: NRG; PAM sequence: TGG
aatttcattaacaggccagg

SEQ ID NO: 40473 - DNA, 20 bp, Artificial Sequence
  Description of Artificial Sequence: Synthetic oligonucleotide
  Target: ATXN1; (-) strand; PAM type: NRG; PAM sequence: AGG
ataaatttcattaacaggcc

SEQ ID NO: 40474 - DNA, 20 bp, Artificial Sequence
  Description of Artificial Sequence: Synthetic oligonucleotide
  Target: ATXN1; (-) strand; PAM type: NRG; PAM sequence: CAG
cataaatttcattaacaggc

SEQ ID NO: 40475 - DNA, 20 bp, Artificial Sequence
  Description of Artificial Sequence: Synthetic oligonucleotide
  Target: ATXN1; (-) strand; PAM type: NRG; PAM sequence: AGG
ttaacataaatttcattaac

SEQ ID NO: 40476 - DNA, 20 bp, Artificial Sequence
  Description of Artificial Sequence: Synthetic oligonucleotide
  Target: ATXN1; (-) strand; PAM type: NRG; PAM sequence: CAG
gttaacataaatttcattaa

SEQ ID NO: 40477 - DNA, 20 bp, Artificial Sequence
  Description of Artificial Sequence: Synthetic oligonucleotide
  Target: ATXN1; (-) strand; PAM type: NRG; PAM sequence: AGG
agaatctcccaagcctatct

SEQ ID NO: 40478 - DNA, 20 bp, Artificial Sequence
  Description of Artificial Sequence: Synthetic oligonucleotide
  Target: ATXN1; (-) strand; PAM type: NRG; PAM sequence: TAG
aagaatctcccaagcctatc

SEQ ID NO: 40479 - DNA, 20 bp, Artificial Sequence
  Description of Artificial Sequence: Synthetic oligonucleotide
  Target: ATXN1; (-) strand; PAM type: NRG; PAM sequence: AAG
tgattaaagaagaatctccc

SEQ ID NO: 40480 - DNA, 20 bp, Artificial Sequence
  Description of Artificial Sequence: Synthetic oligonucleotide
  Target: ATXN1; (-) strand; PAM type: NRG; PAM sequence: AAG
agcctttgaagtgattaaag

SEQ ID NO: 40481 - DNA, 20 bp, Artificial Sequence
  Description of Artificial Sequence: Synthetic oligonucleotide
  Target: ATXN1; (-) strand; PAM type: NRG; PAM sequence: AAG
agaagcctttgaagtgatta

SEQ ID NO: 40482 - DNA, 20 bp, Artificial Sequence
  Description of Artificial Sequence: Synthetic oligonucleotide
  Target: ATXN1; (-) strand; PAM type: NRG; PAM sequence: AAG
gaaacaaagagaagcctttg

SEQ ID NO: 40483 - DNA, 20 bp, Artificial Sequence
  Description of Artificial Sequence: Synthetic oligonucleotide
  Target: ATXN1; (-) strand; PAM type: NRG; PAM sequence: AAG
aggcaaaaagaaacaaagag

SEQ ID NO: 40484 - DNA, 20 bp, Artificial Sequence
  Description of Artificial Sequence: Synthetic oligonucleotide
  Target: ATXN1; (-) strand; PAM type: NRG; PAM sequence: GAG
tttaggcaaaaagaaacaaa

SEQ ID NO: 40485 - DNA, 20 bp, Artificial Sequence
  Description of Artificial Sequence: Synthetic oligonucleotide
  Target: ATXN1; (-) strand; PAM type: NRG; PAM sequence: AAG
aatttaggcaaaaagaaaca

SEQ ID NO: 40486 - DNA, 20 bp, Artificial Sequence
  Description of Artificial Sequence: Synthetic oligonucleotide
  Target: ATXN1; (-) strand; PAM type: NRG; PAM sequence: AAG
aaaggcagaatttaggcaaa

SEQ ID NO: 40487 - DNA, 20 bp, Artificial Sequence
  Description of Artificial Sequence: Synthetic oligonucleotide
  Target: ATXN1; (-) strand; PAM type: NRG; PAM sequence: AGG
aggaagcaaaggcagaattt

SEQ ID NO: 40488 - DNA, 20 bp, Artificial Sequence
  Description of Artificial Sequence: Synthetic oligonucleotide
  Target: ATXN1; (-) strand; PAM type: NRG; PAM sequence: TAG
taggaagcaaaggcagaatt

SEQ ID NO: 40489 - DNA, 20 bp, Artificial Sequence
  Description of Artificial Sequence: Synthetic oligonucleotide
  Target: ATXN1; (-) strand; PAM type: NRG; PAM sequence: CAG
cctttggtaggaagcaaagg

SEQ ID NO: 40490 - DNA, 20 bp, Artificial Sequence
  Description of Artificial Sequence: Synthetic oligonucleotide
  Target: ATXN1; (-) strand; PAM type: NRG; PAM sequence: AGG
gctcctttggtaggaagcaa

SEQ ID NO: 40491 - DNA, 20 bp, Artificial Sequence
  Description of Artificial Sequence: Synthetic oligonucleotide
  Target: ATXN1; (-) strand; PAM type: NRG; PAM sequence: AAG
agctcctttggtaggaagca

SEQ ID NO: 40492 - DNA, 20 bp, Artificial Sequence
  Description of Artificial Sequence: Synthetic oligonucleotide
  Target: ATXN1; (-) strand; PAM type: NRG; PAM sequence: AAG
gacacagctcctttggtagg

SEQ ID NO: 40493 - DNA, 20 bp, Artificial Sequence
  Description of Artificial Sequence: Synthetic oligonucleotide
  Target: ATXN1; (-) strand; PAM type: NRG; PAM sequence: AGG
ggtgacacagctcctttggt

SEQ ID NO: 40494 - DNA, 20 bp, Artificial Sequence
  Description of Artificial Sequence: Synthetic oligonucleotide
  Target: ATXN1; (-) strand; PAM type: NRG; PAM sequence: TAG
gggtgacacagctcctttgg

SEQ ID NO: 40495 - DNA, 20 bp, Artificial Sequence
  Description of Artificial Sequence: Synthetic oligonucleotide
  Target: ATXN1; (-) strand; PAM type: NRG; PAM sequence: TGG
gcagggtgacacagctcctt

SEQ ID NO: 40496 - DNA, 20 bp, Artificial Sequence
  Description of Artificial Sequence: Synthetic oligonucleotide
  Target: ATXN1; (-) strand; PAM type: NRG; PAM sequence: CAG
catcttttcgcagggtgaca

SEQ ID NO: 40497 - DNA, 20 bp, Artificial Sequence
  Description of Artificial Sequence: Synthetic oligonucleotide
  Target: ATXN1; (-) strand; PAM type: NRG; PAM sequence: GGG
ggtcgtggcatcttttcgca

SEQ ID NO: 40498 - DNA, 20 bp, Artificial Sequence
  Description of Artificial Sequence: Synthetic oligonucleotide
  Target: ATXN1; (-) strand; PAM type: NRG; PAM sequence: AGG
tggtcgtggcatcttttcgc

SEQ ID NO: 40499 - DNA, 20 bp, Artificial Sequence
  Description of Artificial Sequence: Synthetic oligonucleotide
  Target: ATXN1; (-) strand; PAM type: NRG; PAM sequence: CAG
ctggtcgtggcatcttttcg

SEQ ID NO: 40500 - DNA, 20 bp, Artificial Sequence
  Description of Artificial Sequence: Synthetic oligonucleotide
  Target: ATXN1; (-) strand; PAM type: NRG; PAM sequence: TGG
acccagctgatatctggtcg

SEQ ID NO: 40501 - DNA, 20 bp, Artificial Sequence
  Description of Artificial Sequence: Synthetic oligonucleotide
  Target: ATXN1; (-) strand; PAM type: NRG; PAM sequence: TGG
tcatggacccagctgatatc

SEQ ID NO: 40502 - DNA, 20 bp, Artificial Sequence
  Description of Artificial Sequence: Synthetic oligonucleotide
  Target: ATXN1; (-) strand; PAM type: NRG; PAM sequence: CAG
cacctcagctttcatggacc

SEQ ID NO: 40503 - DNA, 20 bp, Artificial Sequence
  Description of Artificial Sequence: Synthetic oligonucleotide
  Target: ATXN1; (-) strand; PAM type: NRG; PAM sequence: TGG
cgctcccacctcagctttca

SEQ ID NO: 40504 - DNA, 20 bp, Artificial Sequence
  Description of Artificial Sequence: Synthetic oligonucleotide
  Target: ATXN1; (-) strand; PAM type: NRG; PAM sequence: CAG
ataatcttccgctcccacct

SEQ ID NO: 40505 - DNA, 20 bp, Artificial Sequence
  Description of Artificial Sequence: Synthetic oligonucleotide
  Target: ATXN1; (-) strand; PAM type: NRG; PAM sequence: CAG
cgatctgtgcctacaatgat

SEQ ID NO: 40506 - DNA, 20 bp, Artificial Sequence
  Description of Artificial Sequence: Synthetic oligonucleotide
  Target: ATXN1; (-) strand; PAM type: NRG; PAM sequence: AAG
aaaactagcattgggctggc

SEQ ID NO: 40507 - DNA, 20 bp, Artificial Sequence
  Description of Artificial Sequence: Synthetic oligonucleotide
  Target: ATXN1; (-) strand; PAM type: NRG; PAM sequence: TGG
ggagaaaactagcattgggc

SEQ ID NO: 40508 - DNA, 20 bp, Artificial Sequence
  Description of Artificial Sequence: Synthetic oligonucleotide
  Target: ATXN1; (-) strand; PAM type: NRG; PAM sequence: GGG
gtgaggagaaaactagcatt

SEQ ID NO: 40509 - DNA, 20 bp, Artificial Sequence
  Description of Artificial Sequence: Synthetic oligonucleotide
  Target: ATXN1; (-) strand; PAM type: NRG; PAM sequence: TGG
agtgaggagaaaactagcat

SEQ ID NO: 40510 - DNA, 20 bp, Artificial Sequence
  Description of Artificial Sequence: Synthetic oligonucleotide
  Target: ATXN1; (-) strand; PAM type: NRG; PAM sequence: TAG
ctaattagtgaggagaaaac

SEQ ID NO: 40511 - DNA, 20 bp, Artificial Sequence
  Description of Artificial Sequence: Synthetic oligonucleotide
  Target: ATXN1; (-) strand; PAM type: NRG; PAM sequence: GAG
agttcacactaattagtgag

SEQ ID NO: 40512 - DNA, 20 bp, Artificial Sequence
  Description of Artificial Sequence: Synthetic oligonucleotide
  Target: ATXN1; (-) strand; PAM type: NRG; PAM sequence: AGG
gtagttcacactaattagtg

SEQ ID NO: 40513 - DNA, 20 bp, Artificial Sequence
  Description of Artificial Sequence: Synthetic oligonucleotide
  Target: ATXN1; (-) strand; PAM type: NRG; PAM sequence: GAG
ggtagttcacactaattagt

SEQ ID NO: 40514 - DNA, 20 bp, Artificial Sequence
  Description of Artificial Sequence: Synthetic oligonucleotide
  Target: ATXN1; (-) strand; PAM type: NRG; PAM sequence: TAG
tctaggtagttcacactaat

SEQ ID NO: 40515 - DNA, 20 bp, Artificial Sequence
  Description of Artificial Sequence: Synthetic oligonucleotide
  Target: ATXN1; (-) strand; PAM type: NRG; PAM sequence: TAG
gaaaaagtacattgtctagg

SEQ ID NO: 40516 - DNA, 20 bp, Artificial Sequence
  Description of Artificial Sequence: Synthetic oligonucleotide
  Target: ATXN1; (-) strand; PAM type: NRG; PAM sequence: AGG
ggggaaaaagtacattgtct

SEQ ID NO: 40517 - DNA, 20 bp, Artificial Sequence
  Description of Artificial Sequence: Synthetic oligonucleotide
  Target: ATXN1; (-) strand; PAM type: NRG; PAM sequence: TAG
gggggaaaaagtacattgtc

SEQ ID NO: 40518 - DNA, 20 bp, Artificial Sequence
  Description of Artificial Sequence: Synthetic oligonucleotide
  Target: ATXN1; (-) strand; PAM type: NRG; PAM sequence: AAG
ttcagaccccaagggggaaa

SEQ ID NO: 40519 - DNA, 20 bp, Artificial Sequence
  Description of Artificial Sequence: Synthetic oligonucleotide
  Target: ATXN1; (-) strand; PAM type: NRG; PAM sequence: GGG
catacattcagaccccaagg

SEQ ID NO: 40520 - DNA, 20 bp, Artificial Sequence
  Description of Artificial Sequence: Synthetic oligonucleotide
  Target: ATXN1; (-) strand; PAM type: NRG; PAM sequence: GGG
tcatacattcagaccccaag

SEQ ID NO: 40521 - DNA, 20 bp, Artificial Sequence
  Description of Artificial Sequence: Synthetic oligonucleotide
  Target: ATXN1; (-) strand; PAM type: NRG; PAM sequence: GGG
ctcatacattcagaccccaa

SEQ ID NO: 40522 - DNA, 20 bp, Artificial Sequence
  Description of Artificial Sequence: Synthetic oligonucleotide
  Target: ATXN1; (-) strand; PAM type: NRG; PAM sequence: AGG
tctcatacattcagacccca

SEQ ID NO: 40523 - DNA, 20 bp, Artificial Sequence
  Description of Artificial Sequence: Synthetic oligonucleotide
  Target: ATXN1; (-) strand; PAM type: NRG; PAM sequence: AAG
ttctcatacattcagacccc

SEQ ID NO: 40524 - DNA, 20 bp, Artificial Sequence
  Description of Artificial Sequence: Synthetic oligonucleotide
  Target: ATXN1; (-) strand; PAM type: NRG; PAM sequence: CAG
tattttacttctcatacatt

SEQ ID NO: 40525 - DNA, 20 bp, Artificial Sequence
  Description of Artificial Sequence: Synthetic oligonucleotide
  Target: ATXN1; (-) strand; PAM type: NRG; PAM sequence: GGG
ttttaactttcaccaaagaa

SEQ ID NO: 40526 - DNA, 20 bp, Artificial Sequence
  Description of Artificial Sequence: Synthetic oligonucleotide
  Target: ATXN1; (-) strand; PAM type: NRG; PAM sequence: AGG
attttaactttcaccaaaga

SEQ ID NO: 40527 - DNA, 20 bp, Artificial Sequence
  Description of Artificial Sequence: Synthetic oligonucleotide
  Target: ATXN1; (-) strand; PAM type: NRG; PAM sequence: AAG
gattttaactttcaccaaag

SEQ ID NO: 40528 - DNA, 20 bp, Artificial Sequence
  Description of Artificial Sequence: Synthetic oligonucleotide
  Target: ATXN1; (-) strand; PAM type: NRG; PAM sequence: AAG
caagattttaactttcacca

SEQ ID NO: 40529 - DNA, 20 bp, Artificial Sequence
  Description of Artificial Sequence: Synthetic oligonucleotide
  Target: ATXN1; (-) strand; PAM type: NRG; PAM sequence: AAG
ctatttgagatgtgtgcaac

SEQ ID NO: 40530 - DNA, 20 bp, Artificial Sequence
  Description of Artificial Sequence: Synthetic oligonucleotide
  Target: ATXN1; (-) strand; PAM type: NRG; PAM sequence: GAG
atgcttgagtgtacctattt

SEQ ID NO: 40531 - DNA, 20 bp, Artificial Sequence
  Description of Artificial Sequence: Synthetic oligonucleotide
  Target: ATXN1; (-) strand; PAM type: NRG; PAM sequence: GAG
tagatttgctatgaatgctt

SEQ ID NO: 40532 - DNA, 20 bp, Artificial Sequence
  Description of Artificial Sequence: Synthetic oligonucleotide
  Target: ATXN1; (-) strand; PAM type: NRG; PAM sequence: TAG
acctaattataaaataaaga

SEQ ID NO: 40533 - DNA, 20 bp, Artificial Sequence
  Description of Artificial Sequence: Synthetic oligonucleotide
  Target: ATXN1; (-) strand; PAM type: NRG; PAM sequence: AAG
acaaacctaattataaaata

SEQ ID NO: 40534 - DNA, 20 bp, Artificial Sequence
  Description of Artificial Sequence: Synthetic oligonucleotide
  Target: ATXN1; (-) strand; PAM type: NRG; PAM sequence: AAG
ttaatgatcagttaaccttt

SEQ ID NO: 40535 - DNA, 20 bp, Artificial Sequence
  Description of Artificial Sequence: Synthetic oligonucleotide
  Target: ATXN1; (-) strand; PAM type: NRG; PAM sequence: CAG
cttcattaacggttaatgat

SEQ ID NO: 40536 - DNA, 20 bp, Artificial Sequence
  Description of Artificial Sequence: Synthetic oligonucleotide
  Target: ATXN1; (-) strand; PAM type: NRG; PAM sequence: CGG
cagtgagatttcttcattaa

SEQ ID NO: 40537 - DNA, 20 bp, Artificial Sequence
  Description of Artificial Sequence: Synthetic oligonucleotide
  Target: ATXN1; (-) strand; PAM type: NRG; PAM sequence: GAG
tcactgagaaacccctcagt

SEQ ID NO: 40538 - DNA, 20 bp, Artificial Sequence
  Description of Artificial Sequence: Synthetic oligonucleotide
  Target: ATXN1; (-) strand; PAM type: NRG; PAM sequence: CAG
attctcactgagaaacccct

SEQ ID NO: 40539 - DNA, 20 bp, Artificial Sequence
  Description of Artificial Sequence: Synthetic oligonucleotide
  Target: ATXN1; (-) strand; PAM type: NRG; PAM sequence: GAG
tgatgatatatattctcact

SEQ ID NO: 40540 - DNA, 20 bp, Artificial Sequence
  Description of Artificial Sequence: Synthetic oligonucleotide
  Target: ATXN1; (-) strand; PAM type: NRG; PAM sequence: CAG
tccaagggaatttcaagcaa

SEQ ID NO: 40541 - DNA, 20 bp, Artificial Sequence
  Description of Artificial Sequence: Synthetic oligonucleotide
  Target: ATXN1; (-) strand; PAM type: NRG; PAM sequence: AAG
ctcctctccaagggaatttc

SEQ ID NO: 40542 - DNA, 20 bp, Artificial Sequence
  Description of Artificial Sequence: Synthetic oligonucleotide
  Target: ATXN1; (-) strand; PAM type: NRG; PAM sequence: GGG
tggagaaggctcctctccaa

SEQ ID NO: 40543 - DNA, 20 bp, Artificial Sequence
  Description of Artificial Sequence: Synthetic oligonucleotide
  Target: ATXN1; (-) strand; PAM type: NRG; PAM sequence: AGG
atggagaaggctcctctcca

SEQ ID NO: 40544 - DNA, 20 bp, Artificial Sequence
  Description of Artificial Sequence: Synthetic oligonucleotide
  Target: ATXN1; (-) strand; PAM type: NRG; PAM sequence: AAG
gatggagaaggctcctctcc

SEQ ID NO: 40545 - DNA, 20 bp, Artificial Sequence
  Description of Artificial Sequence: Synthetic oligonucleotide
  Target: ATXN1; (-) strand; PAM type: NRG; PAM sequence: AGG
agcatgttttgagatggaga

SEQ ID NO: 40546 - DNA, 20 bp, Artificial Sequence
  Description of Artificial Sequence: Synthetic oligonucleotide
  Target: ATXN1; (-) strand; PAM type: NRG; PAM sequence: AAG
cagcatgttttgagatggag

SEQ ID NO: 40547 - DNA, 20 bp, Artificial Sequence
  Description of Artificial Sequence: Synthetic oligonucleotide
  Target: ATXN1; (-) strand; PAM type: NRG; PAM sequence: GAG
tgacagcatgttttgagatg

SEQ ID NO: 40548 - DNA, 20 bp, Artificial Sequence
  Description of Artificial Sequence: Synthetic oligonucleotide
  Target: ATXN1; (-) strand; PAM type: NRG; PAM sequence: TGG
attgacagcatgttttgaga

SEQ ID NO: 40549 - DNA, 20 bp, Artificial Sequence
  Description of Artificial Sequence: Synthetic oligonucleotide
  Target: ATXN1; (-) strand; PAM type: NRG; PAM sequence: GAG
tggcattgacagcatgtttt

SEQ ID NO: 40550 - DNA, 20 bp, Artificial Sequence
  Description of Artificial Sequence: Synthetic oligonucleotide
  Target: ATXN1; (-) strand; PAM type: NRG; PAM sequence: CAG
ccagtccccgctggcattga

SEQ ID NO: 40551 - DNA, 20 bp, Artificial Sequence
  Description of Artificial Sequence: Synthetic oligonucleotide
  Target: ATXN1; (-) strand; PAM type: NRG; PAM sequence: TGG
acatccaaaccagtccccgc

SEQ ID NO: 40552 - DNA, 20 bp, Artificial Sequence
  Description of Artificial Sequence: Synthetic oligonucleotide
  Target: ATXN1; (-) strand; PAM type: NRG; PAM sequence: CAG
tctctgtttcacatccaaac

SEQ ID NO: 40553 - DNA, 20 bp, Artificial Sequence
  Description of Artificial Sequence: Synthetic oligonucleotide
  Target: ATXN1; (-) strand; PAM type: NRG; PAM sequence: AAG
cagacttattgttccagttg

SEQ ID NO: 40554 - DNA, 20 bp, Artificial Sequence
  Description of Artificial Sequence: Synthetic oligonucleotide
  Target: ATXN1; (-) strand; PAM type: NRG; PAM sequence: CAG
aattcacagacttattgttc

SEQ ID NO: 40555 - DNA, 20 bp, Artificial Sequence
  Description of Artificial Sequence: Synthetic oligonucleotide
  Target: ATXN1; (-) strand; PAM type: NRG; PAM sequence: CAG
ttttaaattcaaggaattca

SEQ ID NO: 40556 - DNA, 20 bp, Artificial Sequence
  Description of Artificial Sequence: Synthetic oligonucleotide
  Target: ATXN1; (-) strand; PAM type: NRG; PAM sequence: AGG
ccatatgggttttaaattca

SEQ ID NO: 40557 - DNA, 20 bp, Artificial Sequence
  Description of Artificial Sequence: Synthetic oligonucleotide
  Target: ATXN1; (-) strand; PAM type: NRG; PAM sequence: AAG
cccatatgggttttaaattc

SEQ ID NO: 40558 - DNA, 20 bp, Artificial Sequence
  Description of Artificial Sequence: Synthetic oligonucleotide
  Target: ATXN1; (-) strand; PAM type: NRG; PAM sequence: GGG
atcatagagaatacccatat

SEQ ID NO: 40559 - DNA, 20 bp, Artificial Sequence
  Description of Artificial Sequence: Synthetic oligonucleotide
  Target: ATXN1; (-) strand; PAM type: NRG; PAM sequence: TGG
catcatagagaatacccata

SEQ ID NO: 40560 - DNA, 20 bp, Artificial Sequence
  Description of Artificial Sequence: Synthetic oligonucleotide
  Target: ATXN1; (-) strand; PAM type: NRG; PAM sequence: GAG
ttgaagctatcagcatcata

SEQ ID NO: 40561 - DNA, 20 bp, Artificial Sequence
  Description of Artificial Sequence: Synthetic oligonucleotide
  Target: ATXN1; (-) strand; PAM type: NRG; PAM sequence: TAG
ttttgaagctatcagcatca

SEQ ID NO: 40562 - DNA, 20 bp, Artificial Sequence
  Description of Artificial Sequence: Synthetic oligonucleotide
  Target: ATXN1; (-) strand; PAM type: NRG; PAM sequence: CAG
taacaatattttgaagctat

SEQ ID NO: 40563 - DNA, 20 bp, Artificial Sequence
  Description of Artificial Sequence: Synthetic oligonucleotide
  Target: ATXN1; (-) strand; PAM type: NRG; PAM sequence: AAG
ataataataacaatattttg

SEQ ID NO: 40564 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggcaacagagc

SEQ ID NO: 40565 - DNA, 20 bp, Artificial Sequence
  Description of Artificial Sequence: Synthetic oligonucleotide
  Target: ATXN1; (-) strand; PAM type: NRG; PAM sequence: GAG
acattccagcctgggcaaca

SEQ ID NO: 40566 - DNA, 20 bp, Artificial Sequence
  Description of Artificial Sequence: Synthetic oligonucleotide
  Target: ATXN1; (-) strand; PAM type: NRG; PAM sequence: CAG
ctacattccagcctgggcaa

SEQ ID NO: 40567 - DNA, 20 bp, Artificial Sequence
  Description of Artificial Sequence: Synthetic oligonucleotide
  Target: ATXN1; (-) strand; PAM type: NRG; PAM sequence: GGG
gtgccactacattccagcct

SEQ ID NO: 40568 - DNA, 20 bp, Artificial Sequence
  Description of Artificial Sequence: Synthetic oligonucleotide
  Target: ATXN1; (-) strand; PAM type: NRG; PAM sequence: TGG
agtgccactacattccagcc

SEQ ID NO: 40569 - DNA, 20 bp, Artificial Sequence
  Description of Artificial Sequence: Synthetic oligonucleotide
  Target: ATXN1; (-) strand; PAM type: NRG; PAM sequence: CAG
gagatagtgccactacattc

SEQ ID NO: 40570 - DNA, 20 bp, Artificial Sequence
  Description of Artificial Sequence: Synthetic oligonucleotide
  Target: ATXN1; (-) strand; PAM type: NRG; PAM sequence: TAG
gagtttgcagtgagccgaga

SEQ ID NO: 40571 - DNA, 20 bp, Artificial Sequence
  Description of Artificial Sequence: Synthetic oligonucleotide
  Target: ATXN1; (-) strand; PAM type: NRG; PAM sequence: GAG
ggtggagtttgcagtgagcc

SEQ ID NO: 40572 - DNA, 20 bp, Artificial Sequence
  Description of Artificial Sequence: Synthetic oligonucleotide
  Target: ATXN1; (-) strand; PAM type: NRG; PAM sequence: GAG
caggaggtggagtttgcagt

SEQ ID NO: 40573 - DNA, 20 bp, Artificial Sequence
  Description of Artificial Sequence: Synthetic oligonucleotide
  Target: ATXN1; (-) strand; PAM type: NRG; PAM sequence: CAG
aacccaggaggtggagtttg

SEQ ID NO: 40574 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccaggaggtg

SEQ ID NO: 40575 - DNA, 20 bp, Artificial Sequence
  Description of Artificial Sequence: Synthetic oligonucleotide
  Target: ATXN1; (-) strand; PAM type: NRG; PAM sequence: TGG
aatcgcttgaacccaggagg

SEQ ID NO: 40576 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacccagg

SEQ ID NO: 40577 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaacccag

SEQ ID NO: 40578 - DNA, 20 bp, Artificial Sequence
  Description of Artificial Sequence: Synthetic oligonucleotide
  Target: ATXN1; (-) strand; PAM type: NRG; PAM sequence: AGG
caggagaatcgcttgaaccc

SEQ ID NO: 40579 - DNA, 20 bp, Artificial Sequence
  Description of Artificial Sequence: Synthetic oligonucleotide
  Target: ATXN1; (-) strand; PAM type: NRG; PAM sequence: CAG
gcaggagaatcgcttgaacc

SEQ ID NO: 40580 - DNA, 20 bp, Artificial Sequence
  Description of Artificial Sequence: Synthetic oligonucleotide
  Target: ATXN1; (-) strand; PAM type: NRG; PAM sequence: GAG
tactcgggaggctgaggcag

SEQ ID NO: 40581 - DNA, 20 bp, Artificial Sequence
  Description of Artificial Sequence: Synthetic oligonucleotide
  Target: ATXN1; (-) strand; PAM type: NRG; PAM sequence: AGG
gctactcgggaggctgaggc

SEQ ID NO: 40582 - DNA, 20 bp, Artificial Sequence
  Description of Artificial Sequence: Synthetic oligonucleotide
  Target: ATXN1; (-) strand; PAM type: NRG; PAM sequence: CAG
agctactcgggaggctgagg

SEQ ID NO: 40583 - DNA, 20 bp, Artificial Sequence
  Description of Artificial Sequence: Synthetic oligonucleotide
  Target: ATXN1; (-) strand; PAM type: NRG; PAM sequence: AGG
cccagctactcgggaggctg

SEQ ID NO: 40584 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcgggaggct

SEQ ID NO: 40585 - DNA, 20 bp, Artificial Sequence
  Description of Artificial Sequence: Synthetic oligonucleotide
  Target: ATXN1; (-) strand; PAM type: NRG; PAM sequence: AGG
atgcctcccagctactcggg

SEQ ID NO: 40586 - DNA, 20 bp, Artificial Sequence
  Description of Artificial Sequence: Synthetic oligonucleotide
  Target: ATXN1; (-) strand; PAM type: NRG; PAM sequence: GAG
tatgcctcccagctactcgg

SEQ ID NO: 40587 - DNA, 20 bp, Artificial Sequence
  Description of Artificial Sequence: Synthetic oligonucleotide
  Target: ATXN1; (-) strand; PAM type: NRG; PAM sequence: GGG
cttatgcctcccagctactc

SEQ ID NO: 40588 - DNA, 20 bp, Artificial Sequence
  Description of Artificial Sequence: Synthetic oligonucleotide
  Target: ATXN1; (-) strand; PAM type: NRG; PAM sequence: CGG
gcttatgcctcccagctact

SEQ ID NO: 40589 - DNA, 20 bp, Artificial Sequence
  Description of Artificial Sequence: Synthetic oligonucleotide
  Target: ATXN1; (-) strand; PAM type: NRG; PAM sequence: CAG
gtgtggtggcttatgcctcc

SEQ ID NO: 40590 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccaggtgtgg

SEQ ID NO: 40591 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagccaggtg

SEQ ID NO: 40592 - DNA, 20 bp, Artificial Sequence
  Description of Artificial Sequence: Synthetic oligonucleotide
  Target: ATXN1; (-) strand; PAM type: NRG; PAM sequence: AGG
taaacatacaaaaattagcc

SEQ ID NO: 40593 - DNA, 20 bp, Artificial Sequence
  Description of Artificial Sequence: Synthetic oligonucleotide
  Target: ATXN1; (-) strand; PAM type: NRG; PAM sequence: CAG
ctaaacatacaaaaattagc

SEQ ID NO: 40594 - DNA, 20 bp, Artificial Sequence
  Description of Artificial Sequence: Synthetic oligonucleotide
  Target: ATXN1; (-) strand; PAM type: NRG; PAM sequence: TAG
tctactaaacatacaaaaat

SEQ ID NO: 40595 - DNA, 20 bp, Artificial Sequence
  Description of Artificial Sequence: Synthetic oligonucleotide
  Target: ATXN1; (-) strand; PAM type: NRG; PAM sequence: TGG
caagaccagcctggccaaca

SEQ ID NO: 40596 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcaagaccagcc

SEQ ID NO: 40597 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagttcaagac

SEQ ID NO: 40598 - DNA, 20 bp, Artificial Sequence
  Description of Artificial Sequence: Synthetic oligonucleotide
  Target: ATXN1; (-) strand; PAM type: NRG; PAM sequence: AAG
tcacttgaggtcaggagttc

SEQ ID NO: 40599 - DNA, 20 bp, Artificial Sequence
  Description of Artificial Sequence: Synthetic oligonucleotide
  Target: ATXN1; (-) strand; PAM type: NRG; PAM sequence: GAG
ggcagatcacttgaggtcag

SEQ ID NO: 40600 - DNA, 20 bp, Artificial Sequence
  Description of Artificial Sequence: Synthetic oligonucleotide
  Target: ATXN1; (-) strand; PAM type: NRG; PAM sequence: AGG
caggcagatcacttgaggtc

SEQ ID NO: 40601 - DNA, 20 bp, Artificial Sequence
  Description of Artificial Sequence: Synthetic oligonucleotide
  Target: ATXN1; (-) strand; PAM type: NRG; PAM sequence: CAG
gcaggcagatcacttgaggt

SEQ ID NO: 40602 - DNA, 20 bp, Artificial Sequence
  Description of Artificial Sequence: Synthetic oligonucleotide
  Target: ATXN1; (-) strand; PAM type: NRG; PAM sequence: AGG
caaggcaggcagatcacttg

SEQ ID NO: 40603 - DNA, 20 bp, Artificial Sequence
  Description of Artificial Sequence: Synthetic oligonucleotide
  Target: ATXN1; (-) strand; PAM type: NRG; PAM sequence: GAG
ccaaggcaggcagatcactt

SEQ ID NO: 40604 - DNA, 20 bp, Artificial Sequence
  Description of Artificial Sequence: Synthetic oligonucleotide
  Target: ATXN1; (-) strand; PAM type: NRG; PAM sequence: CAG
ctttaggaggccaaggcagg

SEQ ID NO: 40605 - DNA, 20 bp, Artificial Sequence
  Description of Artificial Sequence: Synthetic oligonucleotide
  Target: ATXN1; (-) strand; PAM type: NRG; PAM sequence: AGG
gcactttaggaggccaaggc

SEQ ID NO: 40606 - DNA, 20 bp, Artificial Sequence
  Description of Artificial Sequence: Synthetic oligonucleotide
  Target: ATXN1; (-) strand; PAM type: NRG; PAM sequence: CAG
agcactttaggaggccaagg

SEQ ID NO: 40607 - DNA, 20 bp, Artificial Sequence
  Description of Artificial Sequence: Synthetic oligonucleotide
  Target: ATXN1; (-) strand; PAM type: NRG; PAM sequence: AGG
cccagcactttaggaggcca

SEQ ID NO: 40608 - DNA, 20 bp, Artificial Sequence
  Description of Artificial Sequence: Synthetic oligonucleotide
  Target: ATXN1; (-) strand; PAM type: NRG; PAM sequence: AAG
tcccagcactttaggaggcc

SEQ ID NO: 40609 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttagg

SEQ ID NO: 40610 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttag

SEQ ID NO: 40611 - DNA, 20 bp, Artificial Sequence
  Description of Artificial Sequence: Synthetic oligonucleotide
  Target: ATXN1; (-) strand; PAM type: NRG; PAM sequence: AGG
acctgtaatcccagcacttt

SEQ ID NO: 40612 - DNA, 20 bp, Artificial Sequence
  Description of Artificial Sequence: Synthetic oligonucleotide
  Target: ATXN1; (-) strand; PAM type: NRG; PAM sequence: TAG
cacctgtaatcccagcactt

SEQ ID NO: 40613 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatcc

SEQ ID NO: 40614 - DNA, 20 bp, Artificial Sequence
  Description of Artificial Sequence: Synthetic oligonucleotide
  Target: ATXN1; (-) strand; PAM type: NRG; PAM sequence: TGG
tattttgaggccgggcacgg

SEQ ID NO: 40615 - DNA, 20 bp, Artificial Sequence
  Description of Artificial Sequence: Synthetic oligonucleotide
  Target: ATXN1; (-) strand; PAM type: NRG; PAM sequence: CGG
taatattttgaggccgggca

SEQ ID NO: 40616 - DNA, 20 bp, Artificial Sequence
  Description of Artificial Sequence: Synthetic oligonucleotide
  Target: ATXN1; (-) strand; PAM type: NRG; PAM sequence: GGG
ctcaataatattttgaggcc

SEQ ID NO: 40617 - DNA, 20 bp, Artificial Sequence
  Description of Artificial Sequence: Synthetic oligonucleotide
  Target: ATXN1; (-) strand; PAM type: NRG; PAM sequence: CGG
cctcaataatattttgaggc

SEQ ID NO: 40618 - DNA, 20 bp, Artificial Sequence
  Description of Artificial Sequence: Synthetic oligonucleotide
  Target: ATXN1; (-) strand; PAM type: NRG; PAM sequence: AGG
gaaccctcaataatattttg

SEQ ID NO: 40619 - DNA, 20 bp, Artificial Sequence
  Description of Artificial Sequence: Synthetic oligonucleotide
  Target: ATXN1; (-) strand; PAM type: NRG; PAM sequence: GAG
ggaaccctcaataatatttt

SEQ ID NO: 40620 - DNA, 20 bp, Artificial Sequence
  Description of Artificial Sequence: Synthetic oligonucleotide
  Target: ATXN1; (-) strand; PAM type: NRG; PAM sequence: AGG
aaagcctgaaatgtatcatt

SEQ ID NO: 40621 - DNA, 20 bp, Artificial Sequence
  Description of Artificial Sequence: Synthetic oligonucleotide
  Target: ATXN1; (-) strand; PAM type: NRG; PAM sequence: TAG
gaaagcctgaaatgtatcat

SEQ ID NO: 40622 - DNA, 20 bp, Artificial Sequence
  Description of Artificial Sequence: Synthetic oligonucleotide
  Target: ATXN1; (-) strand; PAM type: NRG; PAM sequence: AAG
gaacttttattaaaactgga

SEQ ID NO: 40623 - DNA, 20 bp, Artificial Sequence
  Description of Artificial Sequence: Synthetic oligonucleotide
  Target: ATXN1; (-) strand; PAM type: NRG; PAM sequence: TGG
tgttgaacttttattaaaac

SEQ ID NO: 40624 - DNA, 20 bp, Artificial Sequence
  Description of Artificial Sequence: Synthetic oligonucleotide
  Target: ATXN1; (-) strand; PAM type: NRG; PAM sequence: CGG
cctaacacttagcaggtgct

SEQ ID NO: 40625 - DNA, 20 bp, Artificial Sequence
  Description of Artificial Sequence: Synthetic oligonucleotide
  Target: ATXN1; (-) strand; PAM type: NRG; PAM sequence: AGG
taaggttcctaacacttagc

SEQ ID NO: 40626 - DNA, 20 bp, Artificial Sequence
  Description of Artificial Sequence: Synthetic oligonucleotide
  Target: ATXN1; (-) strand; PAM type: NRG; PAM sequence: CAG
ctaaggttcctaacacttag

SEQ ID NO: 40627 - DNA, 20 bp, Artificial Sequence
  Description of Artificial Sequence: Synthetic oligonucleotide
  Target: ATXN1; (-) strand; PAM type: NRG; PAM sequence: TAG
cttctaaggttcctaacact

SEQ ID NO: 40628 - DNA, 20 bp, Artificial Sequence
  Description of Artificial Sequence: Synthetic oligonucleotide
  Target: ATXN1; (-) strand; PAM type: NRG; PAM sequence: AGG
aaccaatagatactcttcta

SEQ ID NO: 40629 - DNA, 20 bp, Artificial Sequence
  Description of Artificial Sequence: Synthetic oligonucleotide
  Target: ATXN1; (-) strand; PAM type: NRG; PAM sequence: AAG
taaccaatagatactcttct

SEQ ID NO: 40630 - DNA, 20 bp, Artificial Sequence
  Description of Artificial Sequence: Synthetic oligonucleotide
  Target: ATXN1; (-) strand; PAM type: NRG; PAM sequence: TAG
agaaactaggtcttaaccaa

SEQ ID NO: 40631 - DNA, 20 bp, Artificial Sequence
  Description of Artificial Sequence: Synthetic oligonucleotide
  Target: ATXN1; (-) strand; PAM type: NRG; PAM sequence: AGG
ctggtgggaggcaagaaact

SEQ ID NO: 40632 - DNA, 20 bp, Artificial Sequence
  Description of Artificial Sequence: Synthetic oligonucleotide
  Target: ATXN1; (-) strand; PAM type: NRG; PAM sequence: TAG
cctggtgggaggcaagaaac

SEQ ID NO: 40633 - DNA, 20 bp, Artificial Sequence
  Description of Artificial Sequence: Synthetic oligonucleotide
  Target: ATXN1; (-) strand; PAM type: NRG; PAM sequence: AAG
tctgtctcctggtgggaggc

SEQ ID NO: 40634 - DNA, 20 bp, Artificial Sequence
  Description of Artificial Sequence: Synthetic oligonucleotide
  Target: ATXN1; (-) strand; PAM type: NRG; PAM sequence: AGG
atgttctgtctcctggtggg

SEQ ID NO: 40635 - DNA, 20 bp, Artificial Sequence
  Description of Artificial Sequence: Synthetic oligonucleotide
  Target: ATXN1; (-) strand; PAM type: NRG; PAM sequence: GAG
tatgttctgtctcctggtgg

SEQ ID NO: 40636 - DNA, 20 bp, Artificial Sequence
  Description of Artificial Sequence: Synthetic oligonucleotide
  Target: ATXN1; (-) strand; PAM type: NRG; PAM sequence: GGG
tgtatgttctgtctcctggt

SEQ ID NO: 40637 - DNA, 20 bp, Artificial Sequence
  Description of Artificial Sequence: Synthetic oligonucleotide
  Target: ATXN1; (-) strand; PAM type: NRG; PAM sequence: TGG
gtgtatgttctgtctcctgg

SEQ ID NO: 40638 - DNA, 20 bp, Artificial Sequence
  Description of Artificial Sequence: Synthetic oligonucleotide
  Target: ATXN1; (-) strand; PAM type: NRG; PAM sequence: TGG
tgcgtgtatgttctgtctcc

SEQ ID NO: 40639 - DNA, 20 bp, Artificial Sequence
  Description of Artificial Sequence: Synthetic oligonucleotide
  Target: ATXN1; (-) strand; PAM type: NRG; PAM sequence: TGG
tcatcggatagtgtggtcac

SEQ ID NO: 40640 - DNA, 20 bp, Artificial Sequence
  Description of Artificial Sequence: Synthetic oligonucleotide
  Target: ATXN1; (-) strand; PAM type: NRG; PAM sequence: TGG
gtggacgtcatcggatagtg

SEQ ID NO: 40641 - DNA, 20 bp, Artificial Sequence
  Description of Artificial Sequence: Synthetic oligonucleotide
  Target: ATXN1; (-) strand; PAM type: NRG; PAM sequence: TAG
tctgagtggacgtcatcgga

SEQ ID NO: 40642 - DNA, 20 bp, Artificial Sequence
  Description of Artificial Sequence: Synthetic oligonucleotide
  Target: ATXN1; (-) strand; PAM type: NRG; PAM sequence: CGG
gacatctgagtggacgtcat

SEQ ID NO: 40643 - DNA, 20 bp, Artificial Sequence
  Description of Artificial Sequence: Synthetic oligonucleotide
  Target: ATXN1; (-) strand; PAM type: NRG; PAM sequence: TGG
ttgcccattcgacatctgag

SEQ ID NO: 40644 - DNA, 20 bp, Artificial Sequence
  Description of Artificial Sequence: Synthetic oligonucleotide
  Target: ATXN1; (-) strand; PAM type: NRG; PAM sequence: GAG
gagttgcccattcgacatct

SEQ ID NO: 40645 - DNA, 20 bp, Artificial Sequence
  Description of Artificial Sequence: Synthetic oligonucleotide
  Target: ATXN1; (-) strand; PAM type: NRG; PAM sequence: GAG
ttttaggtcactttaagttt

SEQ ID NO: 40646 - DNA, 20 bp, Artificial Sequence
  Description of Artificial Sequence: Synthetic oligonucleotide
  Target: ATXN1; (-) strand; PAM type: NRG; PAM sequence: AAG
ggtgtgttttaggtcacttt

SEQ ID NO: 40647 - DNA, 20 bp, Artificial Sequence
  Description of Artificial Sequence: Synthetic oligonucleotide
  Target: ATXN1; (-) strand; PAM type: NRG; PAM sequence: AGG
cgggaggtctggtgtgtttt

SEQ ID NO: 40648 - DNA, 20 bp, Artificial Sequence
  Description of Artificial Sequence: Synthetic oligonucleotide
  Target: ATXN1; (-) strand; PAM type: NRG; PAM sequence: TAG
tcgggaggtctggtgtgttt

SEQ ID NO: 40649 - DNA, 20 bp, Artificial Sequence
  Description of Artificial Sequence: Synthetic oligonucleotide
  Target: ATXN1; (-) strand; PAM type: NRG; PAM sequence: TGG
caggggcacatcgggaggtc

SEQ ID NO: 40650 - DNA, 20 bp, Artificial Sequence
  Description of Artificial Sequence: Synthetic oligonucleotide
  Target: ATXN1; (-) strand; PAM type: NRG; PAM sequence: AGG
ccgggcaggggcacatcggg

SEQ ID NO: 40651 - DNA, 20 bp, Artificial Sequence
  Description of Artificial Sequence: Synthetic oligonucleotide
  Target: ATXN1; (-) strand; PAM type: NRG; PAM sequence: GAG
accgggcaggggcacatcgg

SEQ ID NO: 40652 - DNA, 20 bp, Artificial Sequence
  Description of Artificial Sequence: Synthetic oligonucleotide
  Target: ATXN1; (-) strand; PAM type: NRG; PAM sequence: GGG
ccaccgggcaggggcacatc

SEQ ID NO: 40653 - DNA, 20 bp, Artificial Sequence
  Description of Artificial Sequence: Synthetic oligonucleotide
  Target: ATXN1; (-) strand; PAM type: NRG; PAM sequence: CGG
gccaccgggcaggggcacat

SEQ ID NO: 40654 - DNA, 20 bp, Artificial Sequence
  Description of Artificial Sequence: Synthetic oligonucleotide
  Target: ATXN1; (-) strand; PAM type: NRG; PAM sequence: GGG
atgggatggccaccgggcag

SEQ ID NO: 40655 - DNA, 20 bp, Artificial Sequence
  Description of Artificial Sequence: Synthetic oligonucleotide
  Target: ATXN1; (-) strand; PAM type: NRG; PAM sequence: GGG
catgggatggccaccgggca

SEQ ID NO: 40656 - DNA, 20 bp, Artificial Sequence
  Description of Artificial Sequence: Synthetic oligonucleotide
  Target: ATXN1; (-) strand; PAM type: NRG; PAM sequence: AGG
acatgggatggccaccgggc

SEQ ID NO: 40657 - DNA, 20 bp, Artificial Sequence
  Description of Artificial Sequence: Synthetic oligonucleotide
  Target: ATXN1; (-) strand; PAM type: NRG; PAM sequence: CAG
aacatgggatggccaccggg

SEQ ID NO: 40658 - DNA, 20 bp, Artificial Sequence
  Description of Artificial Sequence: Synthetic oligonucleotide
  Target: ATXN1; (-) strand; PAM type: NRG; PAM sequence: GGG
aagaacatgggatggccacc

SEQ ID NO: 40659 - DNA, 20 bp, Artificial Sequence
  Description of Artificial Sequence: Synthetic oligonucleotide
  Target: ATXN1; (-) strand; PAM type: NRG; PAM sequence: CGG
gaagaacatgggatggccac

SEQ ID NO: 40660 - DNA, 20 bp, Artificial Sequence
  Description of Artificial Sequence: Synthetic oligonucleotide
  Target: ATXN1; (-) strand; PAM type: NRG; PAM sequence: TGG
agatggggaagaacatggga

SEQ ID NO: 40661 - DNA, 20 bp, Artificial Sequence
  Description of Artificial Sequence: Synthetic oligonucleotide
  Target: ATXN1; (-) strand; PAM type: NRG; PAM sequence: GGG
atggagatggggaagaacat

SEQ ID NO: 40662 - DNA, 20 bp, Artificial Sequence
  Description of Artificial Sequence: Synthetic oligonucleotide
  Target: ATXN1; (-) strand; PAM type: NRG; PAM sequence: TGG
tatggagatggggaagaaca

SEQ ID NO: 40663 - DNA, 20 bp, Artificial Sequence
  Description of Artificial Sequence: Synthetic oligonucleotide
  Target: ATXN1; (-) strand; PAM type: NRG; PAM sequence: AAG
taccatttatggagatgggg

SEQ ID NO: 40664 - DNA, 20 bp, Artificial Sequence
  Description of Artificial Sequence: Synthetic oligonucleotide
  Target: ATXN1; (-) strand; PAM type: NRG; PAM sequence: GGG
ggataccatttatggagatg

SEQ ID NO: 40665 - DNA, 20 bp, Artificial Sequence
  Description of Artificial Sequence: Synthetic oligonucleotide
  Target: ATXN1; (-) strand; PAM type: NRG; PAM sequence: GGG
gggataccatttatggagat

SEQ ID NO: 40666 - DNA, 20 bp, Artificial Sequence
  Description of Artificial Sequence: Synthetic oligonucleotide
  Target: ATXN1; (-) strand; PAM type: NRG; PAM sequence: TGG
tgggataccatttatggaga

SEQ ID NO: 40667 - DNA, 20 bp, Artificial Sequence
  Description of Artificial Sequence: Synthetic oligonucleotide
  Target: ATXN1; (-) strand; PAM type: NRG; PAM sequence: GAG
agaatgggataccatttatg

SEQ ID NO: 40668 - DNA, 20 bp, Artificial Sequence
  Description of Artificial Sequence: Synthetic oligonucleotide
  Target: ATXN1; (-) strand; PAM type: NRG; PAM sequence: TGG
gaagaatgggataccattta

SEQ ID NO: 40669 - DNA, 20 bp, Artificial Sequence
  Description of Artificial Sequence: Synthetic oligonucleotide
  Target: ATXN1; (-) strand; PAM type: NRG; PAM sequence: GGG
gattgaacagccggaagaat

SEQ ID NO: 40670 - DNA, 20 bp, Artificial Sequence
  Description of Artificial Sequence: Synthetic oligonucleotide
  Target: ATXN1; (-) strand; PAM type: NRG; PAM sequence: TGG
tgattgaacagccggaagaa

SEQ ID NO: 40671 - DNA, 20 bp, Artificial Sequence
  Description of Artificial Sequence: Synthetic oligonucleotide
  Target: ATXN1; (-) strand; PAM type: NRG; PAM sequence: AAG
gtgcttgattgaacagccgg

SEQ ID NO: 40672 - DNA, 20 bp, Artificial Sequence
  Description of Artificial Sequence: Synthetic oligonucleotide
  Target: ATXN1; (-) strand; PAM type: NRG; PAM sequence: CGG
aaggtgcttgattgaacagc

SEQ ID NO: 40673 - DNA, 20 bp, Artificial Sequence
  Description of Artificial Sequence: Synthetic oligonucleotide
  Target: ATXN1; (-) strand; PAM type: NRG; PAM sequence: CAG
ttccaaggtgcttgattgaa

SEQ ID NO: 40674 - DNA, 20 bp, Artificial Sequence
  Description of Artificial Sequence: Synthetic oligonucleotide
  Target: ATXN1; (-) strand; PAM type: NRG; PAM sequence: AGG
cggaagaaagtatgattcca

SEQ ID NO: 40675 - DNA, 20 bp, Artificial Sequence
  Description of Artificial Sequence: Synthetic oligonucleotide
  Target: ATXN1; (-) strand; PAM type: NRG; PAM sequence: AAG
gcggaagaaagtatgattcc

SEQ ID NO: 40676 - DNA, 20 bp, Artificial Sequence
  Description of Artificial Sequence: Synthetic oligonucleotide
  Target: ATXN1; (-) strand; PAM type: NRG; PAM sequence: AAG
gtaagagaaagagcggaaga

SEQ ID NO: 40677 - DNA, 20 bp, Artificial Sequence
  Description of Artificial Sequence: Synthetic oligonucleotide
  Target: ATXN1; (-) strand; PAM type: NRG; PAM sequence: AAG
tgatgtaagagaaagagcgg

SEQ ID NO: 40678 - DNA, 20 bp, Artificial Sequence
  Description of Artificial Sequence: Synthetic oligonucleotide
  Target: ATXN1; (-) strand; PAM type: NRG; PAM sequence: CGG
ttgtgatgtaagagaaagag

SEQ ID NO: 40679 - DNA, 20 bp, Artificial Sequence
  Description of Artificial Sequence: Synthetic oligonucleotide
  Target: ATXN1; (-) strand; PAM type: NRG; PAM sequence: GAG
tgtttgtgatgtaagagaaa

SEQ ID NO: 40680 - DNA, 20 bp, Artificial Sequence
  Description of Artificial Sequence: Synthetic oligonucleotide
  Target: ATXN1; (-) strand; PAM type: NRG; PAM sequence: AAG
gatgtttgtgatgtaagaga

SEQ ID NO: 40681 - DNA, 20 bp, Artificial Sequence
  Description of Artificial Sequence: Synthetic oligonucleotide
  Target: ATXN1; (-) strand; PAM type: NRG; PAM sequence: GAG
ttgggatgtttgtgatgtaa

SEQ ID NO: 40682 - DNA, 20 bp, Artificial Sequence
  Description of Artificial Sequence: Synthetic oligonucleotide
  Target: ATXN1; (-) strand; PAM type: NRG; PAM sequence: AAG
aattgggatgtttgtgatgt

SEQ ID NO: 40683 - DNA, 20 bp, Artificial Sequence
  Description of Artificial Sequence: Synthetic oligonucleotide
  Target: ATXN1; (-) strand; PAM type: NRG; PAM sequence: GGG
catacagtttgcttataatt

SEQ ID NO: 40684 - DNA, 20 bp, Artificial Sequence
  Description of Artificial Sequence: Synthetic oligonucleotide
  Target: ATXN1; (-) strand; PAM type: NRG; PAM sequence: TGG
ccatacagtttgcttataat

SEQ ID NO: 40685 - DNA, 20 bp, Artificial Sequence
  Description of Artificial Sequence: Synthetic oligonucleotide
  Target: ATXN1; (-) strand; PAM type: NRG; PAM sequence: CAG
atttggaaaaggaacccata

SEQ ID NO: 40686 - DNA, 20 bp, Artificial Sequence
  Description of Artificial Sequence: Synthetic oligonucleotide
  Target: ATXN1; (-) strand; PAM type: NRG; PAM sequence: AGG
attctaggtgtatttggaaa

SEQ ID NO: 40687 - DNA, 20 bp, Artificial Sequence
  Description of Artificial Sequence: Synthetic oligonucleotide
  Target: ATXN1; (-) strand; PAM type: NRG; PAM sequence: AAG
cattctaggtgtatttggaa

SEQ ID NO: 40688 - DNA, 20 bp, Artificial Sequence
  Description of Artificial Sequence: Synthetic oligonucleotide
  Target: ATXN1; (-) strand; PAM type: NRG; PAM sequence: TGG
agtatcattctaggtgtatt

SEQ ID NO: 40689 - DNA, 20 bp, Artificial Sequence
  Description of Artificial Sequence: Synthetic oligonucleotide
  Target: ATXN1; (-) strand; PAM type: NRG; PAM sequence: AGG
taaaaaaatagtatcattct

SEQ ID NO: 40690 - DNA, 20 bp, Artificial Sequence
  Description of Artificial Sequence: Synthetic oligonucleotide
  Target: ATXN1; (-) strand; PAM type: NRG; PAM sequence: TAG
gtaaaaaaatagtatcattc

SEQ ID NO: 40691 - DNA, 20 bp, Artificial Sequence
  Description of Artificial Sequence: Synthetic oligonucleotide
  Target: ATXN1; (-) strand; PAM type: NRG; PAM sequence: TAG
tggtggaggtagtaaaaaaa

SEQ ID NO: 40692 - DNA, 20 bp, Artificial Sequence
  Description of Artificial Sequence: Synthetic oligonucleotide
  Target: ATXN1; (-) strand; PAM type: NRG; PAM sequence: TAG
caggacaaaggtggtggagg

SEQ ID NO: 40693 - DNA, 20 bp, Artificial Sequence
  Description of Artificial Sequence: Synthetic oligonucleotide
  Target: ATXN1; (-) strand; PAM type: NRG; PAM sequence: AGG
ggccaggacaaaggtggtgg

SEQ ID NO: 40694 - DNA, 20 bp, Artificial Sequence
  Description of Artificial Sequence: Synthetic oligonucleotide
  Target: ATXN1; (-) strand; PAM type: NRG; PAM sequence: GAG
tggccaggacaaaggtggtg

SEQ ID NO: 40695 - DNA, 20 bp, Artificial Sequence
  Description of Artificial Sequence: Synthetic oligonucleotide
  Target: ATXN1; (-) strand; PAM type: NRG; PAM sequence: TGG
cttggccaggacaaaggtgg

SEQ ID NO: 40696 - DNA, 20 bp, Artificial Sequence
  Description of Artificial Sequence: Synthetic oligonucleotide
  Target: ATXN1; (-) strand; PAM type: NRG; PAM sequence: TGG
cagcttggccaggacaaagg

SEQ ID NO: 40697 - DNA, 20 bp, Artificial Sequence
  Description of Artificial Sequence: Synthetic oligonucleotide
  Target: ATXN1; (-) strand; PAM type: NRG; PAM sequence: AGG
atgcagcttggccaggacaa

SEQ ID NO: 40698 - DNA, 20 bp, Artificial Sequence
  Description of Artificial Sequence: Synthetic oligonucleotide
  Target: ATXN1; (-) strand; PAM type: NRG; PAM sequence: AAG
gatgcagcttggccaggaca

SEQ ID NO: 40699 - DNA, 20 bp, Artificial Sequence
  Description of Artificial Sequence: Synthetic oligonucleotide
  Target: ATXN1; (-) strand; PAM type: NRG; PAM sequence: AGG
gagtgagatgcagcttggcc

SEQ ID NO: 40700 - DNA, 20 bp, Artificial Sequence
  Description of Artificial Sequence: Synthetic oligonucleotide
  Target: ATXN1; (-) strand; PAM type: NRG; PAM sequence: CAG
cgagtgagatgcagcttggc

SEQ ID NO: 40701 - DNA, 20 bp, Artificial Sequence
  Description of Artificial Sequence: Synthetic oligonucleotide
  Target: ATXN1; (-) strand; PAM type: NRG; PAM sequence: TGG
cgagcgagtgagatgcagct

SEQ ID NO: 40702 - DNA, 20 bp, Artificial Sequence
  Description of Artificial Sequence: Synthetic oligonucleotide
  Target: ATXN1; (-) strand; PAM type: NRG; PAM sequence: CAG
gtgaccgagcgagtgagatg

SEQ ID NO: 40703 - DNA, 20 bp, Artificial Sequence
  Description of Artificial Sequence: Synthetic oligonucleotide
  Target: ATXN1; (-) strand; PAM type: NRG; PAM sequence: GAG
catgtggtgaccgagcgagt

SEQ ID NO: 40704 - DNA, 20 bp, Artificial Sequence
  Description of Artificial Sequence: Synthetic oligonucleotide
  Target: ATXN1; (-) strand; PAM type: NRG; PAM sequence: GAG
cttgcatgtggtgaccgagc

SEQ ID NO: 40705 - DNA, 20 bp, Artificial Sequence
  Description of Artificial Sequence: Synthetic oligonucleotide
  Target: ATXN1; (-) strand; PAM type: NRG; PAM sequence: GAG
caggcttgcatgtggtgacc

SEQ ID NO: 40706 - DNA, 20 bp, Artificial Sequence
  Description of Artificial Sequence: Synthetic oligonucleotide
  Target: ATXN1; (-) strand; PAM type: NRG; PAM sequence: TGG
gaccacatcaggcttgcatg

SEQ ID NO: 40707 - DNA, 20 bp, Artificial Sequence
  Description of Artificial Sequence: Synthetic oligonucleotide
  Target: ATXN1; (-) strand; PAM type: NRG; PAM sequence: AGG
gggcacatgcagaccacatc

SEQ ID NO: 40708 - DNA, 20 bp, Artificial Sequence
  Description of Artificial Sequence: Synthetic oligonucleotide
  Target: ATXN1; (-) strand; PAM type: NRG; PAM sequence: CAG
ggggcacatgcagaccacat

SEQ ID NO: 40709 - DNA, 20 bp, Artificial Sequence
  Description of Artificial Sequence: Synthetic oligonucleotide
  Target: ATXN1; (-) strand; PAM type: NRG; PAM sequence: CAG
tagggagtaaggggcacatg

SEQ ID NO: 40710 - DNA, 20 bp, Artificial Sequence
  Description of Artificial Sequence: Synthetic oligonucleotide
  Target: ATXN1; (-) strand; PAM type: NRG; PAM sequence: GGG
gctacagtgtagggagtaag

SEQ ID NO: 40711 - DNA, 20 bp, Artificial Sequence
  Description of Artificial Sequence: Synthetic oligonucleotide
  Target: ATXN1; (-) strand; PAM type: NRG; PAM sequence: GGG
tgctacagtgtagggagtaa

SEQ ID NO: 40712 - DNA, 20 bp, Artificial Sequence
  Description of Artificial Sequence: Synthetic oligonucleotide
  Target: ATXN1; (-) strand; PAM type: NRG; PAM sequence: AGG
ttgctacagtgtagggagta

SEQ ID NO: 40713 - DNA, 20 bp, Artificial Sequence
  Description of Artificial Sequence: Synthetic oligonucleotide
  Target: ATXN1; (-) strand; PAM type: NRG; PAM sequence: AAG
gttgctacagtgtagggagt

SEQ ID NO: 40714 - DNA, 20 bp, Artificial Sequence
  Description of Artificial Sequence: Synthetic oligonucleotide
  Target: ATXN1; (-) strand; PAM type: NRG; PAM sequence: GAG
cactgttgctacagtgtagg

SEQ ID NO: 40715 - DNA, 20 bp, Artificial Sequence
  Description of Artificial Sequence: Synthetic oligonucleotide
  Target: ATXN1; (-) strand; PAM type: NRG; PAM sequence: GGG
accactgttgctacagtgta

SEQ ID NO: 40716 - DNA, 20 bp, Artificial Sequence
  Description of Artificial Sequence: Synthetic oligonucleotide
  Target: ATXN1; (-) strand; PAM type: NRG; PAM sequence: AGG
gaccactgttgctacagtgt

SEQ ID NO: 40717 - DNA, 20 bp, Artificial Sequence
  Description of Artificial Sequence: Synthetic oligonucleotide
  Target: ATXN1; (-) strand; PAM type: NRG; PAM sequence: TAG
agaccactgttgctacagtg

SEQ ID NO: 40718 - DNA, 20 bp, Artificial Sequence
  Description of Artificial Sequence: Synthetic oligonucleotide
  Target: ATXN1; (-) strand; PAM type: NRG; PAM sequence: CAG
caaggagaccactgttgcta

SEQ ID NO: 40719 - DNA, 20 bp, Artificial Sequence
  Description of Artificial Sequence: Synthetic oligonucleotide
  Target: ATXN1; (-) strand; PAM type: NRG; PAM sequence: GAG
ggggttaaagaaccagcaag

SEQ ID NO: 40720 - DNA, 20 bp, Artificial Sequence
  Description of Artificial Sequence: Synthetic oligonucleotide
  Target: ATXN1; (-) strand; PAM type: NRG; PAM sequence: AGG
gaggggttaaagaaccagca

SEQ ID NO: 40721 - DNA, 20 bp, Artificial Sequence
  Description of Artificial Sequence: Synthetic oligonucleotide
  Target: ATXN1; (-) strand; PAM type: NRG; PAM sequence: AAG
agaggggttaaagaaccagc

SEQ ID NO: 40722 - DNA, 20 bp, Artificial Sequence
  Description of Artificial Sequence: Synthetic oligonucleotide
  Target: ATXN1; (-) strand; PAM type: NRG; PAM sequence: CAG
cgcaagaggggttaaagaac

SEQ ID NO: 40723 - DNA, 20 bp, Artificial Sequence
  Description of Artificial Sequence: Synthetic oligonucleotide
  Target: ATXN1; (-) strand; PAM type: NRG; PAM sequence: AAG
ggaaggcgcaagaggggtta

SEQ ID NO: 40724 - DNA, 20 bp, Artificial Sequence
  Description of Artificial Sequence: Synthetic oligonucleotide
  Target: ATXN1; (-) strand; PAM type: NRG; PAM sequence: GGG
ccagacggaaggcgcaagag

SEQ ID NO: 40725 - DNA, 20 bp, Artificial Sequence
  Description of Artificial Sequence: Synthetic oligonucleotide
  Target: ATXN1; (-) strand; PAM type: NRG; PAM sequence: GGG
cccagacggaaggcgcaaga

SEQ ID NO: 40726 - DNA, 20 bp, Artificial Sequence
  Description of Artificial Sequence: Synthetic oligonucleotide
  Target: ATXN1; (-) strand; PAM type: NRG; PAM sequence: AGG
gcccagacggaaggcgcaag

SEQ ID NO: 40727 - DNA, 20 bp, Artificial Sequence
  Description of Artificial Sequence: Synthetic oligonucleotide
  Target: ATXN1; (-) strand; PAM type: NRG; PAM sequence: GAG
tgcccagacggaaggcgcaa

SEQ ID NO: 40728 - DNA, 20 bp, Artificial Sequence
  Description of Artificial Sequence: Synthetic oligonucleotide
  Target: ATXN1; (-) strand; PAM type: NRG; PAM sequence: AAG
ggtgcccagacggaaggcgc

SEQ ID NO: 40729 - DNA, 20 bp, Artificial Sequence
  Description of Artificial Sequence: Synthetic oligonucleotide
  Target: ATXN1; (-) strand; PAM type: NRG; PAM sequence: AGG
gtagcaggtgcccagacgga

SEQ ID NO: 40730 - DNA, 20 bp, Artificial Sequence
  Description of Artificial Sequence: Synthetic oligonucleotide
  Target: ATXN1; (-) strand; PAM type: NRG; PAM sequence: AAG
agtagcaggtgcccagacgg

SEQ ID NO: 40731 - DNA, 20 bp, Artificial Sequence
  Description of Artificial Sequence: Synthetic oligonucleotide
  Target: ATXN1; (-) strand; PAM type: NRG; PAM sequence: CGG
gagagtagcaggtgcccaga

SEQ ID NO: 40732 - DNA, 20 bp, Artificial Sequence
  Description of Artificial Sequence: Synthetic oligonucleotide
  Target: ATXN1; (-) strand; PAM type: NRG; PAM sequence: CAG
tggagagagtagcaggtgcc

SEQ ID NO: 40733 - DNA, 20 bp, Artificial Sequence
  Description of Artificial Sequence: Synthetic oligonucleotide
  Target: ATXN1; (-) strand; PAM type: NRG; PAM sequence: AGG
aaatgaatggagagagtagc

SEQ ID NO: 40734 - DNA, 20 bp, Artificial Sequence
  Description of Artificial Sequence: Synthetic oligonucleotide
  Target: ATXN1; (-) strand; PAM type: NRG; PAM sequence: CAG
caaatgaatggagagagtag

SEQ ID NO: 40735 - DNA, 20 bp, Artificial Sequence
  Description of Artificial Sequence: Synthetic oligonucleotide
  Target: ATXN1; (-) strand; PAM type: NRG; PAM sequence: TAG
ttccaaatgaatggagagag

SEQ ID NO: 40736 - DNA, 20 bp, Artificial Sequence
  Description of Artificial Sequence: Synthetic oligonucleotide
  Target: ATXN1; (-) strand; PAM type: NRG; PAM sequence: GAG
agattccaaatgaatggaga

SEQ ID NO: 40737 - DNA, 20 bp, Artificial Sequence
  Description of Artificial Sequence: Synthetic oligonucleotide
  Target: ATXN1; (-) strand; PAM type: NRG; PAM sequence: GAG
aaagattccaaatgaatgga

SEQ ID NO: 40738 - DNA, 20 bp, Artificial Sequence
  Description of Artificial Sequence: Synthetic oligonucleotide
  Target: ATXN1; (-) strand; PAM type: NRG; PAM sequence: GAG
aaaaagattccaaatgaatg

SEQ ID NO: 40739 - DNA, 20 bp, Artificial Sequence
  Description of Artificial Sequence: Synthetic oligonucleotide
  Target: ATXN1; (-) strand; PAM type: NRG; PAM sequence: TGG
caaaaaagattccaaatgaa

SEQ ID NO: 40740 - DNA, 20 bp, Artificial Sequence
  Description of Artificial Sequence: Synthetic oligonucleotide
  Target: ATXN1; (-) strand; PAM type: NRG; PAM sequence: AAG
caacagtacgtgaggcaaaa

SEQ ID NO: 40741 - DNA, 20 bp, Artificial Sequence
  Description of Artificial Sequence: Synthetic oligonucleotide
  Target: ATXN1; (-) strand; PAM type: NRG; PAM sequence: AGG
gtgggtggcaacagtacgtg

SEQ ID NO: 40742 - DNA, 20 bp, Artificial Sequence
  Description of Artificial Sequence: Synthetic oligonucleotide
  Target: ATXN1; (-) strand; PAM type: NRG; PAM sequence: GAG
agtgggtggcaacagtacgt

SEQ ID NO: 40743 - DNA, 20 bp, Artificial Sequence
  Description of Artificial Sequence: Synthetic oligonucleotide
  Target: ATXN1; (-) strand; PAM type: NRG; PAM sequence: CAG
aaaaggacagtgggtggcaa

SEQ ID NO: 40744 - DNA, 20 bp, Artificial Sequence
  Description of Artificial Sequence: Synthetic oligonucleotide
  Target: ATXN1; (-) strand; PAM type: NRG; PAM sequence: TGG
tctctgaaaaggacagtggg

SEQ ID NO: 40745 - DNA, 20 bp, Artificial Sequence
  Description of Artificial Sequence: Synthetic oligonucleotide
  Target: ATXN1; (-) strand; PAM type: NRG; PAM sequence: GGG
ttctctctgaaaaggacagt

SEQ ID NO: 40746 - DNA, 20 bp, Artificial Sequence
  Description of Artificial Sequence: Synthetic oligonucleotide
  Target: ATXN1; (-) strand; PAM type: NRG; PAM sequence: TGG
gttctctctgaaaaggacag

SEQ ID NO: 40747 - DNA, 20 bp, Artificial Sequence
  Description of Artificial Sequence: Synthetic oligonucleotide
  Target: ATXN1; (-) strand; PAM type: NRG; PAM sequence: CAG
ggagttctctctgaaaagga

SEQ ID NO: 40748 - DNA, 20 bp, Artificial Sequence
  Description of Artificial Sequence: Synthetic oligonucleotide
  Target: ATXN1; (-) strand; PAM type: NRG; PAM sequence: AGG
caggggagttctctctgaaa

SEQ ID NO: 40749 - DNA, 20 bp, Artificial Sequence
  Description of Artificial Sequence: Synthetic oligonucleotide
  Target: ATXN1; (-) strand; PAM type: NRG; PAM sequence: AAG
tcaggggagttctctctgaa

SEQ ID NO: 40750 - DNA, 20 bp, Artificial Sequence
  Description of Artificial Sequence: Synthetic oligonucleotide
  Target: ATXN1; (-) strand; PAM type: NRG; PAM sequence: GAG
tttaaatagaactgtcaggg

SEQ ID NO: 40751 - DNA, 20 bp, Artificial Sequence
  Description of Artificial Sequence: Synthetic oligonucleotide
  Target: ATXN1; (-) strand; PAM type: NRG; PAM sequence: GGG
attttaaatagaactgtcag

SEQ ID NO: 40752 - DNA, 20 bp, Artificial Sequence
  Description of Artificial Sequence: Synthetic oligonucleotide
  Target: ATXN1; (-) strand; PAM type: NRG; PAM sequence: GGG
tattttaaatagaactgtca

SEQ ID NO: 40753 - DNA, 20 bp, Artificial Sequence
  Description of Artificial Sequence: Synthetic oligonucleotide
  Target: ATXN1; (-) strand; PAM type: NRG; PAM sequence: AGG
ttattttaaatagaactgtc

SEQ ID NO: 40754 - DNA, 20 bp, Artificial Sequence
  Description of Artificial Sequence: Synthetic oligonucleotide
  Target: ATXN1; (-) strand; PAM type: NRG; PAM sequence: CAG
gttattttaaatagaactgt

SEQ ID NO: 40755 - DNA, 20 bp, Artificial Sequence
  Description of Artificial Sequence: Synthetic oligonucleotide
  Target: ATXN1; (-) strand; PAM type: NRG; PAM sequence: TAG
tagagggttgttattttaaa

SEQ ID NO: 40756 - DNA, 20 bp, Artificial Sequence
  Description of Artificial Sequence: Synthetic oligonucleotide
  Target: ATXN1; (-) strand; PAM type: NRG; PAM sequence: GGG
aggaagctatggaaactaga

SEQ ID NO: 40757 - DNA, 20 bp, Artificial Sequence
  Description of Artificial Sequence: Synthetic oligonucleotide
  Target: ATXN1; (-) strand; PAM type: NRG; PAM sequence: AGG
aaggaagctatggaaactag

SEQ ID NO: 40758 - DNA, 20 bp, Artificial Sequence
  Description of Artificial Sequence: Synthetic oligonucleotide
  Target: ATXN1; (-) strand; PAM type: NRG; PAM sequence: GAG
aaaggaagctatggaaacta

SEQ ID NO: 40759 - DNA, 20 bp, Artificial Sequence
  Description of Artificial Sequence: Synthetic oligonucleotide
  Target: ATXN1; (-) strand; PAM type: NRG; PAM sequence: TAG
aaaaaggaagctatggaaac

SEQ ID NO: 40760 - DNA, 20 bp, Artificial Sequence
  Description of Artificial Sequence: Synthetic oligonucleotide
  Target: ATXN1; (-) strand; PAM type: NRG; PAM sequence: TGG
aaaataaaaaaaggaagcta

SEQ ID NO: 40761 - DNA, 20 bp, Artificial Sequence
  Description of Artificial Sequence: Synthetic oligonucleotide
  Target: ATXN1; (-) strand; PAM type: NRG; PAM sequence: AAG
tatctcaaaataaaaaaagg

SEQ ID NO: 40762 - DNA, 20 bp, Artificial Sequence
  Description of Artificial Sequence: Synthetic oligonucleotide
  Target: ATXN1; (-) strand; PAM type: NRG; PAM sequence: AGG
ccctatctcaaaataaaaaa

SEQ ID NO: 40763 - DNA, 20 bp, Artificial Sequence
  Description of Artificial Sequence: Synthetic oligonucleotide
  Target: ATXN1; (-) strand; PAM type: NRG; PAM sequence: AAG
accctatctcaaaataaaaa

SEQ ID NO: 40764 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggcaacagaac

SEQ ID NO: 40765 - DNA, 20 bp, Artificial Sequence
  Description of Artificial Sequence: Synthetic oligonucleotide
  Target: ATXN1; (-) strand; PAM type: NRG; PAM sequence: CAG
ctgtactccagcctgggcaa

SEQ ID NO: 40766 - DNA, 20 bp, Artificial Sequence
  Description of Artificial Sequence: Synthetic oligonucleotide
  Target: ATXN1; (-) strand; PAM type: NRG; PAM sequence: GGG
atgctactgtactccagcct

SEQ ID NO: 40767 - DNA, 20 bp, Artificial Sequence
  Description of Artificial Sequence: Synthetic oligonucleotide
  Target: ATXN1; (-) strand; PAM type: NRG; PAM sequence: TGG
catgctactgtactccagcc

SEQ ID NO: 40768 - DNA, 20 bp, Artificial Sequence
  Description of Artificial Sequence: Synthetic oligonucleotide
  Target: ATXN1; (-) strand; PAM type: NRG; PAM sequence: CAG
atgatcatgctactgtactc

SEQ ID NO: 40769 - DNA, 20 bp, Artificial Sequence
  Description of Artificial Sequence: Synthetic oligonucleotide
  Target: ATXN1; (-) strand; PAM type: NRG; PAM sequence: GAG
cacgaggtcaaggctgcagt

SEQ ID NO: 40770 - DNA, 20 bp, Artificial Sequence
  Description of Artificial Sequence: Synthetic oligonucleotide
  Target: ATXN1; (-) strand; PAM type: NRG; PAM sequence: CAG
agcccacgaggtcaaggctg

SEQ ID NO: 40771 - DNA, 20 bp, Artificial Sequence
  Description of Artificial Sequence: Synthetic oligonucleotide
  Target: ATXN1; (-) strand; PAM type: NRG; PAM sequence: AGG
atcttgagcccacgaggtca

SEQ ID NO: 40772 - DNA, 20 bp, Artificial Sequence
  Description of Artificial Sequence: Synthetic oligonucleotide
  Target: ATXN1; (-) strand; PAM type: NRG; PAM sequence: AAG
tatcttgagcccacgaggtc

SEQ ID NO: 40773 - DNA, 20 bp, Artificial Sequence
  Description of Artificial Sequence: Synthetic oligonucleotide
  Target: ATXN1; (-) strand; PAM type: NRG; PAM sequence: AGG
gaagatatcttgagcccacg

SEQ ID NO: 40774 - DNA, 20 bp, Artificial Sequence
  Description of Artificial Sequence: Synthetic oligonucleotide
  Target: ATXN1; (-) strand; PAM type: NRG; PAM sequence: GAG
ggaagatatcttgagcccac

SEQ ID NO: 40775 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggaagatatctt

SEQ ID NO: 40776 - DNA, 20 bp, Artificial Sequence
  Description of Artificial Sequence: Synthetic oligonucleotide
  Target: ATXN1; (-) strand; PAM type: NRG; PAM sequence: AAG
actcaggcggctgaggcagg

SEQ ID NO: 40777 - DNA, 20 bp, Artificial Sequence
  Description of Artificial Sequence: Synthetic oligonucleotide
  Target: ATXN1; (-) strand; PAM type: NRG; PAM sequence: AGG
actactcaggcggctgaggc

SEQ ID NO: 40778 - DNA, 20 bp, Artificial Sequence
  Description of Artificial Sequence: Synthetic oligonucleotide
  Target: ATXN1; (-) strand; PAM type: NRG; PAM sequence: CAG
aactactcaggcggctgagg

SEQ ID NO: 40779 - DNA, 20 bp, Artificial Sequence
  Description of Artificial Sequence: Synthetic oligonucleotide
  Target: ATXN1; (-) strand; PAM type: NRG; PAM sequence: AGG
cccaactactcaggcggctg

SEQ ID NO: 40780 - DNA, 20 bp, Artificial Sequence
  Description of Artificial Sequence: Synthetic oligonucleotide
  Target: ATXN1; (-) strand; PAM type: NRG; PAM sequence: GAG
tcccaactactcaggcggct

SEQ ID NO: 40781 - DNA, 20 bp, Artificial Sequence
  Description of Artificial Sequence: Synthetic oligonucleotide
  Target: ATXN1; (-) strand; PAM type: NRG; PAM sequence: CGG
tgtggtcccaactactcagg

SEQ ID NO: 40782 - DNA, 20 bp, Artificial Sequence
  Description of Artificial Sequence: Synthetic oligonucleotide
  Target: ATXN1; (-) strand; PAM type: NRG; PAM sequence: AGG
gcatgtggtcccaactactc

SEQ ID NO: 40783 - DNA, 20 bp, Artificial Sequence
  Description of Artificial Sequence: Synthetic oligonucleotide
  Target: ATXN1; (-) strand; PAM type: NRG; PAM sequence: CAG
tgcatgtggtcccaactact

SEQ ID NO: 40784 - DNA, 20 bp, Artificial Sequence
  Description of Artificial Sequence: Synthetic oligonucleotide
  Target: ATXN1; (-) strand; PAM type: NRG; PAM sequence: TGG
gacatggtggtgcatgcatg

SEQ ID NO: 40785 - DNA, 20 bp, Artificial Sequence
  Description of Artificial Sequence: Synthetic oligonucleotide
  Target: ATXN1; (-) strand; PAM type: NRG; PAM sequence: TGG
aaaacattagctggacatgg

SEQ ID NO: 40786 - DNA, 20 bp, Artificial Sequence
  Description of Artificial Sequence: Synthetic oligonucleotide
  Target: ATXN1; (-) strand; PAM type: NRG; PAM sequence: TGG
aacaaaacattagctggaca

SEQ ID NO: 40787 - DNA, 20 bp, Artificial Sequence
  Description of Artificial Sequence: Synthetic oligonucleotide
  Target: ATXN1; (-) strand; PAM type: NRG; PAM sequence: TGG
ttcaccaacaaaacattagc

SEQ ID NO: 40788 - DNA, 20 bp, Artificial Sequence
  Description of Artificial Sequence: Synthetic oligonucleotide
  Target: ATXN1; (-) strand; PAM type: NRG; PAM sequence: TAG
tatcttcaccaacaaaacat

SEQ ID NO: 40789 - DNA, 20 bp, Artificial Sequence
  Description of Artificial Sequence: Synthetic oligonucleotide
  Target: ATXN1; (-) strand; PAM type: NRG; PAM sequence: AGG
ccagccaggccaacatagca

SEQ ID NO: 40790 - DNA, 20 bp, Artificial Sequence
  Description of Artificial Sequence: Synthetic oligonucleotide
  Target: ATXN1; (-) strand; PAM type: NRG; PAM sequence: AAG
accagccaggccaacatagc

SEQ ID NO: 40791 - DNA, 20 bp, Artificial Sequence
  Description of Artificial Sequence: Synthetic oligonucleotide
  Target: ATXN1; (-) strand; PAM type: NRG; PAM sequence: TAG
tgaaaccagccaggccaaca

SEQ ID NO: 40792 - DNA, 20 bp, Artificial Sequence
  Description of Artificial Sequence: Synthetic oligonucleotide
  Target: ATXN1; (-) strand; PAM type: NRG; PAM sequence: AGG
caggagttttgaaaccagcc

SEQ ID NO: 40793 - DNA, 20 bp, Artificial Sequence
  Description of Artificial Sequence: Synthetic oligonucleotide
  Target: ATXN1; (-) strand; PAM type: NRG; PAM sequence: CAG
ccaggagttttgaaaccagc

SEQ ID NO: 40794 - DNA, 20 bp, Artificial Sequence
  Description of Artificial Sequence: Synthetic oligonucleotide
  Target: ATXN1; (-) strand; PAM type: NRG; PAM sequence: CAG
gaggccaggagttttgaaac

SEQ ID NO: 40795 - DNA, 20 bp, Artificial Sequence
  Description of Artificial Sequence: Synthetic oligonucleotide
  Target: ATXN1; (-) strand; PAM type: NRG; PAM sequence: GAG
aagagggcacttgaggccag

SEQ ID NO: 40796 - DNA, 20 bp, Artificial Sequence
  Description of Artificial Sequence: Synthetic oligonucleotide
  Target: ATXN1; (-) strand; PAM type: NRG; PAM sequence: AGG
gcaagagggcacttgaggcc

SEQ ID NO: 40797 - DNA, 20 bp, Artificial Sequence
  Description of Artificial Sequence: Synthetic oligonucleotide
  Target: ATXN1; (-) strand; PAM type: NRG; PAM sequence: CAG
ggcaagagggcacttgaggc

SEQ ID NO: 40798 - DNA, 20 bp, Artificial Sequence
  Description of Artificial Sequence: Synthetic oligonucleotide
  Target: ATXN1; (-) strand; PAM type: NRG; PAM sequence: AGG
ctgaggcaagagggcacttg

SEQ ID NO: 40799 - DNA, 20 bp, Artificial Sequence
  Description of Artificial Sequence: Synthetic oligonucleotide
  Target: ATXN1; (-) strand; PAM type: NRG; PAM sequence: GAG
gctgaggcaagagggcactt

SEQ ID NO: 40800 - DNA, 20 bp, Artificial Sequence
  Description of Artificial Sequence: Synthetic oligonucleotide
  Target: ATXN1; (-) strand; PAM type: NRG; PAM sequence: GGG
tttgggaggctgaggcaaga

SEQ ID NO: 40801 - DNA, 20 bp, Artificial Sequence
  Description of Artificial Sequence: Synthetic oligonucleotide
  Target: ATXN1; (-) strand; PAM type: NRG; PAM sequence: AGG
ctttgggaggctgaggcaag

SEQ ID NO: 40802 - DNA, 20 bp, Artificial Sequence
  Description of Artificial Sequence: Synthetic oligonucleotide
  Target: ATXN1; (-) strand; PAM type: NRG; PAM sequence: GAG
actttgggaggctgaggcaa

SEQ ID NO: 40803 - DNA, 20 bp, Artificial Sequence
  Description of Artificial Sequence: Synthetic oligonucleotide
  Target: ATXN1; (-) strand; PAM type: NRG; PAM sequence: AAG
gcactttgggaggctgaggc

SEQ ID NO: 40804 - DNA, 20 bp, Artificial Sequence
  Description of Artificial Sequence: Synthetic oligonucleotide
  Target: ATXN1; (-) strand; PAM type: NRG; PAM sequence: AGG
ctcagcactttgggaggctg

SEQ ID NO: 40805 - DNA, 20 bp, Artificial Sequence
  Description of Artificial Sequence: Synthetic oligonucleotide
  Target: ATXN1; (-) strand; PAM type: NRG; PAM sequence: GAG
tctcagcactttgggaggct

SEQ ID NO: 40806 - DNA, 20 bp, Artificial Sequence
  Description of Artificial Sequence: Synthetic oligonucleotide
  Target: ATXN1; (-) strand; PAM type: NRG; PAM sequence: AGG
tgtaatctcagcactttggg

SEQ ID NO: 40807 - DNA, 20 bp, Artificial Sequence
  Description of Artificial Sequence: Synthetic oligonucleotide
  Target: ATXN1; (-) strand; PAM type: NRG; PAM sequence: GAG
ttgtaatctcagcactttgg

SEQ ID NO: 40808 - DNA, 20 bp, Artificial Sequence
  Description of Artificial Sequence: Synthetic oligonucleotide
  Target: ATXN1; (-) strand; PAM type: NRG; PAM sequence: GGG
gcttgtaatctcagcacttt

SEQ ID NO: 40809 - DNA, 20 bp, Artificial Sequence
  Description of Artificial Sequence: Synthetic oligonucleotide
  Target: ATXN1; (-) strand; PAM type: NRG; PAM sequence: TGG
tgcttgtaatctcagcactt

SEQ ID NO: 40810 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcttgtaatct

SEQ ID NO: 40811 - DNA, 20 bp, Artificial Sequence
  Description of Artificial Sequence: Synthetic oligonucleotide
  Target: ATXN1; (-) strand; PAM type: NRG; PAM sequence: TGG
ggagaaggggccaggctagg

SEQ ID NO: 40812 - DNA, 20 bp, Artificial Sequence
  Description of Artificial Sequence: Synthetic oligonucleotide
  Target: ATXN1; (-) strand; PAM type: NRG; PAM sequence: AGG
agaggagaaggggccaggct

SEQ ID NO: 40813 - DNA, 20 bp, Artificial Sequence
  Description of Artificial Sequence: Synthetic oligonucleotide
  Target: ATXN1; (-) strand; PAM type: NRG; PAM sequence: TAG
aagaggagaaggggccaggc

SEQ ID NO: 40814 - DNA, 20 bp, Artificial Sequence
  Description of Artificial Sequence: Synthetic oligonucleotide
  Target: ATXN1; (-) strand; PAM type: NRG; PAM sequence: AGG
tataaagaggagaaggggcc

SEQ ID NO: 40815 - DNA, 20 bp, Artificial Sequence
  Description of Artificial Sequence: Synthetic oligonucleotide
  Target: ATXN1; (-) strand; PAM type: NRG; PAM sequence: CAG
gtataaagaggagaaggggc

SEQ ID NO: 40816 - DNA, 20 bp, Artificial Sequence
  Description of Artificial Sequence: Synthetic oligonucleotide
  Target: ATXN1; (-) strand; PAM type: NRG; PAM sequence: GGG
cctggtataaagaggagaag

SEQ ID NO: 40817 - DNA, 20 bp, Artificial Sequence
  Description of Artificial Sequence: Synthetic oligonucleotide
  Target: ATXN1; (-) strand; PAM type: NRG; PAM sequence: GGG
ccctggtataaagaggagaa

SEQ ID NO: 40818 - DNA, 20 bp, Artificial Sequence
  Description of Artificial Sequence: Synthetic oligonucleotide
  Target: ATXN1; (-) strand; PAM type: NRG; PAM sequence: AGG
tccctggtataaagaggaga

SEQ ID NO: 40819 - DNA, 20 bp, Artificial Sequence
  Description of Artificial Sequence: Synthetic oligonucleotide
  Target: ATXN1; (-) strand; PAM type: NRG; PAM sequence: AAG
atccctggtataaagaggag

SEQ ID NO: 40820 - DNA, 20 bp, Artificial Sequence
  Description of Artificial Sequence: Synthetic oligonucleotide
  Target: ATXN1; (-) strand; PAM type: NRG; PAM sequence: GAG
gggatccctggtataaagag

SEQ ID NO: 40821 - DNA, 20 bp, Artificial Sequence
  Description of Artificial Sequence: Synthetic oligonucleotide
  Target: ATXN1; (-) strand; PAM type: NRG; PAM sequence: AGG
tggggatccctggtataaag

SEQ ID NO: 40822 - DNA, 20 bp, Artificial Sequence
  Description of Artificial Sequence: Synthetic oligonucleotide
  Target: ATXN1; (-) strand; PAM type: NRG; PAM sequence: GAG
ttggggatccctggtataaa

SEQ ID NO: 40823 - DNA, 20 bp, Artificial Sequence
  Description of Artificial Sequence: Synthetic oligonucleotide
  Target: ATXN1; (-) strand; PAM type: NRG; PAM sequence: AAG
ggttggggatccctggtata

SEQ ID NO: 40824 - DNA, 20 bp, Artificial Sequence
  Description of Artificial Sequence: Synthetic oligonucleotide
  Target: ATXN1; (-) strand; PAM type: NRG; PAM sequence: TGG
gcctgggggttggggatccc

SEQ ID NO: 40825 - DNA, 20 bp, Artificial Sequence
  Description of Artificial Sequence: Synthetic oligonucleotide
  Target: ATXN1; (-) strand; PAM type: NRG; PAM sequence: GGG
ggtctgttgcctgggggttg

SEQ ID NO: 40826 - DNA, 20 bp, Artificial Sequence
  Description of Artificial Sequence: Synthetic oligonucleotide
  Target: ATXN1; (-) strand; PAM type: NRG; PAM sequence: GGG
tggtctgttgcctgggggtt

SEQ ID NO: 40827 - DNA, 20 bp, Artificial Sequence
  Description of Artificial Sequence: Synthetic oligonucleotide
  Target: ATXN1; (-) strand; PAM type: NRG; PAM sequence: TGG
ctggtctgttgcctgggggt

SEQ ID NO: 40828 - DNA, 20 bp, Artificial Sequence
  Description of Artificial Sequence: Synthetic oligonucleotide
  Target: ATXN1; (-) strand; PAM type: NRG; PAM sequence: GGG
gctactggtctgttgcctgg

SEQ ID NO: 40829 - DNA, 20 bp, Artificial Sequence
  Description of Artificial Sequence: Synthetic oligonucleotide
  Target: ATXN1; (-) strand; PAM type: NRG; PAM sequence: GGG
tgctactggtctgttgcctg

SEQ ID NO: 40830 - DNA, 20 bp, Artificial Sequence
  Description of Artificial Sequence: Synthetic oligonucleotide
  Target: ATXN1; (-) strand; PAM type: NRG; PAM sequence: GGG
ctgctactggtctgttgcct

SEQ ID NO: 40831 - DNA, 20 bp, Artificial Sequence
  Description of Artificial Sequence: Synthetic oligonucleotide
  Target: ATXN1; (-) strand; PAM type: NRG; PAM sequence: TGG
actgctactggtctgttgcc

SEQ ID NO: 40832 - DNA, 20 bp, Artificial Sequence
  Description of Artificial Sequence: Synthetic oligonucleotide
  Target: ATXN1; (-) strand; PAM type: NRG; PAM sequence: TGG
aacaggccatggactgctac

SEQ ID NO: 40833 - DNA, 20 bp, Artificial Sequence
  Description of Artificial Sequence: Synthetic oligonucleotide
  Target: ATXN1; (-) strand; PAM type: NRG; PAM sequence: TGG
gcccagtacctaacaggcca

SEQ ID NO: 40834 - DNA, 20 bp, Artificial Sequence
  Description of Artificial Sequence: Synthetic oligonucleotide
  Target: ATXN1; (-) strand; PAM type: NRG; PAM sequence: AGG
tgtgcagcccagtacctaac

SEQ ID NO: 40835 - DNA, 20 bp, Artificial Sequence
  Description of Artificial Sequence: Synthetic oligonucleotide
  Target: ATXN1; (-) strand; PAM type: NRG; PAM sequence: CAG
ctgtgcagcccagtacctaa

SEQ ID NO: 40836 - DNA, 20 bp, Artificial Sequence
  Description of Artificial Sequence: Synthetic oligonucleotide
  Target: ATXN1; (-) strand; PAM type: NRG; PAM sequence: CAG
tcacctccagctgtgcagcc

SEQ ID NO: 40837 - DNA, 20 bp, Artificial Sequence
  Description of Artificial Sequence: Synthetic oligonucleotide
  Target: ATXN1; (-) strand; PAM type: NRG; PAM sequence: CAG
gttgctcacctccagctgtg

SEQ ID NO: 40838 - DNA, 20 bp, Artificial Sequence
  Description of Artificial Sequence: Synthetic oligonucleotide
  Target: ATXN1; (-) strand; PAM type: NRG; PAM sequence: CAG
ctggaatggttgctcacctc

SEQ ID NO: 40839 - DNA, 20 bp, Artificial Sequence
  Description of Artificial Sequence: Synthetic oligonucleotide
  Target: ATXN1; (-) strand; PAM type: NRG; PAM sequence: TGG
aggcggagctcagtctggaa

SEQ ID NO: 40840 - DNA, 20 bp, Artificial Sequence
  Description of Artificial Sequence: Synthetic oligonucleotide
  Target: ATXN1; (-) strand; PAM type: NRG; PAM sequence: TGG
acaggaggcggagctcagtc

SEQ ID NO: 40841 - DNA, 20 bp, Artificial Sequence
  Description of Artificial Sequence: Synthetic oligonucleotide
  Target: ATXN1; (-) strand; PAM type: NRG; PAM sequence: CAG
atctgacaggaggcggagct

SEQ ID NO: 40842 - DNA, 20 bp, Artificial Sequence
  Description of Artificial Sequence: Synthetic oligonucleotide
  Target: ATXN1; (-) strand; PAM type: NRG; PAM sequence: GAG
gactgatctgacaggaggcg

SEQ ID NO: 40843 - DNA, 20 bp, Artificial Sequence
  Description of Artificial Sequence: Synthetic oligonucleotide
  Target: ATXN1; (-) strand; PAM type: NRG; PAM sequence: CGG
gcgactgatctgacaggagg

SEQ ID NO: 40844 - DNA, 20 bp, Artificial Sequence
  Description of Artificial Sequence: Synthetic oligonucleotide
  Target: ATXN1; (-) strand; PAM type: NRG; PAM sequence: AGG
cttgcgactgatctgacagg

SEQ ID NO: 40845 - DNA, 20 bp, Artificial Sequence
  Description of Artificial Sequence: Synthetic oligonucleotide
  Target: ATXN1; (-) strand; PAM type: NRG; PAM sequence: GAG
gcttgcgactgatctgacag

SEQ ID NO: 40846 - DNA, 20 bp, Artificial Sequence
  Description of Artificial Sequence: Synthetic oligonucleotide
  Target: ATXN1; (-) strand; PAM type: NRG; PAM sequence: AGG
atgcttgcgactgatctgac

SEQ ID NO: 40847 - DNA, 20 bp, Artificial Sequence
  Description of Artificial Sequence: Synthetic oligonucleotide
  Target: ATXN1; (-) strand; PAM type: NRG; PAM sequence: CAG
aatgcttgcgactgatctga

SEQ ID NO: 40848 - DNA, 20 bp, Artificial Sequence
  Description of Artificial Sequence: Synthetic oligonucleotide
  Target: ATXN1; (-) strand; PAM type: NRG; PAM sequence: GAG
aatagggttcacgctcctat

SEQ ID NO: 40849 - DNA, 20 bp, Artificial Sequence
  Description of Artificial Sequence: Synthetic oligonucleotide
  Target: ATXN1; (-) strand; PAM type: NRG; PAM sequence: GGG
tgcatgcgcagtttacaata

SEQ ID NO: 40850 - DNA, 20 bp, Artificial Sequence
  Description of Artificial Sequence: Synthetic oligonucleotide
  Target: ATXN1; (-) strand; PAM type: NRG; PAM sequence: AGG
ttgcatgcgcagtttacaat

SEQ ID NO: 40851 - DNA, 20 bp, Artificial Sequence
  Description of Artificial Sequence: Synthetic oligonucleotide
  Target: ATXN1; (-) strand; PAM type: NRG; PAM sequence: TAG
cttgcatgcgcagtttacaa

SEQ ID NO: 40852 - DNA, 20 bp, Artificial Sequence
  Description of Artificial Sequence: Synthetic oligonucleotide
  Target: ATXN1; (-) strand; PAM type: NRG; PAM sequence: CAG
acctggattccttgcatgcg

SEQ ID NO: 40853 - DNA, 20 bp, Artificial Sequence
  Description of Artificial Sequence: Synthetic oligonucleotide
  Target: ATXN1; (-) strand; PAM type: NRG; PAM sequence: TGG
ctcataaggagtgcacaacc

SEQ ID NO: 40854 - DNA, 20 bp, Artificial Sequence
  Description of Artificial Sequence: Synthetic oligonucleotide
  Target: ATXN1; (-) strand; PAM type: NRG; PAM sequence: GAG
attagttagattctcataag

SEQ ID NO: 40855 - DNA, 20 bp, Artificial Sequence
  Description of Artificial Sequence: Synthetic oligonucleotide
  Target: ATXN1; (-) strand; PAM type: NRG; PAM sequence: AGG
gcattagttagattctcata

SEQ ID NO: 40856 - DNA, 20 bp, Artificial Sequence
  Description of Artificial Sequence: Synthetic oligonucleotide
  Target: ATXN1; (-) strand; PAM type: NRG; PAM sequence: AAG
ggcattagttagattctcat

SEQ ID NO: 40857 - DNA, 20 bp, Artificial Sequence
  Description of Artificial Sequence: Synthetic oligonucleotide
  Target: ATXN1; (-) strand; PAM type: NRG; PAM sequence: TAG
tcagatcatcaggcattagt

SEQ ID NO: 40858 - DNA, 20 bp, Artificial Sequence
  Description of Artificial Sequence: Synthetic oligonucleotide
  Target: ATXN1; (-) strand; PAM type: NRG; PAM sequence: TAG
cacctcagatcatcaggcat

SEQ ID NO: 40859 - DNA, 20 bp, Artificial Sequence
  Description of Artificial Sequence: Synthetic oligonucleotide
  Target: ATXN1; (-) strand; PAM type: NRG; PAM sequence: AGG
ctgttccacctcagatcatc

SEQ ID NO: 40860 - DNA, 20 bp, Artificial Sequence
  Description of Artificial Sequence: Synthetic oligonucleotide
  Target: ATXN1; (-) strand; PAM type: NRG; PAM sequence: CAG
actgttccacctcagatcat

SEQ ID NO: 40861 - DNA, 20 bp, Artificial Sequence
  Description of Artificial Sequence: Synthetic oligonucleotide
  Target: ATXN1; (-) strand; PAM type: NRG; PAM sequence: CAG
gggatgaaactgttccacct

SEQ ID NO: 40862 - DNA, 20 bp, Artificial Sequence
  Description of Artificial Sequence: Synthetic oligonucleotide
  Target: ATXN1; (-) strand; PAM type: NRG; PAM sequence: GGG
agagggagggggatggtttt

SEQ ID NO: 40863 - DNA, 20 bp, Artificial Sequence
  Description of Artificial Sequence: Synthetic oligonucleotide
  Target: ATXN1; (-) strand; PAM type: NRG; PAM sequence: TGG
aagagggagggggatggttt

SEQ ID NO: 40864 - DNA, 20 bp, Artificial Sequence
  Description of Artificial Sequence: Synthetic oligonucleotide
  Target: ATXN1; (-) strand; PAM type: NRG; PAM sequence: TGG
gatgggaagagggaggggga

SEQ ID NO: 40865 - DNA, 20 bp, Artificial Sequence
  Description of Artificial Sequence: Synthetic oligonucleotide
  Target: ATXN1; (-) strand; PAM type: NRG; PAM sequence: GGG
gcaggatgggaagagggagg

SEQ ID NO: 40866 - DNA, 20 bp, Artificial Sequence
  Description of Artificial Sequence: Synthetic oligonucleotide
  Target: ATXN1; (-) strand; PAM type: NRG; PAM sequence: GGG
ggcaggatgggaagagggag

SEQ ID NO: 40867 - DNA, 20 bp, Artificial Sequence
  Description of Artificial Sequence: Synthetic oligonucleotide
  Target: ATXN1; (-) strand; PAM type: NRG; PAM sequence: GGG
tggcaggatgggaagaggga

SEQ ID NO: 40868 - DNA, 20 bp, Artificial Sequence
  Description of Artificial Sequence: Synthetic oligonucleotide
  Target: ATXN1; (-) strand; PAM type: NRG; PAM sequence: AGG
ttggcaggatgggaagaggg

SEQ ID NO: 40869 - DNA, 20 bp, Artificial Sequence
  Description of Artificial Sequence: Synthetic oligonucleotide
  Target: ATXN1; (-) strand; PAM type: NRG; PAM sequence: GAG
tttggcaggatgggaagagg

SEQ ID NO: 40870 - DNA, 20 bp, Artificial Sequence
  Description of Artificial Sequence: Synthetic oligonucleotide
  Target: ATXN1; (-) strand; PAM type: NRG; PAM sequence: GGG
tttttggcaggatgggaaga

SEQ ID NO: 40871 - DNA, 20 bp, Artificial Sequence
  Description of Artificial Sequence: Synthetic oligonucleotide
  Target: ATXN1; (-) strand; PAM type: NRG; PAM sequence: AGG
ttttttggcaggatgggaag

SEQ ID NO: 40872 - DNA, 20 bp, Artificial Sequence
  Description of Artificial Sequence: Synthetic oligonucleotide
  Target: ATXN1; (-) strand; PAM type: NRG; PAM sequence: GAG
attttttggcaggatgggaa

SEQ ID NO: 40873 - DNA, 20 bp, Artificial Sequence
  Description of Artificial Sequence: Synthetic oligonucleotide
  Target: ATXN1; (-) strand; PAM type: NRG; PAM sequence: AAG
agattttttggcaggatggg

SEQ ID NO: 40874 - DNA, 20 bp, Artificial Sequence
  Description of Artificial Sequence: Synthetic oligonucleotide
  Target: ATXN1; (-) strand; PAM type: NRG; PAM sequence: GGG
agaagattttttggcaggat

SEQ ID NO: 40875 - DNA, 20 bp, Artificial Sequence
  Description of Artificial Sequence: Synthetic oligonucleotide
  Target: ATXN1; (-) strand; PAM type: NRG; PAM sequence: TGG
aagaagattttttggcagga

SEQ ID NO: 40876 - DNA, 20 bp, Artificial Sequence
  Description of Artificial Sequence: Synthetic oligonucleotide
  Target: ATXN1; (-) strand; PAM type: NRG; PAM sequence: AGG
atggaagaagattttttggc

SEQ ID NO: 40877 - DNA, 20 bp, Artificial Sequence
  Description of Artificial Sequence: Synthetic oligonucleotide
  Target: ATXN1; (-) strand; PAM type: NRG; PAM sequence: CAG
catggaagaagattttttgg

SEQ ID NO: 40878 - DNA, 20 bp, Artificial Sequence
  Description of Artificial Sequence: Synthetic oligonucleotide
  Target: ATXN1; (-) strand; PAM type: NRG; PAM sequence: TGG
tttcatggaagaagattttt

SEQ ID NO: 40879 - DNA, 20 bp, Artificial Sequence
  Description of Artificial Sequence: Synthetic oligonucleotide
  Target: ATXN1; (-) strand; PAM type: NRG; PAM sequence: AAG
agggactggtttcatggaag

SEQ ID NO: 40880 - DNA, 20 bp, Artificial Sequence
  Description of Artificial Sequence: Synthetic oligonucleotide
  Target: ATXN1; (-) strand; PAM type: NRG; PAM sequence: AAG
accagggactggtttcatgg

SEQ ID NO: 40881 - DNA, 20 bp, Artificial Sequence
  Description of Artificial Sequence: Synthetic oligonucleotide
  Target: ATXN1; (-) strand; PAM type: NRG; PAM sequence: TGG
ggcaccagggactggtttca

SEQ ID NO: 40882 - DNA, 20 bp, Artificial Sequence
  Description of Artificial Sequence: Synthetic oligonucleotide
  Target: ATXN1; (-) strand; PAM type: NRG; PAM sequence: TGG
tcccttttggcaccagggac

SEQ ID NO: 40883 - DNA, 20 bp, Artificial Sequence
  Description of Artificial Sequence: Synthetic oligonucleotide
  Target: ATXN1; (-) strand; PAM type: NRG; PAM sequence: GGG
accagtcccttttggcacca

SEQ ID NO: 40884 - DNA, 20 bp, Artificial Sequence
  Description of Artificial Sequence: Synthetic oligonucleotide
  Target: ATXN1; (-) strand; PAM type: NRG; PAM sequence: AGG
aaccagtcccttttggcacc

SEQ ID NO: 40885 - DNA, 20 bp, Artificial Sequence
  Description of Artificial Sequence: Synthetic oligonucleotide
  Target: ATXN1; (-) strand; PAM type: NRG; PAM sequence: CAG
taaccagtcccttttggcac

SEQ ID NO: 40886 - DNA, 20 bp, Artificial Sequence
  Description of Artificial Sequence: Synthetic oligonucleotide
  Target: ATXN1; (-) strand; PAM type: NRG; PAM sequence: TGG
agaagataaccagtcccttt

SEQ ID NO: 40887 - DNA, 20 bp, Artificial Sequence
  Description of Artificial Sequence: Synthetic oligonucleotide
  Target: ATXN1; (-) strand; PAM type: NRG; PAM sequence: CAG
agaatgcataagaagataac

SEQ ID NO: 40888 - DNA, 20 bp, Artificial Sequence
  Description of Artificial Sequence: Synthetic oligonucleotide
  Target: ATXN1; (-) strand; PAM type: NRG; PAM sequence: AAG
aataaaaaagaatgcataag

SEQ ID NO: 40889 - DNA, 20 bp, Artificial Sequence
  Description of Artificial Sequence: Synthetic oligonucleotide
  Target: ATXN1; (-) strand; PAM type: NRG; PAM sequence: AAG
gtaaataaaaaagaatgcat

SEQ ID NO: 40890 - DNA, 20 bp, Artificial Sequence
  Description of Artificial Sequence: Synthetic oligonucleotide
  Target: ATXN1; (-) strand; PAM type: NRG; PAM sequence: AAG
aaatatacaagtaaataaaa

SEQ ID NO: 40891 - DNA, 20 bp, Artificial Sequence
  Description of Artificial Sequence: Synthetic oligonucleotide
  Target: ATXN1; (-) strand; PAM type: NRG; PAM sequence: AAG
ggcaaaacagacaaatatac

SEQ ID NO: 40892 - DNA, 20 bp, Artificial Sequence
  Description of Artificial Sequence: Synthetic oligonucleotide
  Target: ATXN1; (-) strand; PAM type: NRG; PAM sequence: CAG
gtttggggaaagaggcaaaa

SEQ ID NO: 40893 - DNA, 20 bp, Artificial Sequence
  Description of Artificial Sequence: Synthetic oligonucleotide
  Target: ATXN1; (-) strand; PAM type: NRG; PAM sequence: AGG
aacactgagtttggggaaag

SEQ ID NO: 40894 - DNA, 20 bp, Artificial Sequence
  Description of Artificial Sequence: Synthetic oligonucleotide
  Target: ATXN1; (-) strand; PAM type: NRG; PAM sequence: GAG
gaacactgagtttggggaaa

SEQ ID NO: 40895 - DNA, 20 bp, Artificial Sequence
  Description of Artificial Sequence: Synthetic oligonucleotide
  Target: ATXN1; (-) strand; PAM type: NRG; PAM sequence: AAG
tagaacactgagtttgggga

SEQ ID NO: 40896 - DNA, 20 bp, Artificial Sequence
  Description of Artificial Sequence: Synthetic oligonucleotide
  Target: ATXN1; (-) strand; PAM type: NRG; PAM sequence: GGG
gagatagaacactgagtttg

SEQ ID NO: 40897 - DNA, 20 bp, Artificial Sequence
  Description of Artificial Sequence: Synthetic oligonucleotide
  Target: ATXN1; (-) strand; PAM type: NRG; PAM sequence: GGG
ggagatagaacactgagttt

SEQ ID NO: 40898 - DNA, 20 bp, Artificial Sequence
  Description of Artificial Sequence: Synthetic oligonucleotide
  Target: ATXN1; (-) strand; PAM type: NRG; PAM sequence: TGG
tggagatagaacactgagtt

SEQ ID NO: 40899 - DNA, 20 bp, Artificial Sequence
  Description of Artificial Sequence: Synthetic oligonucleotide
  Target: ATXN1; (-) strand; PAM type: NRG; PAM sequence: GAG
gactctggagatagaacact

SEQ ID NO: 40900 - DNA, 20 bp, Artificial Sequence
  Description of Artificial Sequence: Synthetic oligonucleotide
  Target: ATXN1; (-) strand; PAM type: NRG; PAM sequence: TAG
agtcttttagactctggaga

SEQ ID NO: 40901 - DNA, 20 bp, Artificial Sequence
  Description of Artificial Sequence: Synthetic oligonucleotide
  Target: ATXN1; (-) strand; PAM type: NRG; PAM sequence: GAG
aggaagtcttttagactctg

SEQ ID NO: 40902 - DNA, 20 bp, Artificial Sequence
  Description of Artificial Sequence: Synthetic oligonucleotide
  Target: ATXN1; (-) strand; PAM type: NRG; PAM sequence: TGG
ctaggaagtcttttagactc

SEQ ID NO: 40903 - DNA, 20 bp, Artificial Sequence
  Description of Artificial Sequence: Synthetic oligonucleotide
  Target: ATXN1; (-) strand; PAM type: NRG; PAM sequence: TAG
ttacttgctaggaagtcttt

SEQ ID NO: 40904 - DNA, 20 bp, Artificial Sequence
  Description of Artificial Sequence: Synthetic oligonucleotide
  Target: ATXN1; (-) strand; PAM type: NRG; PAM sequence: AAG
agcacctattacttgctagg

SEQ ID NO: 40905 - DNA, 20 bp, Artificial Sequence
  Description of Artificial Sequence: Synthetic oligonucleotide
  Target: ATXN1; (-) strand; PAM type: NRG; PAM sequence: AGG
ctgagcacctattacttgct

SEQ ID NO: 40906 - DNA, 20 bp, Artificial Sequence
  Description of Artificial Sequence: Synthetic oligonucleotide
  Target: ATXN1; (-) strand; PAM type: NRG; PAM sequence: TAG
actgagcacctattacttgc

SEQ ID NO: 40907 - DNA, 20 bp, Artificial Sequence
  Description of Artificial Sequence: Synthetic oligonucleotide
  Target: ATXN1; (-) strand; PAM type: NRG; PAM sequence: GAG
tcttctttcagattttaact

SEQ ID NO: 40908 - DNA, 20 bp, Artificial Sequence
  Description of Artificial Sequence: Synthetic oligonucleotide
  Target: ATXN1; (-) strand; PAM type: NRG; PAM sequence: CAG
ccatgcccggcctcttcttt

SEQ ID NO: 40909 - DNA, 20 bp, Artificial Sequence
  Description of Artificial Sequence: Synthetic oligonucleotide
  Target: ATXN1; (-) strand; PAM type: NRG; PAM sequence: CGG
caggtgtgagccaccatgcc

SEQ ID NO: 40910 - DNA, 20 bp, Artificial Sequence
  Description of Artificial Sequence: Synthetic oligonucleotide
  Target: ATXN1; (-) strand; PAM type: NRG; PAM sequence: GAG
agtggtgggattacaggtgt

SEQ ID NO: 40911 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtggtgggattac

SEQ ID NO: 40912 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtggtgggatta

SEQ ID NO: 40913 - DNA, 20 bp, Artificial Sequence
  Description of Artificial Sequence: Synthetic oligonucleotide
  Target: ATXN1; (-) strand; PAM type: NRG; PAM sequence: GGG
cctctgcctcccaaagtggt

SEQ ID NO: 40914 - DNA, 20 bp, Artificial Sequence
  Description of Artificial Sequence: Synthetic oligonucleotide
  Target: ATXN1; (-) strand; PAM type: NRG; PAM sequence: TGG
gcctctgcctcccaaagtgg

SEQ ID NO: 40915 - DNA, 20 bp, Artificial Sequence
  Description of Artificial Sequence: Synthetic oligonucleotide
  Target: ATXN1; (-) strand; PAM type: NRG; PAM sequence: TGG
cccgcctctgcctcccaaag

SEQ ID NO: 40916 - DNA, 20 bp, Artificial Sequence
  Description of Artificial Sequence: Synthetic oligonucleotide
  Target: ATXN1; (-) strand; PAM type: NRG; PAM sequence: AAG
cagcccgcctctgcctccca

SEQ ID NO: 40917 - DNA, 20 bp, Artificial Sequence
  Description of Artificial Sequence: Synthetic oligonucleotide
  Target: ATXN1; (-) strand; PAM type: NRG; PAM sequence: CAG
tgaactcctgacctcatgat

SEQ ID NO: 40918 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggtcaggc

SEQ ID NO: 40919 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccatgttggtc

SEQ ID NO: 40920 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccatgttggt

SEQ ID NO: 40921 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcaccatgt

SEQ ID NO: 40922 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagaca

SEQ ID NO: 40923 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagagac

SEQ ID NO: 40924 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 40925 - DNA, 20 bp, Artificial Sequence
  Description of Artificial Sequence: Synthetic oligonucleotide
  Target: ATXN1; (-) strand; PAM type: NRG; PAM sequence: GAG
atttttttgtatttttagta

SEQ ID NO: 40926 - DNA, 20 bp, Artificial Sequence
  Description of Artificial Sequence: Synthetic oligonucleotide
  Target: ATXN1; (-) strand; PAM type: NRG; PAM sequence: TAG
taatttttttgtatttttag

SEQ ID NO: 40927 - DNA, 20 bp, Artificial Sequence
  Description of Artificial Sequence: Synthetic oligonucleotide
  Target: ATXN1; (-) strand; PAM type: NRG; PAM sequence: TAG
ggctaatttttttgtatttt

SEQ ID NO: 40928 - DNA, 20 bp, Artificial Sequence
  Description of Artificial Sequence: Synthetic oligonucleotide
  Target: ATXN1; (-) strand; PAM type: NRG; PAM sequence: TGG
caggcacctgctcccacgcc

SEQ ID NO: 40929 - DNA, 20 bp, Artificial Sequence
  Description of Artificial Sequence: Synthetic oligonucleotide
  Target: ATXN1; (-) strand; PAM type: NRG; PAM sequence: AGG
ttcagagtagctgagattac

SEQ ID NO: 40930 - DNA, 20 bp, Artificial Sequence
  Description of Artificial Sequence: Synthetic oligonucleotide
  Target: ATXN1; (-) strand; PAM type: NRG; PAM sequence: CAG
cttcagagtagctgagatta

SEQ ID NO: 40931 - DNA, 20 bp, Artificial Sequence
  Description of Artificial Sequence: Synthetic oligonucleotide
  Target: ATXN1; (-) strand; PAM type: NRG; PAM sequence: GAG
cttcagccttcagagtagct

SEQ ID NO: 40932 - DNA, 20 bp, Artificial Sequence
  Description of Artificial Sequence: Synthetic oligonucleotide
  Target: ATXN1; (-) strand; PAM type: NRG; PAM sequence: TAG
tcctgcttcagccttcagag

SEQ ID NO: 40933 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcttcagccttca

SEQ ID NO: 40934 - DNA, 20 bp, Artificial Sequence
  Description of Artificial Sequence: Synthetic oligonucleotide
  Target: ATXN1; (-) strand; PAM type: NRG; PAM sequence: CAG
aattctcctgcttcagcctt

SEQ ID NO: 40935 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctgctt

SEQ ID NO: 40936 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcccaggttc

SEQ ID NO: 40937 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccgcctccc

SEQ ID NO: 40938 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccgcctcc

SEQ ID NO: 40939 - DNA, 20 bp, Artificial Sequence
  Description of Artificial Sequence: Synthetic oligonucleotide
  Target: ATXN1; (-) strand; PAM type: NRG; PAM sequence: TGG
ggggtgcaatggcgtgatct

SEQ ID NO: 40940 - DNA, 20 bp, Artificial Sequence
  Description of Artificial Sequence: Synthetic oligonucleotide
  Target: ATXN1; (-) strand; PAM type: NRG; PAM sequence: TGG
tcacctgggctggggtgcaa

SEQ ID NO: 40941 - DNA, 20 bp, Artificial Sequence
  Description of Artificial Sequence: Synthetic oligonucleotide
  Target: ATXN1; (-) strand; PAM type: NRG; PAM sequence: GGG
ttgcactgtcacctgggctg

SEQ ID NO: 40942 - DNA, 20 bp, Artificial Sequence
  Description of Artificial Sequence: Synthetic oligonucleotide
  Target: ATXN1; (-) strand; PAM type: NRG; PAM sequence: GGG
cttgcactgtcacctgggct

SEQ ID NO: 40943 - DNA, 20 bp, Artificial Sequence
  Description of Artificial Sequence: Synthetic oligonucleotide
  Target: ATXN1; (-) strand; PAM type: NRG; PAM sequence: TGG
tcttgcactgtcacctgggc

SEQ ID NO: 40944 - DNA, 20 bp, Artificial Sequence
  Description of Artificial Sequence: Synthetic oligonucleotide
  Target: ATXN1; (-) strand; PAM type: NRG; PAM sequence: GGG
ggagtcttgcactgtcacct

SEQ ID NO: 40945 - DNA, 20 bp, Artificial Sequence
  Description of Artificial Sequence: Synthetic oligonucleotide
  Target: ATXN1; (-) strand; PAM type: NRG; PAM sequence: TGG
cggagtcttgcactgtcacc

SEQ ID NO: 40946 - DNA, 20 bp, Artificial Sequence
  Description of Artificial Sequence: Synthetic oligonucleotide
  Target: ATXN1; (-) strand; PAM type: NRG; PAM sequence: GAG
tttttgttttttttaagacg

SEQ ID NO: 40947 - DNA, 20 bp, Artificial Sequence
  Description of Artificial Sequence: Synthetic oligonucleotide
  Target: ATXN1; (-) strand; PAM type: NRG; PAM sequence: CGG
tgtttttgttttttttaaga

SEQ ID NO: 40948 - DNA, 20 bp, Artificial Sequence
  Description of Artificial Sequence: Synthetic oligonucleotide
  Target: ATXN1; (-) strand; PAM type: NRG; PAM sequence: AAG
gttttgtttttgtttttttt

SEQ ID NO: 40949 - DNA, 20 bp, Artificial Sequence
  Description of Artificial Sequence: Synthetic oligonucleotide
  Target: ATXN1; (-) strand; PAM type: NRG; PAM sequence: CAG
ggcaaacagaactattcttt

SEQ ID NO: 40950 - DNA, 20 bp, Artificial Sequence
  Description of Artificial Sequence: Synthetic oligonucleotide
  Target: ATXN1; (-) strand; PAM type: NRG; PAM sequence: CAG
ttttccatacagaaggcaaa

SEQ ID NO: 40951 - DNA, 20 bp, Artificial Sequence
  Description of Artificial Sequence: Synthetic oligonucleotide
  Target: ATXN1; (-) strand; PAM type: NRG; PAM sequence: AGG
gcaatgtttttccatacaga

SEQ ID NO: 40952 - DNA, 20 bp, Artificial Sequence
  Description of Artificial Sequence: Synthetic oligonucleotide
  Target: ATXN1; (-) strand; PAM type: NRG; PAM sequence: AAG
tgcaatgtttttccatacag

SEQ ID NO: 40953 - DNA, 20 bp, Artificial Sequence
  Description of Artificial Sequence: Synthetic oligonucleotide
  Target: ATXN1; (-) strand; PAM type: NRG; PAM sequence: CAG
cattgcaatgtttttccata

SEQ ID NO: 40954 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaaaaaagacagg

SEQ ID NO: 40955 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaaaaaaaaagac

SEQ ID NO: 40956 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaaaaaaaaaaga

SEQ ID NO: 40957 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaaaaa

SEQ ID NO: 40958 - DNA, 20 bp, Artificial Sequence
  Description of Artificial Sequence: Synthetic oligonucleotide
  Target: ATXN1; (-) strand; PAM type: NRG; PAM sequence: TGG
cagcccactttagttctggc

SEQ ID NO: 40959 - DNA, 20 bp, Artificial Sequence
  Description of Artificial Sequence: Synthetic oligonucleotide
  Target: ATXN1; (-) strand; PAM type: NRG; PAM sequence: TGG
gtcacagcccactttagttc

SEQ ID NO: 40960 - DNA, 20 bp, Artificial Sequence
  Description of Artificial Sequence: Synthetic oligonucleotide
  Target: ATXN1; (-) strand; PAM type: NRG; PAM sequence: TAG
ggggaggtcacagcccactt

SEQ ID NO: 40961 - DNA, 20 bp, Artificial Sequence
  Description of Artificial Sequence: Synthetic oligonucleotide
  Target: ATXN1; (-) strand; PAM type: NRG; PAM sequence: CAG
cctctccctgggggaggtca

SEQ ID NO: 40962 - DNA, 20 bp, Artificial Sequence
  Description of Artificial Sequence: Synthetic oligonucleotide
  Target: ATXN1; (-) strand; PAM type: NRG; PAM sequence: AGG
actgctcctctccctggggg

SEQ ID NO: 40963 - DNA, 20 bp, Artificial Sequence
  Description of Artificial Sequence: Synthetic oligonucleotide
  Target: ATXN1; (-) strand; PAM type: NRG; PAM sequence: GAG
cactgctcctctccctgggg

SEQ ID NO: 40964 - DNA, 20 bp, Artificial Sequence
  Description of Artificial Sequence: Synthetic oligonucleotide
  Target: ATXN1; (-) strand; PAM type: NRG; PAM sequence: GGG
agcactgctcctctccctgg

SEQ ID NO: 40965 - DNA, 20 bp, Artificial Sequence
  Description of Artificial Sequence: Synthetic oligonucleotide
  Target: ATXN1; (-) strand; PAM type: NRG; PAM sequence: GGG
aagcactgctcctctccctg

SEQ ID NO: 40966 - DNA, 20 bp, Artificial Sequence
  Description of Artificial Sequence: Synthetic oligonucleotide
  Target: ATXN1; (-) strand; PAM type: NRG; PAM sequence: GGG
aaagcactgctcctctccct

SEQ ID NO: 40967 - DNA, 20 bp, Artificial Sequence
  Description of Artificial Sequence: Synthetic oligonucleotide
  Target: ATXN1; (-) strand; PAM type: NRG; PAM sequence: TGG
gaaagcactgctcctctccc

SEQ ID NO: 40968 - DNA, 20 bp, Artificial Sequence
  Description of Artificial Sequence: Synthetic oligonucleotide
  Target: ATXN1; (-) strand; PAM type: NRG; PAM sequence: AAG
gtaaagccacaccctggaga

SEQ ID NO: 40969 - DNA, 20 bp, Artificial Sequence
  Description of Artificial Sequence: Synthetic oligonucleotide
  Target: ATXN1; (-) strand; PAM type: NRG; PAM sequence: GAG
ggcggtaaagccacaccctg

SEQ ID NO: 40970 - DNA, 20 bp, Artificial Sequence
  Description of Artificial Sequence: Synthetic oligonucleotide
  Target: ATXN1; (-) strand; PAM type: NRG; PAM sequence: TGG
taggcggtaaagccacaccc

SEQ ID NO: 40971 - DNA, 20 bp, Artificial Sequence
  Description of Artificial Sequence: Synthetic oligonucleotide
  Target: ATXN1; (-) strand; PAM type: NRG; PAM sequence: AAG
aagctgcctgttaggcggta

SEQ ID NO: 40972 - DNA, 20 bp, Artificial Sequence
  Description of Artificial Sequence: Synthetic oligonucleotide
  Target: ATXN1; (-) strand; PAM type: NRG; PAM sequence: CGG
tgagaaagctgcctgttagg

SEQ ID NO: 40973 - DNA, 20 bp, Artificial Sequence
  Description of Artificial Sequence: Synthetic oligonucleotide
  Target: ATXN1; (-) strand; PAM type: NRG; PAM sequence: AGG
cgctgagaaagctgcctgtt

SEQ ID NO: 40974 - DNA, 20 bp, Artificial Sequence
  Description of Artificial Sequence: Synthetic oligonucleotide
  Target: ATXN1; (-) strand; PAM type: NRG; PAM sequence: TAG
ccgctgagaaagctgcctgt

SEQ ID NO: 40975 - DNA, 20 bp, Artificial Sequence
  Description of Artificial Sequence: Synthetic oligonucleotide
  Target: ATXN1; (-) strand; PAM type: NRG; PAM sequence: AAG
tggctatggctccgctgaga

SEQ ID NO: 40976 - DNA, 20 bp, Artificial Sequence
  Description of Artificial Sequence: Synthetic oligonucleotide
  Target: ATXN1; (-) strand; PAM type: NRG; PAM sequence: GAG
gaggtggctatggctccgct

SEQ ID NO: 40977 - DNA, 20 bp, Artificial Sequence
  Description of Artificial Sequence: Synthetic oligonucleotide
  Target: ATXN1; (-) strand; PAM type: NRG; PAM sequence: TGG
ctgacaaggtgaggtggcta

SEQ ID NO: 40978 - DNA, 20 bp, Artificial Sequence
  Description of Artificial Sequence: Synthetic oligonucleotide
  Target: ATXN1; (-) strand; PAM type: NRG; PAM sequence: TGG
cagcatctgacaaggtgagg

SEQ ID NO: 40979 - DNA, 20 bp, Artificial Sequence
  Description of Artificial Sequence: Synthetic oligonucleotide
  Target: ATXN1; (-) strand; PAM type: NRG; PAM sequence: AGG
cctcagcatctgacaaggtg

SEQ ID NO: 40980 - DNA, 20 bp, Artificial Sequence
  Description of Artificial Sequence: Synthetic oligonucleotide
  Target: ATXN1; (-) strand; PAM type: NRG; PAM sequence: GAG
acctcagcatctgacaaggt

SEQ ID NO: 40981 - DNA, 20 bp, Artificial Sequence
  Description of Artificial Sequence: Synthetic oligonucleotide
  Target: ATXN1; (-) strand; PAM type: NRG; PAM sequence: AGG
gacgacctcagcatctgaca

SEQ ID NO: 40982 - DNA, 20 bp, Artificial Sequence
  Description of Artificial Sequence: Synthetic oligonucleotide
  Target: ATXN1; (-) strand; PAM type: NRG; PAM sequence: AAG
tgacgacctcagcatctgac

SEQ ID NO: 40983 - DNA, 20 bp, Artificial Sequence
  Description of Artificial Sequence: Synthetic oligonucleotide
  Target: ATXN1; (-) strand; PAM type: NRG; PAM sequence: CAG
caataaaatcatgacgacct

SEQ ID NO: 40984 - DNA, 20 bp, Artificial Sequence
  Description of Artificial Sequence: Synthetic oligonucleotide
  Target: ATXN1; (-) strand; PAM type: NRG; PAM sequence: AAG
gagtggagagaaaataactg

SEQ ID NO: 40985 - DNA, 20 bp, Artificial Sequence
  Description of Artificial Sequence: Synthetic oligonucleotide
  Target: ATXN1; (-) strand; PAM type: NRG; PAM sequence: GAG
gctgcaagaacgagagtgga

SEQ ID NO: 40986 - DNA, 20 bp, Artificial Sequence
  Description of Artificial Sequence: Synthetic oligonucleotide
  Target: ATXN1; (-) strand; PAM type: NRG; PAM sequence: GAG
cagctgcaagaacgagagtg

SEQ ID NO: 40987 - DNA, 20 bp, Artificial Sequence
  Description of Artificial Sequence: Synthetic oligonucleotide
  Target: ATXN1; (-) strand; PAM type: NRG; PAM sequence: TGG
cacagctgcaagaacgagag

SEQ ID NO: 40988 - DNA, 20 bp, Artificial Sequence
  Description of Artificial Sequence: Synthetic oligonucleotide
  Target: ATXN1; (-) strand; PAM type: NRG; PAM sequence: GAG
taacacagctgcaagaacga

SEQ ID NO: 40989 - DNA, 20 bp, Artificial Sequence
  Description of Artificial Sequence: Synthetic oligonucleotide
  Target: ATXN1; (-) strand; PAM type: NRG; PAM sequence: GAG
actaacacagctgcaagaac

SEQ ID NO: 40990 - DNA, 20 bp, Artificial Sequence
  Description of Artificial Sequence: Synthetic oligonucleotide
  Target: ATXN1; (-) strand; PAM type: NRG; PAM sequence: AAG
atgattactaacacagctgc

SEQ ID NO: 40991 - DNA, 20 bp, Artificial Sequence
  Description of Artificial Sequence: Synthetic oligonucleotide
  Target: ATXN1; (-) strand; PAM type: NRG; PAM sequence: CAG
tgacttaatgattactaaca

SEQ ID NO: 40992 - DNA, 20 bp, Artificial Sequence
  Description of Artificial Sequence: Synthetic oligonucleotide
  Target: ATXN1; (-) strand; PAM type: NRG; PAM sequence: AAG
aaaatgtgtggaaccccagc

SEQ ID NO: 40993 - DNA, 20 bp, Artificial Sequence
  Description of Artificial Sequence: Synthetic oligonucleotide
  Target: ATXN1; (-) strand; PAM type: NRG; PAM sequence: CAG
ctggaaaatgtgtggaaccc

SEQ ID NO: 40994 - DNA, 20 bp, Artificial Sequence
  Description of Artificial Sequence: Synthetic oligonucleotide
  Target: ATXN1; (-) strand; PAM type: NRG; PAM sequence: TGG
aaaccattctggaaaatgtg

SEQ ID NO: 40995 - DNA, 20 bp, Artificial Sequence
  Description of Artificial Sequence: Synthetic oligonucleotide
  Target: ATXN1; (-) strand; PAM type: NRG; PAM sequence: TGG
gatttaatcagaaaccattc

SEQ ID NO: 40996 - DNA, 20 bp, Artificial Sequence
  Description of Artificial Sequence: Synthetic oligonucleotide
  Target: ATXN1; (-) strand; PAM type: NRG; PAM sequence: CAG
tattttcattgggatttaat

SEQ ID NO: 40997 - DNA, 20 bp, Artificial Sequence
  Description of Artificial Sequence: Synthetic oligonucleotide
  Target: ATXN1; (-) strand; PAM type: NRG; PAM sequence: GGG
cccatgagtttattttcatt

SEQ ID NO: 40998 - DNA, 20 bp, Artificial Sequence
  Description of Artificial Sequence: Synthetic oligonucleotide
  Target: ATXN1; (-) strand; PAM type: NRG; PAM sequence: TGG
tcccatgagtttattttcat

SEQ ID NO: 40999 - DNA, 20 bp, Artificial Sequence
  Description of Artificial Sequence: Synthetic oligonucleotide
  Target: ATXN1; (-) strand; PAM type: NRG; PAM sequence: GAG
atctgtggtactgctcccat

SEQ ID NO: 41000 - DNA, 20 bp, Artificial Sequence
  Description of Artificial Sequence: Synthetic oligonucleotide
  Target: ATXN1; (-) strand; PAM type: NRG; PAM sequence: TGG
taacgtgctttggttatctg

SEQ ID NO: 41001 - DNA, 20 bp, Artificial Sequence
  Description of Artificial Sequence: Synthetic oligonucleotide
  Target: ATXN1; (-) strand; PAM type: NRG; PAM sequence: TGG
tggcgttatgtaacgtgctt

SEQ ID NO: 41002 - DNA, 20 bp, Artificial Sequence
  Description of Artificial Sequence: Synthetic oligonucleotide
  Target: ATXN1; (-) strand; PAM type: NRG; PAM sequence: TGG
atgggctatattgagctgtc

SEQ ID NO: 41003 - DNA, 20 bp, Artificial Sequence
  Description of Artificial Sequence: Synthetic oligonucleotide
  Target: ATXN1; (-) strand; PAM type: NRG; PAM sequence: GAG
atgaaaaaatgggctatatt

SEQ ID NO: 41004 - DNA, 20 bp, Artificial Sequence
  Description of Artificial Sequence: Synthetic oligonucleotide
  Target: ATXN1; (-) strand; PAM type: NRG; PAM sequence: GGG
tatttactggatgaaaaaat

SEQ ID NO: 41005 - DNA, 20 bp, Artificial Sequence
  Description of Artificial Sequence: Synthetic oligonucleotide
  Target: ATXN1; (-) strand; PAM type: NRG; PAM sequence: TGG
atatttactggatgaaaaaa

SEQ ID NO: 41006 - DNA, 20 bp, Artificial Sequence
  Description of Artificial Sequence: Synthetic oligonucleotide
  Target: ATXN1; (-) strand; PAM type: NRG; PAM sequence: TGG
ttgaaacaggatatatttac

SEQ ID NO: 41007 - DNA, 20 bp, Artificial Sequence
  Description of Artificial Sequence: Synthetic oligonucleotide
  Target: ATXN1; (-) strand; PAM type: NRG; PAM sequence: AGG
ctgcttagggtgtttgaaac

SEQ ID NO: 41008 - DNA, 20 bp, Artificial Sequence
  Description of Artificial Sequence: Synthetic oligonucleotide
  Target: ATXN1; (-) strand; PAM type: NRG; PAM sequence: CAG
actgcttagggtgtttgaaa

SEQ ID NO: 41009 - DNA, 20 bp, Artificial Sequence
  Description of Artificial Sequence: Synthetic oligonucleotide
  Target: ATXN1; (-) strand; PAM type: NRG; PAM sequence: GGG
gctattctacttactgctta

SEQ ID NO: 41010 - DNA, 20 bp, Artificial Sequence
  Description of Artificial Sequence: Synthetic oligonucleotide
  Target: ATXN1; (-) strand; PAM type: NRG; PAM sequence: AGG
ggctattctacttactgctt

SEQ ID NO: 41011 - DNA, 20 bp, Artificial Sequence
  Description of Artificial Sequence: Synthetic oligonucleotide
  Target: ATXN1; (-) strand; PAM type: NRG; PAM sequence: TAG
aggctattctacttactgct

SEQ ID NO: 41012 - DNA, 20 bp, Artificial Sequence
  Description of Artificial Sequence: Synthetic oligonucleotide
  Target: ATXN1; (-) strand; PAM type: NRG; PAM sequence: AGG
gaaagaaagaaaagttataa

SEQ ID NO: 41013 - DNA, 20 bp, Artificial Sequence
  Description of Artificial Sequence: Synthetic oligonucleotide
  Target: ATXN1; (-) strand; PAM type: NRG; PAM sequence: AAG
agaaagaaagaaaagttata

SEQ ID NO: 41014 - DNA, 20 bp, Artificial Sequence
  Description of Artificial Sequence: Synthetic oligonucleotide
  Target: ATXN1; (-) strand; PAM type: NRG; PAM sequence: AAG
agaaagaaagaaagaaagaa

SEQ ID NO: 41015 - DNA, 20 bp, Artificial Sequence
  Description of Artificial Sequence: Synthetic oligonucleotide
  Target: ATXN1; (-) strand; PAM type: NRG; PAM sequence: AAG
aaaaaagaaagaaagaaaga

SEQ ID NO: 41016 - DNA, 20 bp, Artificial Sequence
  Description of Artificial Sequence: Synthetic oligonucleotide
  Target: ATXN1; (-) strand; PAM type: NRG; PAM sequence: AAG
caaaaaaaaagaaagaaaga

SEQ ID NO: 41017 - DNA, 20 bp, Artificial Sequence
  Description of Artificial Sequence: Synthetic oligonucleotide
  Target: ATXN1; (-) strand; PAM type: NRG; PAM sequence: AAG
gtctcaaaaaaaaagaaaga

SEQ ID NO: 41018 - DNA, 20 bp, Artificial Sequence
  Description of Artificial Sequence: Synthetic oligonucleotide
  Target: ATXN1; (-) strand; PAM type: NRG; PAM sequence: AAG
ctctgtctcaaaaaaaaaga

SEQ ID NO: 41019 - DNA, 20 bp, Artificial Sequence
  Description of Artificial Sequence: Synthetic oligonucleotide
  Target: ATXN1; (-) strand; PAM type: NRG; PAM sequence: AAG
gagactctgtctcaaaaaaa

SEQ ID NO: 41020 - DNA, 20 bp, Artificial Sequence
  Description of Artificial Sequence: Synthetic oligonucleotide
  Target: ATXN1; (-) strand; PAM type: NRG; PAM sequence: GAG
tctagccttggcgacagagt

SEQ ID NO: 41021 - DNA, 20 bp, Artificial Sequence
  Description of Artificial Sequence: Synthetic oligonucleotide
  Target: ATXN1; (-) strand; PAM type: NRG; PAM sequence: GAG
acactctagccttggcgaca

SEQ ID NO: 41022 - DNA, 20 bp, Artificial Sequence
  Description of Artificial Sequence: Synthetic oligonucleotide
  Target: ATXN1; (-) strand; PAM type: NRG; PAM sequence: CAG
ctacactctagccttggcga

SEQ ID NO: 41023 - DNA, 20 bp, Artificial Sequence
  Description of Artificial Sequence: Synthetic oligonucleotide
  Target: ATXN1; (-) strand; PAM type: NRG; PAM sequence: TGG
gcaccactacactctagcct

SEQ ID NO: 41024 - DNA, 20 bp, Artificial Sequence
  Description of Artificial Sequence: Synthetic oligonucleotide
  Target: ATXN1; (-) strand; PAM type: NRG; PAM sequence: TAG
aagatggcaccactacactc

SEQ ID NO: 41025 - DNA, 20 bp, Artificial Sequence
  Description of Artificial Sequence: Synthetic oligonucleotide
  Target: ATXN1; (-) strand; PAM type: NRG; PAM sequence: TGG
gaggttaccgtgaatcaaga

SEQ ID NO: 41026 - DNA, 20 bp, Artificial Sequence
  Description of Artificial Sequence: Synthetic oligonucleotide
  Target: ATXN1; (-) strand; PAM type: NRG; PAM sequence: AAG
ggcagaggttaccgtgaatc

SEQ ID NO: 41027 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctgggaggcag

SEQ ID NO: 41028 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaacctgggaggca

SEQ ID NO: 41029 - DNA, 20 bp, Artificial Sequence
  Description of Artificial Sequence: Synthetic oligonucleotide
  Target: ATXN1; (-) strand; PAM type: NRG; PAM sequence: CAG
aattgcttgaacctgggagg

SEQ ID NO: 41030 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaacctggg

SEQ ID NO: 41031 - DNA, 20 bp, Artificial Sequence
  Description of Artificial Sequence: Synthetic oligonucleotide
  Target: ATXN1; (-) strand; PAM type: NRG; PAM sequence: GAG
ggagaattgcttgaacctgg

SEQ ID NO: 41032 - DNA, 20 bp, Artificial Sequence
  Description of Artificial Sequence: Synthetic oligonucleotide
  Target: ATXN1; (-) strand; PAM type: NRG; PAM sequence: GGG
caggagaattgcttgaacct

SEQ ID NO: 41033 - DNA, 20 bp, Artificial Sequence
  Description of Artificial Sequence: Synthetic oligonucleotide
  Target: ATXN1; (-) strand; PAM type: NRG; PAM sequence: TGG
gcaggagaattgcttgaacc

SEQ ID NO: 41034 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcag

SEQ ID NO: 41035 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggctgaggc

SEQ ID NO: 41036 - DNA, 20 bp, Artificial Sequence
  Description of Artificial Sequence: Synthetic oligonucleotide
  Target: ATXN1; (-) strand; PAM type: NRG; PAM sequence: CAG
agctacttgggaggctgagg

SEQ ID NO: 41037 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 41038 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 41039 - DNA, 20 bp, Artificial Sequence
  Description of Artificial Sequence: Synthetic oligonucleotide
  Target: ATXN1; (-) strand; PAM type: NRG; PAM sequence: AGG
tataatcccagctacttggg

SEQ ID NO: 41040 - DNA, 20 bp, Artificial Sequence
  Description of Artificial Sequence: Synthetic oligonucleotide
  Target: ATXN1; (-) strand; PAM type: NRG; PAM sequence: GAG
ctataatcccagctacttgg

SEQ ID NO: 41041 - DNA, 20 bp, Artificial Sequence
  Description of Artificial Sequence: Synthetic oligonucleotide
  Target: ATXN1; (-) strand; PAM type: NRG; PAM sequence: GGG
gcctataatcccagctactt

SEQ ID NO: 41042 - DNA, 20 bp, Artificial Sequence
  Description of Artificial Sequence: Synthetic oligonucleotide
  Target: ATXN1; (-) strand; PAM type: NRG; PAM sequence: TGG
cgcctataatcccagctact

SEQ ID NO: 41043 - DNA, 20 bp, Artificial Sequence
  Description of Artificial Sequence: Synthetic oligonucleotide
  Target: ATXN1; (-) strand; PAM type: NRG; PAM sequence: CAG
gtggcaggcgcctataatcc

SEQ ID NO: 41044 - DNA, 20 bp, Artificial Sequence
  Description of Artificial Sequence: Synthetic oligonucleotide
  Target: ATXN1; (-) strand; PAM type: NRG; PAM sequence: AGG
aattagcctggtgtggtggc

SEQ ID NO: 41045 - DNA, 20 bp, Artificial Sequence
  Description of Artificial Sequence: Synthetic oligonucleotide
  Target: ATXN1; (-) strand; PAM type: NRG; PAM sequence: CAG
aaattagcctggtgtggtgg

SEQ ID NO: 41046 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagcctggtgtgg

SEQ ID NO: 41047 - DNA, 20 bp, Artificial Sequence
  Description of Artificial Sequence: Synthetic oligonucleotide
  Target: ATXN1; (-) strand; PAM type: NRG; PAM sequence: TGG
acaaaaaaattagcctggtg

SEQ ID NO: 41048 - DNA, 20 bp, Artificial Sequence
  Description of Artificial Sequence: Synthetic oligonucleotide
  Target: ATXN1; (-) strand; PAM type: NRG; PAM sequence: TGG
taaatacaaaaaaattagcc

SEQ ID NO: 41049 - DNA, 20 bp, Artificial Sequence
  Description of Artificial Sequence: Synthetic oligonucleotide
  Target: ATXN1; (-) strand; PAM type: NRG; PAM sequence: TAG
tctactaaatacaaaaaaat

SEQ ID NO: 41050 - DNA, 20 bp, Artificial Sequence
  Description of Artificial Sequence: Synthetic oligonucleotide
  Target: ATXN1; (-) strand; PAM type: NRG; PAM sequence: TGG
caagaccagcctgactaaca

SEQ ID NO: 41051 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaagagttcaagac

SEQ ID NO: 41052 - DNA, 20 bp, Artificial Sequence
  Description of Artificial Sequence: Synthetic oligonucleotide
  Target: ATXN1; (-) strand; PAM type: NRG; PAM sequence: AAG
tcatctgaggtcaagagttc

SEQ ID NO: 41053 - DNA, 20 bp, Artificial Sequence
  Description of Artificial Sequence: Synthetic oligonucleotide
  Target: ATXN1; (-) strand; PAM type: NRG; PAM sequence: GAG
ggtggatcatctgaggtcaa

SEQ ID NO: 41054 - DNA, 20 bp, Artificial Sequence
  Description of Artificial Sequence: Synthetic oligonucleotide
  Target: ATXN1; (-) strand; PAM type: NRG; PAM sequence: AAG
tgggtggatcatctgaggtc

SEQ ID NO: 41055 - DNA, 20 bp, Artificial Sequence
  Description of Artificial Sequence: Synthetic oligonucleotide
  Target: ATXN1; (-) strand; PAM type: NRG; PAM sequence: AGG
cgaggtgggtggatcatctg

SEQ ID NO: 41056 - DNA, 20 bp, Artificial Sequence
  Description of Artificial Sequence: Synthetic oligonucleotide
  Target: ATXN1; (-) strand; PAM type: NRG; PAM sequence: GAG
ccgaggtgggtggatcatct

SEQ ID NO: 41057 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccgaggtggg

SEQ ID NO: 41058 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccgaggt

SEQ ID NO: 41059 - DNA, 20 bp, Artificial Sequence
  Description of Artificial Sequence: Synthetic oligonucleotide
  Target: ATXN1; (-) strand; PAM type: NRG; PAM sequence: TGG
agcactttgggaggccgagg

SEQ ID NO: 41060 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggccg

SEQ ID NO: 41061 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 41062 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 41063 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 41064 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagcacttt

SEQ ID NO: 41065 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagcactt

SEQ ID NO: 41066 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatcc

SEQ ID NO: 41067 - DNA, 20 bp, Artificial Sequence
  Description of Artificial Sequence: Synthetic oligonucleotide
  Target: ATXN1; (-) strand; PAM type: NRG; PAM sequence: TGG
aaggccatccctgggcgcgg

SEQ ID NO: 41068 - DNA, 20 bp, Artificial Sequence
  Description of Artificial Sequence: Synthetic oligonucleotide
  Target: ATXN1; (-) strand; PAM type: NRG; PAM sequence: CGG
ataaaggccatccctgggcg

SEQ ID NO: 41069 - DNA, 20 bp, Artificial Sequence
  Description of Artificial Sequence: Synthetic oligonucleotide
  Target: ATXN1; (-) strand; PAM type: NRG; PAM sequence: GGG
aaagtataaaggccatccct

SEQ ID NO: 41070 - DNA, 20 bp, Artificial Sequence
  Description of Artificial Sequence: Synthetic oligonucleotide
  Target: ATXN1; (-) strand; PAM type: NRG; PAM sequence: TGG
aaaagtataaaggccatccc

SEQ ID NO: 41071 - DNA, 20 bp, Artificial Sequence
  Description of Artificial Sequence: Synthetic oligonucleotide
  Target: ATXN1; (-) strand; PAM type: NRG; PAM sequence: AGG
tcaagcttacaaaagtataa

SEQ ID NO: 41072 - DNA, 20 bp, Artificial Sequence
  Description of Artificial Sequence: Synthetic oligonucleotide
  Target: ATXN1; (-) strand; PAM type: NRG; PAM sequence: AAG
ctcaagcttacaaaagtata

SEQ ID NO: 41073 - DNA, 20 bp, Artificial Sequence
  Description of Artificial Sequence: Synthetic oligonucleotide
  Target: ATXN1; (-) strand; PAM type: NRG; PAM sequence: AAG
gagggccctcaagcttacaa

SEQ ID NO: 41074 - DNA, 20 bp, Artificial Sequence
  Description of Artificial Sequence: Synthetic oligonucleotide
  Target: ATXN1; (-) strand; PAM type: NRG; PAM sequence: AAG
atgaaagacagagggccctc

SEQ ID NO: 41075 - DNA, 20 bp, Artificial Sequence
  Description of Artificial Sequence: Synthetic oligonucleotide
  Target: ATXN1; (-) strand; PAM type: NRG; PAM sequence: GGG
atccagagatgaaagacaga

SEQ ID NO: 41076 - DNA, 20 bp, Artificial Sequence
  Description of Artificial Sequence: Synthetic oligonucleotide
  Target: ATXN1; (-) strand; PAM type: NRG; PAM sequence: AGG
catccagagatgaaagacag

SEQ ID NO: 41077 - DNA, 20 bp, Artificial Sequence
  Description of Artificial Sequence: Synthetic oligonucleotide
  Target: ATXN1; (-) strand; PAM type: NRG; PAM sequence: GAG
gcatccagagatgaaagaca

SEQ ID NO: 41078 - DNA, 20 bp, Artificial Sequence
  Description of Artificial Sequence: Synthetic oligonucleotide
  Target: ATXN1; (-) strand; PAM type: NRG; PAM sequence: CAG
gggcatccagagatgaaaga

SEQ ID NO: 41079 - DNA, 20 bp, Artificial Sequence
  Description of Artificial Sequence: Synthetic oligonucleotide
  Target: ATXN1; (-) strand; PAM type: NRG; PAM sequence: AAG
gacagggcatccagagatga

SEQ ID NO: 41080 - DNA, 20 bp, Artificial Sequence
  Description of Artificial Sequence: Synthetic oligonucleotide
  Target: ATXN1; (-) strand; PAM type: NRG; PAM sequence: GAG
tgctggcgacagggcatcca

SEQ ID NO: 41081 - DNA, 20 bp, Artificial Sequence
  Description of Artificial Sequence: Synthetic oligonucleotide
  Target: ATXN1; (-) strand; PAM type: NRG; PAM sequence: CAG
ggtgctggcgacagggcatc

SEQ ID NO: 41082 - DNA, 20 bp, Artificial Sequence
  Description of Artificial Sequence: Synthetic oligonucleotide
  Target: ATXN1; (-) strand; PAM type: NRG; PAM sequence: GGG
agcaagaggtgctggcgaca

SEQ ID NO: 41083 - DNA, 20 bp, Artificial Sequence
  Description of Artificial Sequence: Synthetic oligonucleotide
  Target: ATXN1; (-) strand; PAM type: NRG; PAM sequence: AGG
aagcaagaggtgctggcgac

SEQ ID NO: 41084 - DNA, 20 bp, Artificial Sequence
  Description of Artificial Sequence: Synthetic oligonucleotide
  Target: ATXN1; (-) strand; PAM type: NRG; PAM sequence: CAG
aaagcaagaggtgctggcga

SEQ ID NO: 41085 - DNA, 20 bp, Artificial Sequence
  Description of Artificial Sequence: Synthetic oligonucleotide
  Target: ATXN1; (-) strand; PAM type: NRG; PAM sequence: TGG
cccccaaaagcaagaggtgc

SEQ ID NO: 41086 - DNA, 20 bp, Artificial Sequence
  Description of Artificial Sequence: Synthetic oligonucleotide
  Target: ATXN1; (-) strand; PAM type: NRG; PAM sequence: AGG
ggtccacccccaaaagcaag

SEQ ID NO: 41087 - DNA, 20 bp, Artificial Sequence
  Description of Artificial Sequence: Synthetic oligonucleotide
  Target: ATXN1; (-) strand; PAM type: NRG; PAM sequence: GAG
cggtccacccccaaaagcaa

SEQ ID NO: 41088 - DNA, 20 bp, Artificial Sequence
  Description of Artificial Sequence: Synthetic oligonucleotide
  Target: ATXN1; (-) strand; PAM type: NRG; PAM sequence: AAG
ggcggtccacccccaaaagc

SEQ ID NO: 41089 - DNA, 20 bp, Artificial Sequence
  Description of Artificial Sequence: Synthetic oligonucleotide
  Target: ATXN1; (-) strand; PAM type: NRG; PAM sequence: AAG
gggaggcggtccacccccaa

SEQ ID NO: 41090 - DNA, 20 bp, Artificial Sequence
  Description of Artificial Sequence: Synthetic oligonucleotide
  Target: ATXN1; (-) strand; PAM type: NRG; PAM sequence: CGG
gagtggaggagggtgggagg

SEQ ID NO: 41091 - DNA, 20 bp, Artificial Sequence
  Description of Artificial Sequence: Synthetic oligonucleotide
  Target: ATXN1; (-) strand; PAM type: NRG; PAM sequence: AGG
aaagagtggaggagggtggg

SEQ ID NO: 41092 - DNA, 20 bp, Artificial Sequence
  Description of Artificial Sequence: Synthetic oligonucleotide
  Target: ATXN1; (-) strand; PAM type: NRG; PAM sequence: GAG
gaaagagtggaggagggtgg

SEQ ID NO: 41093 - DNA, 20 bp, Artificial Sequence
  Description of Artificial Sequence: Synthetic oligonucleotide
  Target: ATXN1; (-) strand; PAM type: NRG; PAM sequence: GGG
gggaaagagtggaggagggt

SEQ ID NO: 41094 - DNA, 20 bp, Artificial Sequence
  Description of Artificial Sequence: Synthetic oligonucleotide
  Target: ATXN1; (-) strand; PAM type: NRG; PAM sequence: TGG
agggaaagagtggaggaggg

SEQ ID NO: 41095 - DNA, 20 bp, Artificial Sequence
  Description of Artificial Sequence: Synthetic oligonucleotide
  Target: ATXN1; (-) strand; PAM type: NRG; PAM sequence: GGG
gggagggaaagagtggagga

SEQ ID NO: 41096 - DNA, 20 bp, Artificial Sequence
  Description of Artificial Sequence: Synthetic oligonucleotide
  Target: ATXN1; (-) strand; PAM type: NRG; PAM sequence: AGG
agggagggaaagagtggagg

SEQ ID NO: 41097 - DNA, 20 bp, Artificial Sequence
  Description of Artificial Sequence: Synthetic oligonucleotide
  Target: ATXN1; (-) strand; PAM type: NRG; PAM sequence: GAG
gagggagggaaagagtggag

SEQ ID NO: 41098 - DNA, 20 bp, Artificial Sequence
  Description of Artificial Sequence: Synthetic oligonucleotide
  Target: ATXN1; (-) strand; PAM type: NRG; PAM sequence: AGG
aggagggagggaaagagtgg

SEQ ID NO: 41099 - DNA, 20 bp, Artificial Sequence
  Description of Artificial Sequence: Synthetic oligonucleotide
  Target: ATXN1; (-) strand; PAM type: NRG; PAM sequence: GAG
gaggagggagggaaagagtg

SEQ ID NO: 41100 - DNA, 20 bp, Artificial Sequence
  Description of Artificial Sequence: Synthetic oligonucleotide
  Target: ATXN1; (-) strand; PAM type: NRG; PAM sequence: TGG
gggaggagggagggaaagag

SEQ ID NO: 41101 - DNA, 20 bp, Artificial Sequence
  Description of Artificial Sequence: Synthetic oligonucleotide
  Target: ATXN1; (-) strand; PAM type: NRG; PAM sequence: GAG
agtgggaggagggagggaaa

SEQ ID NO: 41102 - DNA, 20 bp, Artificial Sequence
  Description of Artificial Sequence: Synthetic oligonucleotide
  Target: ATXN1; (-) strand; PAM type: NRG; PAM sequence: AAG
gcagtgggaggagggaggga

SEQ ID NO: 41103 - DNA, 20 bp, Artificial Sequence
  Description of Artificial Sequence: Synthetic oligonucleotide
  Target: ATXN1; (-) strand; PAM type: NRG; PAM sequence: GGG
ggcagcagtgggaggaggga

SEQ ID NO: 41104 - DNA, 20 bp, Artificial Sequence
  Description of Artificial Sequence: Synthetic oligonucleotide
  Target: ATXN1; (-) strand; PAM type: NRG; PAM sequence: AGG
tggcagcagtgggaggaggg

SEQ ID NO: 41105 - DNA, 20 bp, Artificial Sequence
  Description of Artificial Sequence: Synthetic oligonucleotide
  Target: ATXN1; (-) strand; PAM type: NRG; PAM sequence: GAG
ctggcagcagtgggaggagg

SEQ ID NO: 41106 - DNA, 20 bp, Artificial Sequence
  Description of Artificial Sequence: Synthetic oligonucleotide
  Target: ATXN1; (-) strand; PAM type: NRG; PAM sequence: GGG
tgctggcagcagtgggagga

SEQ ID NO: 41107 - DNA, 20 bp, Artificial Sequence
  Description of Artificial Sequence: Synthetic oligonucleotide
  Target: ATXN1; (-) strand; PAM type: NRG; PAM sequence: AGG
ttgctggcagcagtgggagg

SEQ ID NO: 41108 - DNA, 20 bp, Artificial Sequence
  Description of Artificial Sequence: Synthetic oligonucleotide
  Target: ATXN1; (-) strand; PAM type: NRG; PAM sequence: GAG
cttgctggcagcagtgggag

SEQ ID NO: 41109 - DNA, 20 bp, Artificial Sequence
  Description of Artificial Sequence: Synthetic oligonucleotide
  Target: ATXN1; (-) strand; PAM type: NRG; PAM sequence: AGG
ggcttgctggcagcagtggg

SEQ ID NO: 41110 - DNA, 20 bp, Artificial Sequence
  Description of Artificial Sequence: Synthetic oligonucleotide
  Target: ATXN1; (-) strand; PAM type: NRG; PAM sequence: GAG
gggcttgctggcagcagtgg

SEQ ID NO: 41111 - DNA, 20 bp, Artificial Sequence
  Description of Artificial Sequence: Synthetic oligonucleotide
  Target: ATXN1; (-) strand; PAM type: NRG; PAM sequence: GGG
atgggcttgctggcagcagt

SEQ ID NO: 41112 - DNA, 20 bp, Artificial Sequence
  Description of Artificial Sequence: Synthetic oligonucleotide
  Target: ATXN1; (-) strand; PAM type: NRG; PAM sequence: TGG
catgggcttgctggcagcag

SEQ ID NO: 41113 - DNA, 20 bp, Artificial Sequence
  Description of Artificial Sequence: Synthetic oligonucleotide
  Target: ATXN1; (-) strand; PAM type: NRG; PAM sequence: CAG
gcacatgggcttgctggcag

SEQ ID NO: 41114 - DNA, 20 bp, Artificial Sequence
  Description of Artificial Sequence: Synthetic oligonucleotide
  Target: ATXN1; (-) strand; PAM type: NRG; PAM sequence: CAG
tgagcacatgggcttgctgg

SEQ ID NO: 41115 - DNA, 20 bp, Artificial Sequence
  Description of Artificial Sequence: Synthetic oligonucleotide
  Target: ATXN1; (-) strand; PAM type: NRG; PAM sequence: TGG
tgatgagcacatgggcttgc

SEQ ID NO: 41116 - DNA, 20 bp, Artificial Sequence
  Description of Artificial Sequence: Synthetic oligonucleotide
  Target: ATXN1; (-) strand; PAM type: NRG; PAM sequence: GGG
aaccacactgatgagcacat

SEQ ID NO: 41117 - DNA, 20 bp, Artificial Sequence
  Description of Artificial Sequence: Synthetic oligonucleotide
  Target: ATXN1; (-) strand; PAM type: NRG; PAM sequence: TGG
taaccacactgatgagcaca

SEQ ID NO: 41118 - DNA, 20 bp, Artificial Sequence
  Description of Artificial Sequence: Synthetic oligonucleotide
  Target: ATXN1; (-) strand; PAM type: NRG; PAM sequence: GAG
tctcttataaccacactgat

SEQ ID NO: 41119 - DNA, 20 bp, Artificial Sequence
  Description of Artificial Sequence: Synthetic oligonucleotide
  Target: ATXN1; (-) strand; PAM type: NRG; PAM sequence: CAG
tggatggaggaaggggtagg

SEQ ID NO: 41120 - DNA, 20 bp, Artificial Sequence
  Description of Artificial Sequence: Synthetic oligonucleotide
  Target: ATXN1; (-) strand; PAM type: NRG; PAM sequence: AGG
ggatggatggaggaaggggt

SEQ ID NO: 41121 - DNA, 20 bp, Artificial Sequence
  Description of Artificial Sequence: Synthetic oligonucleotide
  Target: ATXN1; (-) strand; PAM type: NRG; PAM sequence: TAG
gggatggatggaggaagggg

SEQ ID NO: 41122 - DNA, 20 bp, Artificial Sequence
  Description of Artificial Sequence: Synthetic oligonucleotide
  Target: ATXN1; (-) strand; PAM type: NRG; PAM sequence: GGG
agggggatggatggaggaag

SEQ ID NO: 41123 - DNA, 20 bp, Artificial Sequence
  Description of Artificial Sequence: Synthetic oligonucleotide
  Target: ATXN1; (-) strand; PAM type: NRG; PAM sequence: GGG
tagggggatggatggaggaa

SEQ ID NO: 41124 - DNA, 20 bp, Artificial Sequence
  Description of Artificial Sequence: Synthetic oligonucleotide
  Target: ATXN1; (-) strand; PAM type: NRG; PAM sequence: AGG
ttagggggatggatggagga

SEQ ID NO: 41125 - DNA, 20 bp, Artificial Sequence
  Description of Artificial Sequence: Synthetic oligonucleotide
  Target: ATXN1; (-) strand; PAM type: NRG; PAM sequence: AAG
tttagggggatggatggagg

SEQ ID NO: 41126 - DNA, 20 bp, Artificial Sequence
  Description of Artificial Sequence: Synthetic oligonucleotide
  Target: ATXN1; (-) strand; PAM type: NRG; PAM sequence: AGG
cgatttagggggatggatgg

SEQ ID NO: 41127 - DNA, 20 bp, Artificial Sequence
  Description of Artificial Sequence: Synthetic oligonucleotide
  Target: ATXN1; (-) strand; PAM type: NRG; PAM sequence: GAG
tcgatttagggggatggatg

SEQ ID NO: 41128 - DNA, 20 bp, Artificial Sequence
  Description of Artificial Sequence: Synthetic oligonucleotide
  Target: ATXN1; (-) strand; PAM type: NRG; PAM sequence: TGG
agtcgatttagggggatgga

SEQ ID NO: 41129 - DNA, 20 bp, Artificial Sequence
  Description of Artificial Sequence: Synthetic oligonucleotide
  Target: ATXN1; (-) strand; PAM type: NRG; PAM sequence: TGG
gaggagtcgatttaggggga

SEQ ID NO: 41130 - DNA, 20 bp, Artificial Sequence
  Description of Artificial Sequence: Synthetic oligonucleotide
  Target: ATXN1; (-) strand; PAM type: NRG; PAM sequence: GGG
tctagaggagtcgatttagg

SEQ ID NO: 41131 - DNA, 20 bp, Artificial Sequence
  Description of Artificial Sequence: Synthetic oligonucleotide
  Target: ATXN1; (-) strand; PAM type: NRG; PAM sequence: GGG
ttctagaggagtcgatttag

SEQ ID NO: 41132 - DNA, 20 bp, Artificial Sequence
  Description of Artificial Sequence: Synthetic oligonucleotide
  Target: ATXN1; (-) strand; PAM type: NRG; PAM sequence: GGG
gttctagaggagtcgattta

SEQ ID NO: 41133 - DNA, 20 bp, Artificial Sequence
  Description of Artificial Sequence: Synthetic oligonucleotide
  Target: ATXN1; (-) strand; PAM type: NRG; PAM sequence: AGG
agttctagaggagtcgattt

SEQ ID NO: 41134 - DNA, 20 bp, Artificial Sequence
  Description of Artificial Sequence: Synthetic oligonucleotide
  Target: ATXN1; (-) strand; PAM type: NRG; PAM sequence: TAG
cagttctagaggagtcgatt

SEQ ID NO: 41135 - DNA, 20 bp, Artificial Sequence
  Description of Artificial Sequence: Synthetic oligonucleotide
  Target: ATXN1; (-) strand; PAM type: NRG; PAM sequence: GAG
tggaggtgacagttctagag

SEQ ID NO: 41136 - DNA, 20 bp, Artificial Sequence
  Description of Artificial Sequence: Synthetic oligonucleotide
  Target: ATXN1; (-) strand; PAM type: NRG; PAM sequence: AGG
gttggaggtgacagttctag

SEQ ID NO: 41137 - DNA, 20 bp, Artificial Sequence
  Description of Artificial Sequence: Synthetic oligonucleotide
  Target: ATXN1; (-) strand; PAM type: NRG; PAM sequence: GAG
agttggaggtgacagttcta

SEQ ID NO: 41138 - DNA, 20 bp, Artificial Sequence
  Description of Artificial Sequence: Synthetic oligonucleotide
  Target: ATXN1; (-) strand; PAM type: NRG; PAM sequence: TAG
ggagttggaggtgacagttc

SEQ ID NO: 41139 - DNA, 20 bp, Artificial Sequence
  Description of Artificial Sequence: Synthetic oligonucleotide
  Target: ATXN1; (-) strand; PAM type: NRG; PAM sequence: CAG
aaaatgggagttggaggtga

SEQ ID NO: 41140 - DNA, 20 bp, Artificial Sequence
  Description of Artificial Sequence: Synthetic oligonucleotide
  Target: ATXN1; (-) strand; PAM type: NRG; PAM sequence: AGG
ccatccaaaatgggagttgg

SEQ ID NO: 41141 - DNA, 20 bp, Artificial Sequence
  Description of Artificial Sequence: Synthetic oligonucleotide
  Target: ATXN1; (-) strand; PAM type: NRG; PAM sequence: GAG
tccatccaaaatgggagttg

SEQ ID NO: 41142 - DNA, 20 bp, Artificial Sequence
  Description of Artificial Sequence: Synthetic oligonucleotide
  Target: ATXN1; (-) strand; PAM type: NRG; PAM sequence: TGG
cgtccatccaaaatgggagt

SEQ ID NO: 41143 - DNA, 20 bp, Artificial Sequence
  Description of Artificial Sequence: Synthetic oligonucleotide
  Target: ATXN1; (-) strand; PAM type: NRG; PAM sequence: GAG
ggttcgtccatccaaaatgg

SEQ ID NO: 41144 - DNA, 20 bp, Artificial Sequence
  Description of Artificial Sequence: Synthetic oligonucleotide
  Target: ATXN1; (-) strand; PAM type: NRG; PAM sequence: GGG
taggttcgtccatccaaaat

SEQ ID NO: 41145 - DNA, 20 bp, Artificial Sequence
  Description of Artificial Sequence: Synthetic oligonucleotide
  Target: ATXN1; (-) strand; PAM type: NRG; PAM sequence: TGG
ctaggttcgtccatccaaaa

SEQ ID NO: 41146 - DNA, 20 bp, Artificial Sequence
  Description of Artificial Sequence: Synthetic oligonucleotide
  Target: ATXN1; (-) strand; PAM type: NRG; PAM sequence: AGG
tcggtgttgtctccctgtct

SEQ ID NO: 41147 - DNA, 20 bp, Artificial Sequence
  Description of Artificial Sequence: Synthetic oligonucleotide
  Target: ATXN1; (-) strand; PAM type: NRG; PAM sequence: TAG
gtcggtgttgtctccctgtc

SEQ ID NO: 41148 - DNA, 20 bp, Artificial Sequence
  Description of Artificial Sequence: Synthetic oligonucleotide
  Target: ATXN1; (-) strand; PAM type: NRG; PAM sequence: CGG
ttatgagcccagaagtgagt

SEQ ID NO: 41149 - DNA, 20 bp, Artificial Sequence
  Description of Artificial Sequence: Synthetic oligonucleotide
  Target: ATXN1; (-) strand; PAM type: NRG; PAM sequence: GAG
ataattatgagcccagaagt

SEQ ID NO: 41150 - DNA, 20 bp, Artificial Sequence
  Description of Artificial Sequence: Synthetic oligonucleotide
  Target: ATXN1; (-) strand; PAM type: NRG; PAM sequence: AAG
aaaaataattatgagcccag

SEQ ID NO: 41151 - DNA, 20 bp, Artificial Sequence
  Description of Artificial Sequence: Synthetic oligonucleotide
  Target: ATXN1; (-) strand; PAM type: NRG; PAM sequence: CAG
ttaaaaaataattatgagcc

SEQ ID NO: 41152 - DNA, 20 bp, Artificial Sequence
  Description of Artificial Sequence: Synthetic oligonucleotide
  Target: ATXN1; (-) strand; PAM type: NRG; PAM sequence: GAG
gacatttaaaaaataattat

SEQ ID NO: 41153 - DNA, 20 bp, Artificial Sequence
  Description of Artificial Sequence: Synthetic oligonucleotide
  Target: ATXN1; (-) strand; PAM type: NRG; PAM sequence: AGG
agtcattagtcagattagga

SEQ ID NO: 41154 - DNA, 20 bp, Artificial Sequence
  Description of Artificial Sequence: Synthetic oligonucleotide
  Target: ATXN1; (-) strand; PAM type: NRG; PAM sequence: AAG
cagtcattagtcagattagg

SEQ ID NO: 41155 - DNA, 20 bp, Artificial Sequence
  Description of Artificial Sequence: Synthetic oligonucleotide
  Target: ATXN1; (-) strand; PAM type: NRG; PAM sequence: AGG
agccagtcattagtcagatt

SEQ ID NO: 41156 - DNA, 20 bp, Artificial Sequence
  Description of Artificial Sequence: Synthetic oligonucleotide
  Target: ATXN1; (-) strand; PAM type: NRG; PAM sequence: TAG
aagccagtcattagtcagat

SEQ ID NO: 41157 - DNA, 20 bp, Artificial Sequence
  Description of Artificial Sequence: Synthetic oligonucleotide
  Target: ATXN1; (-) strand; PAM type: NRG; PAM sequence: CAG
cttaaaagccagtcattagt

SEQ ID NO: 41158 - DNA, 20 bp, Artificial Sequence
  Description of Artificial Sequence: Synthetic oligonucleotide
  Target: ATXN1; (-) strand; PAM type: NRG; PAM sequence: TAG
ttttcttaaaagccagtcat

SEQ ID NO: 41159 - DNA, 20 bp, Artificial Sequence
  Description of Artificial Sequence: Synthetic oligonucleotide
  Target: ATXN1; (-) strand; PAM type: NRG; PAM sequence: CAG
ctaaaatttttcttaaaagc

SEQ ID NO: 41160 - DNA, 20 bp, Artificial Sequence
  Description of Artificial Sequence: Synthetic oligonucleotide
  Target: ATXN1; (-) strand; PAM type: NRG; PAM sequence: AAG
ggagctaaaatttttcttaa

SEQ ID NO: 41161 - DNA, 20 bp, Artificial Sequence
  Description of Artificial Sequence: Synthetic oligonucleotide
  Target: ATXN1; (-) strand; PAM type: NRG; PAM sequence: GAG
tattgaattttcatacagag

SEQ ID NO: 41162 - DNA, 20 bp, Artificial Sequence
  Description of Artificial Sequence: Synthetic oligonucleotide
  Target: ATXN1; (-) strand; PAM type: NRG; PAM sequence: AGG
tttattgaattttcatacag

SEQ ID NO: 41163 - DNA, 20 bp, Artificial Sequence
  Description of Artificial Sequence: Synthetic oligonucleotide
  Target: ATXN1; (-) strand; PAM type: NRG; PAM sequence: GAG
ttttattgaattttcataca

SEQ ID NO: 41164 - DNA, 20 bp, Artificial Sequence
  Description of Artificial Sequence: Synthetic oligonucleotide
  Target: ATXN1; (-) strand; PAM type: NRG; PAM sequence: CAG
aattttattgaattttcata

SEQ ID NO: 41165 - DNA, 20 bp, Artificial Sequence
  Description of Artificial Sequence: Synthetic oligonucleotide
  Target: ATXN1; (-) strand; PAM type: NRG; PAM sequence: AGG
gttattgactaagtggtgaa

SEQ ID NO: 41166 - DNA, 20 bp, Artificial Sequence
  Description of Artificial Sequence: Synthetic oligonucleotide
  Target: ATXN1; (-) strand; PAM type: NRG; PAM sequence: AAG
agttattgactaagtggtga

SEQ ID NO: 41167 - DNA, 20 bp, Artificial Sequence
  Description of Artificial Sequence: Synthetic oligonucleotide
  Target: ATXN1; (-) strand; PAM type: NRG; PAM sequence: TGG
tatagtagttattgactaag

SEQ ID NO: 41168 - DNA, 20 bp, Artificial Sequence
  Description of Artificial Sequence: Synthetic oligonucleotide
  Target: ATXN1; (-) strand; PAM type: NRG; PAM sequence: AAG
agatatagtagttattgact

SEQ ID NO: 41169 - DNA, 20 bp, Artificial Sequence
  Description of Artificial Sequence: Synthetic oligonucleotide
  Target: ATXN1; (-) strand; PAM type: NRG; PAM sequence: TAG
tgcatagtgtttagatatag

SEQ ID NO: 41170 - DNA, 20 bp, Artificial Sequence
  Description of Artificial Sequence: Synthetic oligonucleotide
  Target: ATXN1; (-) strand; PAM type: NRG; PAM sequence: TAG
atgtgcatagtgtttagata

SEQ ID NO: 41171 - DNA, 20 bp, Artificial Sequence
  Description of Artificial Sequence: Synthetic oligonucleotide
  Target: ATXN1; (-) strand; PAM type: NRG; PAM sequence: TAG
gcgtgtatgtgcatagtgtt

SEQ ID NO: 41172 - DNA, 20 bp, Artificial Sequence
  Description of Artificial Sequence: Synthetic oligonucleotide
  Target: ATXN1; (-) strand; PAM type: NRG; PAM sequence: TAG
taaatatgcgtgtatgtgca

SEQ ID NO: 41173 - DNA, 20 bp, Artificial Sequence
  Description of Artificial Sequence: Synthetic oligonucleotide
  Target: ATXN1; (-) strand; PAM type: NRG; PAM sequence: CAG
gattgaaatatacaatcaaa

SEQ ID NO: 41174 - DNA, 20 bp, Artificial Sequence
  Description of Artificial Sequence: Synthetic oligonucleotide
  Target: ATXN1; (-) strand; PAM type: NRG; PAM sequence: AAG
tatagacatagcaccaatct

SEQ ID NO: 41175 - DNA, 20 bp, Artificial Sequence
  Description of Artificial Sequence: Synthetic oligonucleotide
  Target: ATXN1; (-) strand; PAM type: NRG; PAM sequence: TAG
catatgtgtgtatatagaca

SEQ ID NO: 41176 - DNA, 20 bp, Artificial Sequence
  Description of Artificial Sequence: Synthetic oligonucleotide
  Target: ATXN1; (-) strand; PAM type: NRG; PAM sequence: TAG
tatgtacatatgtgtgtata

SEQ ID NO: 41177 - DNA, 20 bp, Artificial Sequence
  Description of Artificial Sequence: Synthetic oligonucleotide
  Target: ATXN1; (-) strand; PAM type: NRG; PAM sequence: TGG
ttttctttctatcttgtttt

SEQ ID NO: 41178 - DNA, 20 bp, Artificial Sequence
  Description of Artificial Sequence: Synthetic oligonucleotide
  Target: ATXN1; (-) strand; PAM type: NRG; PAM sequence: CAG
tgggagacatatttaaacaa

SEQ ID NO: 41179 - DNA, 20 bp, Artificial Sequence
  Description of Artificial Sequence: Synthetic oligonucleotide
  Target: ATXN1; (-) strand; PAM type: NRG; PAM sequence: GAG
gactcttgtgaaggaaatgg

SEQ ID NO: 41180 - DNA, 20 bp, Artificial Sequence
  Description of Artificial Sequence: Synthetic oligonucleotide
  Target: ATXN1; (-) strand; PAM type: NRG; PAM sequence: GGG
gggactcttgtgaaggaaat

SEQ ID NO: 41181 - DNA, 20 bp, Artificial Sequence
  Description of Artificial Sequence: Synthetic oligonucleotide
  Target: ATXN1; (-) strand; PAM type: NRG; PAM sequence: TGG
agggactcttgtgaaggaaa

SEQ ID NO: 41182 - DNA, 20 bp, Artificial Sequence
  Description of Artificial Sequence: Synthetic oligonucleotide
  Target: ATXN1; (-) strand; PAM type: NRG; PAM sequence: AGG
gaaaacagggactcttgtga

SEQ ID NO: 41183 - DNA, 20 bp, Artificial Sequence
  Description of Artificial Sequence: Synthetic oligonucleotide
  Target: ATXN1; (-) strand; PAM type: NRG; PAM sequence: AAG
tgaaaacagggactcttgtg

SEQ ID NO: 41184 - DNA, 20 bp, Artificial Sequence
  Description of Artificial Sequence: Synthetic oligonucleotide
  Target: ATXN1; (-) strand; PAM type: NRG; PAM sequence: GGG
cttcgcaatttgtgaaaaca

SEQ ID NO: 41185 - DNA, 20 bp, Artificial Sequence
  Description of Artificial Sequence: Synthetic oligonucleotide
  Target: ATXN1; (-) strand; PAM type: NRG; PAM sequence: AGG
ccttcgcaatttgtgaaaac

SEQ ID NO: 41186 - DNA, 20 bp, Artificial Sequence
  Description of Artificial Sequence: Synthetic oligonucleotide
  Target: ATXN1; (-) strand; PAM type: NRG; PAM sequence: CAG
cccttcgcaatttgtgaaaa

SEQ ID NO: 41187 - DNA, 20 bp, Artificial Sequence
  Description of Artificial Sequence: Synthetic oligonucleotide
  Target: ATXN1; (-) strand; PAM type: NRG; PAM sequence: CAG
tgaaaaaatgttttgtaaaa

SEQ ID NO: 41188 - DNA, 20 bp, Artificial Sequence
  Description of Artificial Sequence: Synthetic oligonucleotide
  Target: ATXN1; (-) strand; PAM type: NRG; PAM sequence: TAG
cgaaatttgtatgtctggga

SEQ ID NO: 41189 - DNA, 20 bp, Artificial Sequence
  Description of Artificial Sequence: Synthetic oligonucleotide
  Target: ATXN1; (-) strand; PAM type: NRG; PAM sequence: GGG
caggcgaaatttgtatgtct

SEQ ID NO: 41190 - DNA, 20 bp, Artificial Sequence
  Description of Artificial Sequence: Synthetic oligonucleotide
  Target: ATXN1; (-) strand; PAM type: NRG; PAM sequence: TGG
acaggcgaaatttgtatgtc

SEQ ID NO: 41191 - DNA, 20 bp, Artificial Sequence
  Description of Artificial Sequence: Synthetic oligonucleotide
  Target: ATXN1; (-) strand; PAM type: NRG; PAM sequence: AGG
aattcattgctcccagcaac

SEQ ID NO: 41192 - DNA, 20 bp, Artificial Sequence
  Description of Artificial Sequence: Synthetic oligonucleotide
  Target: ATXN1; (-) strand; PAM type: NRG; PAM sequence: CAG
gaattcattgctcccagcaa

SEQ ID NO: 41193 - DNA, 20 bp, Artificial Sequence
  Description of Artificial Sequence: Synthetic oligonucleotide
  Target: ATXN1; (-) strand; PAM type: NRG; PAM sequence: CAG
atgagagaattcattgctcc

SEQ ID NO: 41194 - DNA, 20 bp, Artificial Sequence
  Description of Artificial Sequence: Synthetic oligonucleotide
  Target: ATXN1; (-) strand; PAM type: NRG; PAM sequence: GAG
tactgaaacctagcttatga

SEQ ID NO: 41195 - DNA, 20 bp, Artificial Sequence
  Description of Artificial Sequence: Synthetic oligonucleotide
  Target: ATXN1; (-) strand; PAM type: NRG; PAM sequence: GAG
cttactgaaacctagcttat

SEQ ID NO: 41196 - DNA, 20 bp, Artificial Sequence
  Description of Artificial Sequence: Synthetic oligonucleotide
  Target: ATXN1; (-) strand; PAM type: NRG; PAM sequence: TAG
aagacatacttactgaaacc

SEQ ID NO: 41197 - DNA, 20 bp, Artificial Sequence
  Description of Artificial Sequence: Synthetic oligonucleotide
  Target: ATXN1; (-) strand; PAM type: NRG; PAM sequence: AAG
taataatttcgccaaaaaac

SEQ ID NO: 41198 - DNA, 20 bp, Artificial Sequence
  Description of Artificial Sequence: Synthetic oligonucleotide
  Target: ATXN1; (-) strand; PAM type: NRG; PAM sequence: AAG
tttcacttgcagacaaagtt

SEQ ID NO: 41199 - DNA, 20 bp, Artificial Sequence
  Description of Artificial Sequence: Synthetic oligonucleotide
  Target: ATXN1; (-) strand; PAM type: NRG; PAM sequence: AAG
gagaatttcacttgcagaca

SEQ ID NO: 41200 - DNA, 20 bp, Artificial Sequence
  Description of Artificial Sequence: Synthetic oligonucleotide
  Target: ATXN1; (-) strand; PAM type: NRG; PAM sequence: CAG
aagactgagaatttcacttg

SEQ ID NO: 41201 - DNA, 20 bp, Artificial Sequence
  Description of Artificial Sequence: Synthetic oligonucleotide
  Target: ATXN1; (-) strand; PAM type: NRG; PAM sequence: GAG
tctacaggtaaaacaagact

SEQ ID NO: 41202 - DNA, 20 bp, Artificial Sequence
  Description of Artificial Sequence: Synthetic oligonucleotide
  Target: ATXN1; (-) strand; PAM type: NRG; PAM sequence: AAG
cctttctctacaggtaaaac

SEQ ID NO: 41203 - DNA, 20 bp, Artificial Sequence
  Description of Artificial Sequence: Synthetic oligonucleotide
  Target: ATXN1; (-) strand; PAM type: NRG; PAM sequence: AGG
gcagaccggcctttctctac

SEQ ID NO: 41204 - DNA, 20 bp, Artificial Sequence
  Description of Artificial Sequence: Synthetic oligonucleotide
  Target: ATXN1; (-) strand; PAM type: NRG; PAM sequence: CAG
agcagaccggcctttctcta

SEQ ID NO: 41205 - DNA, 20 bp, Artificial Sequence
  Description of Artificial Sequence: Synthetic oligonucleotide
  Target: ATXN1; (-) strand; PAM type: NRG; PAM sequence: CGG
agccttccaggaaagcagac

SEQ ID NO: 41206 - DNA, 20 bp, Artificial Sequence
  Description of Artificial Sequence: Synthetic oligonucleotide
  Target: ATXN1; (-) strand; PAM type: NRG; PAM sequence: CAG
gacttagccttccaggaaag

SEQ ID NO: 41207 - DNA, 20 bp, Artificial Sequence
  Description of Artificial Sequence: Synthetic oligonucleotide
  Target: ATXN1; (-) strand; PAM type: NRG; PAM sequence: AAG
gcagacttagccttccagga

SEQ ID NO: 41208 - DNA, 20 bp, Artificial Sequence
  Description of Artificial Sequence: Synthetic oligonucleotide
  Target: ATXN1; (-) strand; PAM type: NRG; PAM sequence: AGG
ccatgcagacttagccttcc

SEQ ID NO: 41209 - DNA, 20 bp, Artificial Sequence
  Description of Artificial Sequence: Synthetic oligonucleotide
  Target: ATXN1; (-) strand; PAM type: NRG; PAM sequence: CAG
accatgcagacttagccttc

SEQ ID NO: 41210 - DNA, 20 bp, Artificial Sequence
  Description of Artificial Sequence: Synthetic oligonucleotide
  Target: ATXN1; (-) strand; PAM type: NRG; PAM sequence: TAG
agaacgtaaccatgcagact

SEQ ID NO: 41211 - DNA, 20 bp, Artificial Sequence
  Description of Artificial Sequence: Synthetic oligonucleotide
  Target: ATXN1; (-) strand; PAM type: NRG; PAM sequence: CAG
atgctgagaacgtaaccatg

SEQ ID NO: 41212 - DNA, 20 bp, Artificial Sequence
  Description of Artificial Sequence: Synthetic oligonucleotide
  Target: ATXN1; (-) strand; PAM type: NRG; PAM sequence: GAG
tttctgatttttttcatgct

SEQ ID NO: 41213 - DNA, 20 bp, Artificial Sequence
  Description of Artificial Sequence: Synthetic oligonucleotide
  Target: ATXN1; (-) strand; PAM type: NRG; PAM sequence: GGG
cccccttcatctttgagacg

SEQ ID NO: 41214 - DNA, 20 bp, Artificial Sequence
  Description of Artificial Sequence: Synthetic oligonucleotide
  Target: ATXN1; (-) strand; PAM type: NRG; PAM sequence: GGG
acccccttcatctttgagac

SEQ ID NO: 41215 - DNA, 20 bp, Artificial Sequence
  Description of Artificial Sequence: Synthetic oligonucleotide
  Target: ATXN1; (-) strand; PAM type: NRG; PAM sequence: CGG
tacccccttcatctttgaga

SEQ ID NO: 41216 - DNA, 20 bp, Artificial Sequence
  Description of Artificial Sequence: Synthetic oligonucleotide
  Target: ATXN1; (-) strand; PAM type: NRG; PAM sequence: GAG
cgcttacccccttcatcttt

SEQ ID NO: 41217 - DNA, 20 bp, Artificial Sequence
  Description of Artificial Sequence: Synthetic oligonucleotide
  Target: ATXN1; (-) strand; PAM type: NRG; PAM sequence: GGG
ttttaaacattgcagtaaat

SEQ ID NO: 41218 - DNA, 20 bp, Artificial Sequence
  Description of Artificial Sequence: Synthetic oligonucleotide
  Target: ATXN1; (-) strand; PAM type: NRG; PAM sequence: TGG
tttttaaacattgcagtaaa

SEQ ID NO: 41219 - DNA, 20 bp, Artificial Sequence
  Description of Artificial Sequence: Synthetic oligonucleotide
  Target: ATXN1; (-) strand; PAM type: NRG; PAM sequence: CAG
ttaatgatttttaaacattg

SEQ ID NO: 41220 - DNA, 20 bp, Artificial Sequence
  Description of Artificial Sequence: Synthetic oligonucleotide
  Target: ATXN1; (-) strand; PAM type: NRG; PAM sequence: AAG
gagattcttacactcagcca

SEQ ID NO: 41221 - DNA, 20 bp, Artificial Sequence
  Description of Artificial Sequence: Synthetic oligonucleotide
  Target: ATXN1; (-) strand; PAM type: NRG; PAM sequence: CAG
ctcacagagattcttacact

SEQ ID NO: 41222 - DNA, 20 bp, Artificial Sequence
  Description of Artificial Sequence: Synthetic oligonucleotide
  Target: ATXN1; (-) strand; PAM type: NRG; PAM sequence: GAG
ttttaaatagaacactcaca

SEQ ID NO: 41223 - DNA, 20 bp, Artificial Sequence
  Description of Artificial Sequence: Synthetic oligonucleotide
  Target: ATXN1; (-) strand; PAM type: NRG; PAM sequence: CAG
tgttttaaatagaacactca

SEQ ID NO: 41224 - DNA, 20 bp, Artificial Sequence
  Description of Artificial Sequence: Synthetic oligonucleotide
  Target: ATXN1; (-) strand; PAM type: NRG; PAM sequence: TAG
acatgattcagtgttttaaa

SEQ ID NO: 41225 - DNA, 20 bp, Artificial Sequence
  Description of Artificial Sequence: Synthetic oligonucleotide
  Target: ATXN1; (-) strand; PAM type: NRG; PAM sequence: CAG
ggctttgcgtgaacatgatt

SEQ ID NO: 41226 - DNA, 20 bp, Artificial Sequence
  Description of Artificial Sequence: Synthetic oligonucleotide
  Target: ATXN1; (-) strand; PAM type: NRG; PAM sequence: AGG
cttccaccaaggactgagtc

SEQ ID NO: 41227 - DNA, 20 bp, Artificial Sequence
  Description of Artificial Sequence: Synthetic oligonucleotide
  Target: ATXN1; (-) strand; PAM type: NRG; PAM sequence: CAG
acttccaccaaggactgagt

SEQ ID NO: 41228 - DNA, 20 bp, Artificial Sequence
  Description of Artificial Sequence: Synthetic oligonucleotide
  Target: ATXN1; (-) strand; PAM type: NRG; PAM sequence: GAG
aaacacttccaccaaggact

SEQ ID NO: 41229 - DNA, 20 bp, Artificial Sequence
  Description of Artificial Sequence: Synthetic oligonucleotide
  Target: ATXN1; (-) strand; PAM type: NRG; PAM sequence: AGG
accctgaaacacttccacca

SEQ ID NO: 41230 - DNA, 20 bp, Artificial Sequence
  Description of Artificial Sequence: Synthetic oligonucleotide
  Target: ATXN1; (-) strand; PAM type: NRG; PAM sequence: AAG
aaccctgaaacacttccacc

SEQ ID NO: 41231 - DNA, 20 bp, Artificial Sequence
  Description of Artificial Sequence: Synthetic oligonucleotide
  Target: ATXN1; (-) strand; PAM type: NRG; PAM sequence: GGG
gcgtcccggtgctagggtgt

SEQ ID NO: 41232 - DNA, 20 bp, Artificial Sequence
  Description of Artificial Sequence: Synthetic oligonucleotide
  Target: ATXN1; (-) strand; PAM type: NRG; PAM sequence: TGG
ggcgtcccggtgctagggtg

SEQ ID NO: 41233 - DNA, 20 bp, Artificial Sequence
  Description of Artificial Sequence: Synthetic oligonucleotide
  Target: ATXN1; (-) strand; PAM type: NRG; PAM sequence: GGG
taggaggcgtcccggtgcta

SEQ ID NO: 41234 - DNA, 20 bp, Artificial Sequence
  Description of Artificial Sequence: Synthetic oligonucleotide
  Target: ATXN1; (-) strand; PAM type: NRG; PAM sequence: AGG
ttaggaggcgtcccggtgct

SEQ ID NO: 41235 - DNA, 20 bp, Artificial Sequence
  Description of Artificial Sequence: Synthetic oligonucleotide
  Target: ATXN1; (-) strand; PAM type: NRG; PAM sequence: TAG
gttaggaggcgtcccggtgc

SEQ ID NO: 41236 - DNA, 20 bp, Artificial Sequence
  Description of Artificial Sequence: Synthetic oligonucleotide
  Target: ATXN1; (-) strand; PAM type: NRG; PAM sequence: CGG
atttgtgttaggaggcgtcc

SEQ ID NO: 41237 - DNA, 20 bp, Artificial Sequence
  Description of Artificial Sequence: Synthetic oligonucleotide
  Target: ATXN1; (-) strand; PAM type: NRG; PAM sequence: AGG
aatgtgggatttgtgttagg

SEQ ID NO: 41238 - DNA, 20 bp, Artificial Sequence
  Description of Artificial Sequence: Synthetic oligonucleotide
  Target: ATXN1; (-) strand; PAM type: NRG; PAM sequence: GAG
taatgtgggatttgtgttag

SEQ ID NO: 41239 - DNA, 20 bp, Artificial Sequence
  Description of Artificial Sequence: Synthetic oligonucleotide
  Target: ATXN1; (-) strand; PAM type: NRG; PAM sequence: AGG
tttaatgtgggatttgtgtt

SEQ ID NO: 41240 - DNA, 20 bp, Artificial Sequence
  Description of Artificial Sequence: Synthetic oligonucleotide
  Target: ATXN1; (-) strand; PAM type: NRG; PAM sequence: TAG
ttttaatgtgggatttgtgt

SEQ ID NO: 41241 - DNA, 20 bp, Artificial Sequence
  Description of Artificial Sequence: Synthetic oligonucleotide
  Target: ATXN1; (-) strand; PAM type: NRG; PAM sequence: GGG
aaaaacccagcttttaatgt

SEQ ID NO: 41242 - DNA, 20 bp, Artificial Sequence
  Description of Artificial Sequence: Synthetic oligonucleotide
  Target: ATXN1; (-) strand; PAM type: NRG; PAM sequence: TGG
gaaaaacccagcttttaatg

SEQ ID NO: 41243 - DNA, 20 bp, Artificial Sequence
  Description of Artificial Sequence: Synthetic oligonucleotide
  Target: ATXN1; (-) strand; PAM type: NRG; PAM sequence: CAG
taccatgtgtaagaaaaacc

SEQ ID NO: 41244 - DNA, 20 bp, Artificial Sequence
  Description of Artificial Sequence: Synthetic oligonucleotide
  Target: ATXN1; (-) strand; PAM type: NRG; PAM sequence: AAG
tgagccacgctaccatgtgt

SEQ ID NO: 41245 - DNA, 20 bp, Artificial Sequence
  Description of Artificial Sequence: Synthetic oligonucleotide
  Target: ATXN1; (-) strand; PAM type: NRG; PAM sequence: GAG
ttcccacaagggagctctgt

SEQ ID NO: 41246 - DNA, 20 bp, Artificial Sequence
  Description of Artificial Sequence: Synthetic oligonucleotide
  Target: ATXN1; (-) strand; PAM type: NRG; PAM sequence: GAG
cacagggccttcccacaagg

SEQ ID NO: 41247 - DNA, 20 bp, Artificial Sequence
  Description of Artificial Sequence: Synthetic oligonucleotide
  Target: ATXN1; (-) strand; PAM type: NRG; PAM sequence: GGG
cccacagggccttcccacaa

SEQ ID NO: 41248 - DNA, 20 bp, Artificial Sequence
  Description of Artificial Sequence: Synthetic oligonucleotide
  Target: ATXN1; (-) strand; PAM type: NRG; PAM sequence: AGG
ccccacagggccttcccaca

SEQ ID NO: 41249 - DNA, 20 bp, Artificial Sequence
  Description of Artificial Sequence: Synthetic oligonucleotide
  Target: ATXN1; (-) strand; PAM type: NRG; PAM sequence: AAG
tccccacagggccttcccac

SEQ ID NO: 41250 - DNA, 20 bp, Artificial Sequence
  Description of Artificial Sequence: Synthetic oligonucleotide
  Target: ATXN1; (-) strand; PAM type: NRG; PAM sequence: GGG
catccctgagcctccccaca

SEQ ID NO: 41251 - DNA, 20 bp, Artificial Sequence
  Description of Artificial Sequence: Synthetic oligonucleotide
  Target: ATXN1; (-) strand; PAM type: NRG; PAM sequence: AGG
ccatccctgagcctccccac

SEQ ID NO: 41252 - DNA, 20 bp, Artificial Sequence
  Description of Artificial Sequence: Synthetic oligonucleotide
  Target: ATXN1; (-) strand; PAM type: NRG; PAM sequence: CAG
gccatccctgagcctcccca

SEQ ID NO: 41253 - DNA, 20 bp, Artificial Sequence
  Description of Artificial Sequence: Synthetic oligonucleotide
  Target: ATXN1; (-) strand; PAM type: NRG; PAM sequence: GAG
tgtccttcctggccatccct

SEQ ID NO: 41254 - DNA, 20 bp, Artificial Sequence
  Description of Artificial Sequence: Synthetic oligonucleotide
  Target: ATXN1; (-) strand; PAM type: NRG; PAM sequence: TGG
tcactgggcagtgtccttcc

SEQ ID NO: 41255 - DNA, 20 bp, Artificial Sequence
  Description of Artificial Sequence: Synthetic oligonucleotide
  Target: ATXN1; (-) strand; PAM type: NRG; PAM sequence: CAG
tgctgtggtcactcactggg

SEQ ID NO: 41256 - DNA, 20 bp, Artificial Sequence
  Description of Artificial Sequence: Synthetic oligonucleotide
  Target: ATXN1; (-) strand; PAM type: NRG; PAM sequence: GGG
agctgctgtggtcactcact

SEQ ID NO: 41257 - DNA, 20 bp, Artificial Sequence
  Description of Artificial Sequence: Synthetic oligonucleotide
  Target: ATXN1; (-) strand; PAM type: NRG; PAM sequence: TGG
cagctgctgtggtcactcac

SEQ ID NO: 41258 - DNA, 20 bp, Artificial Sequence
  Description of Artificial Sequence: Synthetic oligonucleotide
  Target: ATXN1; (-) strand; PAM type: NRG; PAM sequence: TGG
cttccgtgtcacagctgctg

SEQ ID NO: 41259 - DNA, 20 bp, Artificial Sequence
  Description of Artificial Sequence: Synthetic oligonucleotide
  Target: ATXN1; (-) strand; PAM type: NRG; PAM sequence: CAG
gcctaagggcttccgtgtca

SEQ ID NO: 41260 - DNA, 20 bp, Artificial Sequence
  Description of Artificial Sequence: Synthetic oligonucleotide
  Target: ATXN1; (-) strand; PAM type: NRG; PAM sequence: GGG
gctagaacctgtgtgcctaa

SEQ ID NO: 41261 - DNA, 20 bp, Artificial Sequence
  Description of Artificial Sequence: Synthetic oligonucleotide
  Target: ATXN1; (-) strand; PAM type: NRG; PAM sequence: AGG
agctagaacctgtgtgccta

SEQ ID NO: 41262 - DNA, 20 bp, Artificial Sequence
  Description of Artificial Sequence: Synthetic oligonucleotide
  Target: ATXN1; (-) strand; PAM type: NRG; PAM sequence: AAG
gagctagaacctgtgtgcct

SEQ ID NO: 41263 - DNA, 20 bp, Artificial Sequence
  Description of Artificial Sequence: Synthetic oligonucleotide
  Target: ATXN1; (-) strand; PAM type: NRG; PAM sequence: TAG
gaaaaggaaggcaagtgagc

SEQ ID NO: 41264 - DNA, 20 bp, Artificial Sequence
  Description of Artificial Sequence: Synthetic oligonucleotide
  Target: ATXN1; (-) strand; PAM type: NRG; PAM sequence: GAG
cccagaaaaggaaggcaagt

SEQ ID NO: 41265 - DNA, 20 bp, Artificial Sequence
  Description of Artificial Sequence: Synthetic oligonucleotide
  Target: ATXN1; (-) strand; PAM type: NRG; PAM sequence: AAG
aggccccagaaaaggaaggc

SEQ ID NO: 41266 - DNA, 20 bp, Artificial Sequence
  Description of Artificial Sequence: Synthetic oligonucleotide
  Target: ATXN1; (-) strand; PAM type: NRG; PAM sequence: AGG
tttaaggccccagaaaagga

SEQ ID NO: 41267 - DNA, 20 bp, Artificial Sequence
  Description of Artificial Sequence: Synthetic oligonucleotide
  Target: ATXN1; (-) strand; PAM type: NRG; PAM sequence: AAG
ttttaaggccccagaaaagg

SEQ ID NO: 41268 - DNA, 20 bp, Artificial Sequence
  Description of Artificial Sequence: Synthetic oligonucleotide
  Target: ATXN1; (-) strand; PAM type: NRG; PAM sequence: AGG
acattttaaggccccagaaa

SEQ ID NO: 41269 - DNA, 20 bp, Artificial Sequence
  Description of Artificial Sequence: Synthetic oligonucleotide
  Target: ATXN1; (-) strand; PAM type: NRG; PAM sequence: AAG
cacattttaaggccccagaa

SEQ ID NO: 41270 - DNA, 20 bp, Artificial Sequence
  Description of Artificial Sequence: Synthetic oligonucleotide
  Target: ATXN1; (-) strand; PAM type: NRG; PAM sequence: CAG
aggcacacattttaaggccc

SEQ ID NO: 41271 - DNA, 20 bp, Artificial Sequence
  Description of Artificial Sequence: Synthetic oligonucleotide
  Target: ATXN1; (-) strand; PAM type: NRG; PAM sequence: AGG
tgcctaaggcacacatttta

SEQ ID NO: 41272 - DNA, 20 bp, Artificial Sequence
  Description of Artificial Sequence: Synthetic oligonucleotide
  Target: ATXN1; (-) strand; PAM type: NRG; PAM sequence: AAG
ctgcctaaggcacacatttt

SEQ ID NO: 41273 - DNA, 20 bp, Artificial Sequence
  Description of Artificial Sequence: Synthetic oligonucleotide
  Target: ATXN1; (-) strand; PAM type: NRG; PAM sequence: AGG
gagccacccttccctgccta

SEQ ID NO: 41274 - DNA, 20 bp, Artificial Sequence
  Description of Artificial Sequence: Synthetic oligonucleotide
  Target: ATXN1; (-) strand; PAM type: NRG; PAM sequence: AAG
tgagccacccttccctgcct

SEQ ID NO: 41275 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacagggat

SEQ ID NO: 41276 - DNA, 20 bp, Artificial Sequence
  Description of Artificial Sequence: Synthetic oligonucleotide
  Target: ATXN1; (-) strand; PAM type: NRG; PAM sequence: GGG
cccaaagtgctgggattaca

SEQ ID NO: 41277 - DNA, 20 bp, Artificial Sequence
  Description of Artificial Sequence: Synthetic oligonucleotide
  Target: ATXN1; (-) strand; PAM type: NRG; PAM sequence: AGG
ccccaaagtgctgggattac

SEQ ID NO: 41278 - DNA, 20 bp, Artificial Sequence
  Description of Artificial Sequence: Synthetic oligonucleotide
  Target: ATXN1; (-) strand; PAM type: NRG; PAM sequence: CAG
cccccaaagtgctgggatta

SEQ ID NO: 41279 - DNA, 20 bp, Artificial Sequence
  Description of Artificial Sequence: Synthetic oligonucleotide
  Target: ATXN1; (-) strand; PAM type: NRG; PAM sequence: GGG
cctcaggcccccaaagtgct

SEQ ID NO: 41280 - DNA, 20 bp, Artificial Sequence
  Description of Artificial Sequence: Synthetic oligonucleotide
  Target: ATXN1; (-) strand; PAM type: NRG; PAM sequence: TGG
gcctcaggcccccaaagtgc

SEQ ID NO: 41281 - DNA, 20 bp, Artificial Sequence
  Description of Artificial Sequence: Synthetic oligonucleotide
  Target: ATXN1; (-) strand; PAM type: NRG; PAM sequence: AAG
cctcccgcctcaggccccca

SEQ ID NO: 41282 - DNA, 20 bp, Artificial Sequence
  Description of Artificial Sequence: Synthetic oligonucleotide
  Target: ATXN1; (-) strand; PAM type: NRG; PAM sequence: AGG
tcatgtgatcctcccgcctc

SEQ ID NO: 41283 - DNA, 20 bp, Artificial Sequence
  Description of Artificial Sequence: Synthetic oligonucleotide
  Target: ATXN1; (-) strand; PAM type: NRG; PAM sequence: CAG
ctcatgtgatcctcccgcct

SEQ ID NO: 41284 - DNA, 20 bp, Artificial Sequence
  Description of Artificial Sequence: Synthetic oligonucleotide
  Target: ATXN1; (-) strand; PAM type: NRG; PAM sequence: GAG
caggctgctcttgaactcct

SEQ ID NO: 41285 - DNA, 20 bp, Artificial Sequence
  Description of Artificial Sequence: Synthetic oligonucleotide
  Target: ATXN1; (-) strand; PAM type: NRG; PAM sequence: AGG
ggggtcttgccatgttgccc

SEQ ID NO: 41286 - DNA, 20 bp, Artificial Sequence
  Description of Artificial Sequence: Synthetic oligonucleotide
  Target: ATXN1; (-) strand; PAM type: NRG; PAM sequence: CAG
cggggtcttgccatgttgcc

SEQ ID NO: 41287 - DNA, 20 bp, Artificial Sequence
  Description of Artificial Sequence: Synthetic oligonucleotide
  Target: ATXN1; (-) strand; PAM type: NRG; PAM sequence: GGG
tctatttttttgtagagacg

SEQ ID NO: 41288 - DNA, 20 bp, Artificial Sequence
  Description of Artificial Sequence: Synthetic oligonucleotide
  Target: ATXN1; (-) strand; PAM type: NRG; PAM sequence: GGG
ttctatttttttgtagagac

SEQ ID NO: 41289 - DNA, 20 bp, Artificial Sequence
  Description of Artificial Sequence: Synthetic oligonucleotide
  Target: ATXN1; (-) strand; PAM type: NRG; PAM sequence: CGG
tttctatttttttgtagaga

SEQ ID NO: 41290 - DNA, 20 bp, Artificial Sequence
  Description of Artificial Sequence: Synthetic oligonucleotide
  Target: ATXN1; (-) strand; PAM type: NRG; PAM sequence: GAG
aatttttctatttttttgta

SEQ ID NO: 41291 - DNA, 20 bp, Artificial Sequence
  Description of Artificial Sequence: Synthetic oligonucleotide
  Target: ATXN1; (-) strand; PAM type: NRG; PAM sequence: TAG
ctaatttttctatttttttg

SEQ ID NO: 41292 - DNA, 20 bp, Artificial Sequence
  Description of Artificial Sequence: Synthetic oligonucleotide
  Target: ATXN1; (-) strand; PAM type: NRG; PAM sequence: CAG
caagtacacaccaccacgcc

SEQ ID NO: 41293 - DNA, 20 bp, Artificial Sequence
  Description of Artificial Sequence: Synthetic oligonucleotide
  Target: ATXN1; (-) strand; PAM type: NRG; PAM sequence: AAG
tccctaggaacagggaccac

SEQ ID NO: 41294 - DNA, 20 bp, Artificial Sequence
  Description of Artificial Sequence: Synthetic oligonucleotide
  Target: ATXN1; (-) strand; PAM type: NRG; PAM sequence: GGG
cttcagcctccctaggaaca

SEQ ID NO: 41295 - DNA, 20 bp, Artificial Sequence
  Description of Artificial Sequence: Synthetic oligonucleotide
  Target: ATXN1; (-) strand; PAM type: NRG; PAM sequence: AGG
acttcagcctccctaggaac

SEQ ID NO: 41296 - DNA, 20 bp, Artificial Sequence
  Description of Artificial Sequence: Synthetic oligonucleotide
  Target: ATXN1; (-) strand; PAM type: NRG; PAM sequence: CAG
cacttcagcctccctaggaa

SEQ ID NO: 41297 - DNA, 20 bp, Artificial Sequence
  Description of Artificial Sequence: Synthetic oligonucleotide
  Target: ATXN1; (-) strand; PAM type: NRG; PAM sequence: AGG
cctcccacttcagcctccct

SEQ ID NO: 41298 - DNA, 20 bp, Artificial Sequence
  Description of Artificial Sequence: Synthetic oligonucleotide
  Target: ATXN1; (-) strand; PAM type: NRG; PAM sequence: TAG
tcctcccacttcagcctccc

SEQ ID NO: 41299 - DNA, 20 bp, Artificial Sequence
  Description of Artificial Sequence: Synthetic oligonucleotide
  Target: ATXN1; (-) strand; PAM type: NRG; PAM sequence: CAG
ctcaagcaatcctcccactt

SEQ ID NO: 41300 - DNA, 20 bp, Artificial Sequence
  Description of Artificial Sequence: Synthetic oligonucleotide
  Target: ATXN1; (-) strand; PAM type: NRG; PAM sequence: AAG
agctttgacctcctaggctc

SEQ ID NO: 41301 - DNA, 20 bp, Artificial Sequence
  Description of Artificial Sequence: Synthetic oligonucleotide
  Target: ATXN1; (-) strand; PAM type: NRG; PAM sequence: AGG
cactgcagctttgacctcct

SEQ ID NO: 41302 - DNA, 20 bp, Artificial Sequence
  Description of Artificial Sequence: Synthetic oligonucleotide
  Target: ATXN1; (-) strand; PAM type: NRG; PAM sequence: TAG
tcactgcagctttgacctcc

SEQ ID NO: 41303 - DNA, 20 bp, Artificial Sequence
  Description of Artificial Sequence: Synthetic oligonucleotide
  Target: ATXN1; (-) strand; PAM type: NRG; PAM sequence: CAG
gacaccataatagctcactg

SEQ ID NO: 41304 - DNA, 20 bp, Artificial Sequence
  Description of Artificial Sequence: Synthetic oligonucleotide
  Target: ATXN1; (-) strand; PAM type: NRG; PAM sequence: TAG
ggagtgcagtgacaccataa

SEQ ID NO: 41305 - DNA, 20 bp, Artificial Sequence
  Description of Artificial Sequence: Synthetic oligonucleotide
  Target: ATXN1; (-) strand; PAM type: NRG; PAM sequence: CAG
ctgttgcccaggctggagtg

SEQ ID NO: 41306 - DNA, 20 bp, Artificial Sequence
  Description of Artificial Sequence: Synthetic oligonucleotide
  Target: ATXN1; (-) strand; PAM type: NRG; PAM sequence: GAG
ttgctctgttgcccaggctg

SEQ ID NO: 41307 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgttgcccaggc

SEQ ID NO: 41308 - DNA, 20 bp, Artificial Sequence
  Description of Artificial Sequence: Synthetic oligonucleotide
  Target: ATXN1; (-) strand; PAM type: NRG; PAM sequence: AGG
agggtcttgctctgttgccc

SEQ ID NO: 41309 - DNA, 20 bp, Artificial Sequence
  Description of Artificial Sequence: Synthetic oligonucleotide
  Target: ATXN1; (-) strand; PAM type: NRG; PAM sequence: CAG
tagggtcttgctctgttgcc

SEQ ID NO: 41310 - DNA, 20 bp, Artificial Sequence
  Description of Artificial Sequence: Synthetic oligonucleotide
  Target: ATXN1; (-) strand; PAM type: NRG; PAM sequence: GGG
cattttttttttttgagata

SEQ ID NO: 41311 - DNA, 20 bp, Artificial Sequence
  Description of Artificial Sequence: Synthetic oligonucleotide
  Target: ATXN1; (-) strand; PAM type: NRG; PAM sequence: AGG
acattttttttttttgagat

SEQ ID NO: 41312 - DNA, 20 bp, Artificial Sequence
  Description of Artificial Sequence: Synthetic oligonucleotide
  Target: ATXN1; (-) strand; PAM type: NRG; PAM sequence: TAG
cacattttttttttttgaga

SEQ ID NO: 41313 - DNA, 20 bp, Artificial Sequence
  Description of Artificial Sequence: Synthetic oligonucleotide
  Target: ATXN1; (-) strand; PAM type: NRG; PAM sequence: GAG
aaggcacatttttttttttt

SEQ ID NO: 41314 - DNA, 20 bp, Artificial Sequence
  Description of Artificial Sequence: Synthetic oligonucleotide
  Target: ATXN1; (-) strand; PAM type: NRG; PAM sequence: AGG
gaatattatgttgttcttta

SEQ ID NO: 41315 - DNA, 20 bp, Artificial Sequence
  Description of Artificial Sequence: Synthetic oligonucleotide
  Target: ATXN1; (-) strand; PAM type: NRG; PAM sequence: AAG
tgaatattatgttgttcttt

SEQ ID NO: 41316 - DNA, 20 bp, Artificial Sequence
  Description of Artificial Sequence: Synthetic oligonucleotide
  Target: ATXN1; (-) strand; PAM type: NRG; PAM sequence: TAG
tctgatagctcatttctttt

SEQ ID NO: 41317 - DNA, 20 bp, Artificial Sequence
  Description of Artificial Sequence: Synthetic oligonucleotide
  Target: ATXN1; (-) strand; PAM type: NRG; PAM sequence: TAG
atgtcttcttgttgctctga

SEQ ID NO: 41318 - DNA, 20 bp, Artificial Sequence
  Description of Artificial Sequence: Synthetic oligonucleotide
  Target: ATXN1; (-) strand; PAM type: NRG; PAM sequence: AGG
cacttagcgatatgcatttc

SEQ ID NO: 41319 - DNA, 20 bp, Artificial Sequence
  Description of Artificial Sequence: Synthetic oligonucleotide
  Target: ATXN1; (-) strand; PAM type: NRG; PAM sequence: CAG
tcacttagcgatatgcattt

SEQ ID NO: 41320 - DNA, 20 bp, Artificial Sequence
  Description of Artificial Sequence: Synthetic oligonucleotide
  Target: ATXN1; (-) strand; PAM type: NRG; PAM sequence: TAG
tcacattggcgtctctcact

SEQ ID NO: 41321 - DNA, 20 bp, Artificial Sequence
  Description of Artificial Sequence: Synthetic oligonucleotide
  Target: ATXN1; (-) strand; PAM type: NRG; PAM sequence: TGG
ggtatgtcgccttttcacat

SEQ ID NO: 41322 - DNA, 20 bp, Artificial Sequence
  Description of Artificial Sequence: Synthetic oligonucleotide
  Target: ATXN1; (-) strand; PAM type: NRG; PAM sequence: CGG
gccatgcagttggaatcatc

SEQ ID NO: 41323 - DNA, 20 bp, Artificial Sequence
  Description of Artificial Sequence: Synthetic oligonucleotide
  Target: ATXN1; (-) strand; PAM type: NRG; PAM sequence: TGG
gttccagaatgccatgcagt

SEQ ID NO: 41324 - DNA, 20 bp, Artificial Sequence
  Description of Artificial Sequence: Synthetic oligonucleotide
  Target: ATXN1; (-) strand; PAM type: NRG; PAM sequence: CAG
gcctgttccagaatgccatg

SEQ ID NO: 41325 - DNA, 20 bp, Artificial Sequence
  Description of Artificial Sequence: Synthetic oligonucleotide
  Target: ATXN1; (-) strand; PAM type: NRG; PAM sequence: CAG
ctccatagttttgcctgttc

SEQ ID NO: 41326 - DNA, 20 bp, Artificial Sequence
  Description of Artificial Sequence: Synthetic oligonucleotide
  Target: ATXN1; (-) strand; PAM type: NRG; PAM sequence: TAG
tgatcattttactctctcca

SEQ ID NO: 41327 - DNA, 20 bp, Artificial Sequence
  Description of Artificial Sequence: Synthetic oligonucleotide
  Target: ATXN1; (-) strand; PAM type: NRG; PAM sequence: TGG
cacaccccacctgaaactcc

SEQ ID NO: 41328 - DNA, 20 bp, Artificial Sequence
  Description of Artificial Sequence: Synthetic oligonucleotide
  Target: ATXN1; (-) strand; PAM type: NRG; PAM sequence: CAG
cattacattattatacagaa

SEQ ID NO: 41329 - DNA, 20 bp, Artificial Sequence
  Description of Artificial Sequence: Synthetic oligonucleotide
  Target: ATXN1; (-) strand; PAM type: NRG; PAM sequence: CAG
tccagcattacattattata

SEQ ID NO: 41330 - DNA, 20 bp, Artificial Sequence
  Description of Artificial Sequence: Synthetic oligonucleotide
  Target: ATXN1; (-) strand; PAM type: NRG; PAM sequence: CAG
aatttatgatgtcatgtatc

SEQ ID NO: 41331 - DNA, 20 bp, Artificial Sequence
  Description of Artificial Sequence: Synthetic oligonucleotide
  Target: ATXN1; (-) strand; PAM type: NRG; PAM sequence: CAG
aaagtccatagtttatacta

SEQ ID NO: 41332 - DNA, 20 bp, Artificial Sequence
  Description of Artificial Sequence: Synthetic oligonucleotide
  Target: ATXN1; (-) strand; PAM type: NRG; PAM sequence: TAG
ttatttttaactaaagtcca

SEQ ID NO: 41333 - DNA, 20 bp, Artificial Sequence
  Description of Artificial Sequence: Synthetic oligonucleotide
  Target: ATXN1; (-) strand; PAM type: NRG; PAM sequence: AAG
cgataccttatttttaacta

SEQ ID NO: 41334 - DNA, 20 bp, Artificial Sequence
  Description of Artificial Sequence: Synthetic oligonucleotide
  Target: ATXN1; (-) strand; PAM type: NRG; PAM sequence: CAG
attggttacaactgatgagc

SEQ ID NO: 41335 - DNA, 20 bp, Artificial Sequence
  Description of Artificial Sequence: Synthetic oligonucleotide
  Target: ATXN1; (-) strand; PAM type: NRG; PAM sequence: GAG
atagattggttacaactgat

SEQ ID NO: 41336 - DNA, 20 bp, Artificial Sequence
  Description of Artificial Sequence: Synthetic oligonucleotide
  Target: ATXN1; (-) strand; PAM type: NRG; PAM sequence: TGG
cttgcattggtgtgatagat

SEQ ID NO: 41337 - DNA, 20 bp, Artificial Sequence
  Description of Artificial Sequence: Synthetic oligonucleotide
  Target: ATXN1; (-) strand; PAM type: NRG; PAM sequence: TAG
aaaatcttgcattggtgtga

SEQ ID NO: 41338 - DNA, 20 bp, Artificial Sequence
  Description of Artificial Sequence: Synthetic oligonucleotide
  Target: ATXN1; (-) strand; PAM type: NRG; PAM sequence: TGG
ctgttattaaaatcttgcat

SEQ ID NO: 41339 - DNA, 20 bp, Artificial Sequence
  Description of Artificial Sequence: Synthetic oligonucleotide
  Target: ATXN1; (-) strand; PAM type: NRG; PAM sequence: CAG
gagaggtctcacacacctaa

SEQ ID NO: 41340 - DNA, 20 bp, Artificial Sequence
  Description of Artificial Sequence: Synthetic oligonucleotide
  Target: ATXN1; (-) strand; PAM type: NRG; PAM sequence: AGG
ggtgtacagcaagtagagag

SEQ ID NO: 41341 - DNA, 20 bp, Artificial Sequence
  Description of Artificial Sequence: Synthetic oligonucleotide
  Target: ATXN1; (-) strand; PAM type: NRG; PAM sequence: GAG
aggtgtacagcaagtagaga

SEQ ID NO: 41342 - DNA, 20 bp, Artificial Sequence
  Description of Artificial Sequence: Synthetic oligonucleotide
  Target: ATXN1; (-) strand; PAM type: NRG; PAM sequence: GAG
ttaggtgtacagcaagtaga

SEQ ID NO: 41343 - DNA, 20 bp, Artificial Sequence
  Description of Artificial Sequence: Synthetic oligonucleotide
  Target: ATXN1; (-) strand; PAM type: NRG; PAM sequence: GAG
ttttaggtgtacagcaagta

SEQ ID NO: 41344 - DNA, 20 bp, Artificial Sequence
  Description of Artificial Sequence: Synthetic oligonucleotide
  Target: ATXN1; (-) strand; PAM type: NRG; PAM sequence: TAG
agttttaggtgtacagcaag

SEQ ID NO: 41345 - DNA, 20 bp, Artificial Sequence
  Description of Artificial Sequence: Synthetic oligonucleotide
  Target: ATXN1; (-) strand; PAM type: NRG; PAM sequence: AAG
agcagttttaggtgtacagc

SEQ ID NO: 41346 - DNA, 20 bp, Artificial Sequence
  Description of Artificial Sequence: Synthetic oligonucleotide
  Target: ATXN1; (-) strand; PAM type: NRG; PAM sequence: CAG
ttaaagcagttttaggtgta

SEQ ID NO: 41347 - DNA, 20 bp, Artificial Sequence
  Description of Artificial Sequence: Synthetic oligonucleotide
  Target: ATXN1; (-) strand; PAM type: NRG; PAM sequence: AGG
ctattgtttaaagcagtttt

SEQ ID NO: 41348 - DNA, 20 bp, Artificial Sequence
  Description of Artificial Sequence: Synthetic oligonucleotide
  Target: ATXN1; (-) strand; PAM type: NRG; PAM sequence: TAG
actattgtttaaagcagttt

SEQ ID NO: 41349 - DNA, 20 bp, Artificial Sequence
  Description of Artificial Sequence: Synthetic oligonucleotide
  Target: ATXN1; (-) strand; PAM type: NRG; PAM sequence: CAG
ttaaagactattgtttaaag

SEQ ID NO: 41350 - DNA, 20 bp, Artificial Sequence
  Description of Artificial Sequence: Synthetic oligonucleotide
  Target: ATXN1; (-) strand; PAM type: NRG; PAM sequence: AAG
aaattaaagactattgttta

SEQ ID NO: 41351 - DNA, 20 bp, Artificial Sequence
  Description of Artificial Sequence: Synthetic oligonucleotide
  Target: ATXN1; (-) strand; PAM type: NRG; PAM sequence: AAG
tagcatttagaaaaaaatta

SEQ ID NO: 41352 - DNA, 20 bp, Artificial Sequence
  Description of Artificial Sequence: Synthetic oligonucleotide
  Target: ATXN1; (-) strand; PAM type: NRG; PAM sequence: TAG
ctgttgttgtttatagcatt

SEQ ID NO: 41353 - DNA, 20 bp, Artificial Sequence
  Description of Artificial Sequence: Synthetic oligonucleotide
  Target: ATXN1; (-) strand; PAM type: NRG; PAM sequence: TAG
tctcagactgttgttgttta

SEQ ID NO: 41354 - DNA, 20 bp, Artificial Sequence
  Description of Artificial Sequence: Synthetic oligonucleotide
  Target: ATXN1; (-) strand; PAM type: NRG; PAM sequence: CAG
cttatatgttttgattctct

SEQ ID NO: 41355 - DNA, 20 bp, Artificial Sequence
  Description of Artificial Sequence: Synthetic oligonucleotide
  Target: ATXN1; (-) strand; PAM type: NRG; PAM sequence: GGG
tgctatatgtgcccccaact

SEQ ID NO: 41356 - DNA, 20 bp, Artificial Sequence
  Description of Artificial Sequence: Synthetic oligonucleotide
  Target: ATXN1; (-) strand; PAM type: NRG; PAM sequence: TGG
gtgctatatgtgcccccaac

SEQ ID NO: 41357 - DNA, 20 bp, Artificial Sequence
  Description of Artificial Sequence: Synthetic oligonucleotide
  Target: ATXN1; (-) strand; PAM type: NRG; PAM sequence: GAG
ctctaaaaaaaaaaaaaaag

SEQ ID NO: 41358 - DNA, 20 bp, Artificial Sequence
  Description of Artificial Sequence: Synthetic oligonucleotide
  Target: ATXN1; (-) strand; PAM type: NRG; PAM sequence: AGG
ctctctaaaaaaaaaaaaaa

SEQ ID NO: 41359 - DNA, 20 bp, Artificial Sequence
  Description of Artificial Sequence: Synthetic oligonucleotide
  Target: ATXN1; (-) strand; PAM type: NRG; PAM sequence: AAG
cctctctaaaaaaaaaaaaa

SEQ ID NO: 41360 - DNA, 20 bp, Artificial Sequence
  Description of Artificial Sequence: Synthetic oligonucleotide
  Target: ATXN1; (-) strand; PAM type: NRG; PAM sequence: GGG
caaaccacatttttgtttgt

SEQ ID NO: 41361 - DNA, 20 bp, Artificial Sequence
  Description of Artificial Sequence: Synthetic oligonucleotide
  Target: ATXN1; (-) strand; PAM type: NRG; PAM sequence: TGG
tcaaaccacatttttgtttg

SEQ ID NO: 41362 - DNA, 20 bp, Artificial Sequence
  Description of Artificial Sequence: Synthetic oligonucleotide
  Target: ATXN1; (-) strand; PAM type: NRG; PAM sequence: GAG
gtgctggaaaggctccaaca

SEQ ID NO: 41363 - DNA, 20 bp, Artificial Sequence
  Description of Artificial Sequence: Synthetic oligonucleotide
  Target: ATXN1; (-) strand; PAM type: NRG; PAM sequence: CAG
tggtgctggaaaggctccaa

SEQ ID NO: 41364 - DNA, 20 bp, Artificial Sequence
  Description of Artificial Sequence: Synthetic oligonucleotide
  Target: ATXN1; (-) strand; PAM type: NRG; PAM sequence: AGG
tgtctgttctggtgctggaa

SEQ ID NO: 41365 - DNA, 20 bp, Artificial Sequence
  Description of Artificial Sequence: Synthetic oligonucleotide
  Target: ATXN1; (-) strand; PAM type: NRG; PAM sequence: AAG
ctgtctgttctggtgctgga

SEQ ID NO: 41366 - DNA, 20 bp, Artificial Sequence
  Description of Artificial Sequence: Synthetic oligonucleotide
  Target: ATXN1; (-) strand; PAM type: NRG; PAM sequence: TGG
cttcctgtctgttctggtgc

SEQ ID NO: 41367 - DNA, 20 bp, Artificial Sequence
  Description of Artificial Sequence: Synthetic oligonucleotide
  Target: ATXN1; (-) strand; PAM type: NRG; PAM sequence: TGG
tacacacttcctgtctgttc

SEQ ID NO: 41368 - DNA, 20 bp, Artificial Sequence
  Description of Artificial Sequence: Synthetic oligonucleotide
  Target: ATXN1; (-) strand; PAM type: NRG; PAM sequence: TGG
tggatttgtgccgcagttgt

SEQ ID NO: 41369 - DNA, 20 bp, Artificial Sequence
  Description of Artificial Sequence: Synthetic oligonucleotide
  Target: ATXN1; (-) strand; PAM type: NRG; PAM sequence: CAG
ccagccctggatttgtgccg

SEQ ID NO: 41370 - DNA, 20 bp, Artificial Sequence
  Description of Artificial Sequence: Synthetic oligonucleotide
  Target: ATXN1; (-) strand; PAM type: NRG; PAM sequence: TGG
ctgtgtgcagagcccagccc

SEQ ID NO: 41371 - DNA, 20 bp, Artificial Sequence
  Description of Artificial Sequence: Synthetic oligonucleotide
  Target: ATXN1; (-) strand; PAM type: NRG; PAM sequence: CAG
actgccctgtgtgcagagcc

SEQ ID NO: 41372 - DNA, 20 bp, Artificial Sequence
  Description of Artificial Sequence: Synthetic oligonucleotide
  Target: ATXN1; (-) strand; PAM type: NRG; PAM sequence: GAG
tggtgactgccctgtgtgca

SEQ ID NO: 41373 - DNA, 20 bp, Artificial Sequence
  Description of Artificial Sequence: Synthetic oligonucleotide
  Target: ATXN1; (-) strand; PAM type: NRG; PAM sequence: CAG
gttggtgactgccctgtgtg

SEQ ID NO: 41374 - DNA, 20 bp, Artificial Sequence
  Description of Artificial Sequence: Synthetic oligonucleotide
  Target: ATXN1; (-) strand; PAM type: NRG; PAM sequence: TGG
tgtatcaaaaaatagatagt

SEQ ID NO: 41375 - DNA, 20 bp, Artificial Sequence
  Description of Artificial Sequence: Synthetic oligonucleotide
  Target: ATXN1; (-) strand; PAM type: NRG; PAM sequence: TAG
ctaatgtatcaaaaaataga

SEQ ID NO: 41376 - DNA, 20 bp, Artificial Sequence
  Description of Artificial Sequence: Synthetic oligonucleotide
  Target: ATXN1; (-) strand; PAM type: NRG; PAM sequence: TAG
aatcctaatgtatcaaaaaa

SEQ ID NO: 41377 - DNA, 20 bp, Artificial Sequence
  Description of Artificial Sequence: Synthetic oligonucleotide
  Target: ATXN1; (-) strand; PAM type: NRG; PAM sequence: TGG
attgaacatgccgagcttgg

SEQ ID NO: 41378 - DNA, 20 bp, Artificial Sequence
  Description of Artificial Sequence: Synthetic oligonucleotide
  Target: ATXN1; (-) strand; PAM type: NRG; PAM sequence: TGG
aacattgaacatgccgagct

SEQ ID NO: 41379 - DNA, 20 bp, Artificial Sequence
  Description of Artificial Sequence: Synthetic oligonucleotide
  Target: ATXN1; (-) strand; PAM type: NRG; PAM sequence: GAG
ttgccaacattgaacatgcc

SEQ ID NO: 41380 - DNA, 20 bp, Artificial Sequence
  Description of Artificial Sequence: Synthetic oligonucleotide
  Target: ATXN1; (-) strand; PAM type: NRG; PAM sequence: CAG
cagtccctttgcagccaagg

SEQ ID NO: 41381 - DNA, 20 bp, Artificial Sequence
  Description of Artificial Sequence: Synthetic oligonucleotide
  Target: ATXN1; (-) strand; PAM type: NRG; PAM sequence: AGG
agtcagtccctttgcagcca

SEQ ID NO: 41382 - DNA, 20 bp, Artificial Sequence
  Description of Artificial Sequence: Synthetic oligonucleotide
  Target: ATXN1; (-) strand; PAM type: NRG; PAM sequence: AAG
gagtcagtccctttgcagcc

SEQ ID NO: 41383 - DNA, 20 bp, Artificial Sequence
  Description of Artificial Sequence: Synthetic oligonucleotide
  Target: ATXN1; (-) strand; PAM type: NRG; PAM sequence: CAG
ctgtagagtcagtccctttg

SEQ ID NO: 41384 - DNA, 20 bp, Artificial Sequence
  Description of Artificial Sequence: Synthetic oligonucleotide
  Target: ATXN1; (-) strand; PAM type: NRG; PAM sequence: CAG
ggcacatgagcctgtagagt

SEQ ID NO: 41385 - DNA, 20 bp, Artificial Sequence
  Description of Artificial Sequence: Synthetic oligonucleotide
  Target: ATXN1; (-) strand; PAM type: NRG; PAM sequence: GAG
aggcggcacatgagcctgta

SEQ ID NO: 41386 - DNA, 20 bp, Artificial Sequence
  Description of Artificial Sequence: Synthetic oligonucleotide
  Target: ATXN1; (-) strand; PAM type: NRG; PAM sequence: TAG
gcaggcggcacatgagcctg

SEQ ID NO: 41387 - DNA, 20 bp, Artificial Sequence
  Description of Artificial Sequence: Synthetic oligonucleotide
  Target: ATXN1; (-) strand; PAM type: NRG; PAM sequence: GAG
ccctcatgcaggcggcacat

SEQ ID NO: 41388 - DNA, 20 bp, Artificial Sequence
  Description of Artificial Sequence: Synthetic oligonucleotide
  Target: ATXN1; (-) strand; PAM type: NRG; PAM sequence: CGG
agccgaggccctcatgcagg

SEQ ID NO: 41389 - DNA, 20 bp, Artificial Sequence
  Description of Artificial Sequence: Synthetic oligonucleotide
  Target: ATXN1; (-) strand; PAM type: NRG; PAM sequence: AGG
aatagccgaggccctcatgc

SEQ ID NO: 41390 - DNA, 20 bp, Artificial Sequence
  Description of Artificial Sequence: Synthetic oligonucleotide
  Target: ATXN1; (-) strand; PAM type: NRG; PAM sequence: CAG
aaatagccgaggccctcatg

SEQ ID NO: 41391 - DNA, 20 bp, Artificial Sequence
  Description of Artificial Sequence: Synthetic oligonucleotide
  Target: ATXN1; (-) strand; PAM type: NRG; PAM sequence: AGG
ctggtacctaaaaatagccg

SEQ ID NO: 41392 - DNA, 20 bp, Artificial Sequence
  Description of Artificial Sequence: Synthetic oligonucleotide
  Target: ATXN1; (-) strand; PAM type: NRG; PAM sequence: GAG
gctggtacctaaaaatagcc

SEQ ID NO: 41393 - DNA, 20 bp, Artificial Sequence
  Description of Artificial Sequence: Synthetic oligonucleotide
  Target: ATXN1; (-) strand; PAM type: NRG; PAM sequence: TAG
gattagctggtacctaaaaa

SEQ ID NO: 41394 - DNA, 20 bp, Artificial Sequence
  Description of Artificial Sequence: Synthetic oligonucleotide
  Target: ATXN1; (-) strand; PAM type: NRG; PAM sequence: TGG
tatgcattgaatggattagc

SEQ ID NO: 41395 - DNA, 20 bp, Artificial Sequence
  Description of Artificial Sequence: Synthetic oligonucleotide
  Target: ATXN1; (-) strand; PAM type: NRG; PAM sequence: TAG
acattatgcattgaatggat

SEQ ID NO: 41396 - DNA, 20 bp, Artificial Sequence
  Description of Artificial Sequence: Synthetic oligonucleotide
  Target: ATXN1; (-) strand; PAM type: NRG; PAM sequence: TGG
tggtaacattatgcattgaa

SEQ ID NO: 41397 - DNA, 20 bp, Artificial Sequence
  Description of Artificial Sequence: Synthetic oligonucleotide
  Target: ATXN1; (-) strand; PAM type: NRG; PAM sequence: TGG
tgtgagctgtgagtcatcgg

SEQ ID NO: 41398 - DNA, 20 bp, Artificial Sequence
  Description of Artificial Sequence: Synthetic oligonucleotide
  Target: ATXN1; (-) strand; PAM type: NRG; PAM sequence: CGG
ttctgtgagctgtgagtcat

SEQ ID NO: 41399 - DNA, 20 bp, Artificial Sequence
  Description of Artificial Sequence: Synthetic oligonucleotide
  Target: ATXN1; (-) strand; PAM type: NRG; PAM sequence: GAG
ggttgacttctgtgagctgt

SEQ ID NO: 41400 - DNA, 20 bp, Artificial Sequence
  Description of Artificial Sequence: Synthetic oligonucleotide
  Target: ATXN1; (-) strand; PAM type: NRG; PAM sequence: GAG
attttttggttgacttctgt

SEQ ID NO: 41401 - DNA, 20 bp, Artificial Sequence
  Description of Artificial Sequence: Synthetic oligonucleotide
  Target: ATXN1; (-) strand; PAM type: NRG; PAM sequence: TGG
cctttcattctactattttt

SEQ ID NO: 41402 - DNA, 20 bp, Artificial Sequence
  Description of Artificial Sequence: Synthetic oligonucleotide
  Target: ATXN1; (-) strand; PAM type: NRG; PAM sequence: TGG
acttactggctgtctaccga

SEQ ID NO: 41403 - DNA, 20 bp, Artificial Sequence
  Description of Artificial Sequence: Synthetic oligonucleotide
  Target: ATXN1; (-) strand; PAM type: NRG; PAM sequence: TGG
tgttatcatgatgtacttac

SEQ ID NO: 41404 - DNA, 20 bp, Artificial Sequence
  Description of Artificial Sequence: Synthetic oligonucleotide
  Target: ATXN1; (-) strand; PAM type: NRG; PAM sequence: CAG
ctgtgtgtgtgctcgtacag

SEQ ID NO: 41405 - DNA, 20 bp, Artificial Sequence
  Description of Artificial Sequence: Synthetic oligonucleotide
  Target: ATXN1; (-) strand; PAM type: NRG; PAM sequence: CAG
tgcctgtgtgtgtgctcgta

SEQ ID NO: 41406 - DNA, 20 bp, Artificial Sequence
  Description of Artificial Sequence: Synthetic oligonucleotide
  Target: ATXN1; (-) strand; PAM type: NRG; PAM sequence: GAG
gactgtcctggcgtgggtgt

SEQ ID NO: 41407 - DNA, 20 bp, Artificial Sequence
  Description of Artificial Sequence: Synthetic oligonucleotide
  Target: ATXN1; (-) strand; PAM type: NRG; PAM sequence: GGG
cctcccgactgtcctggcgt

SEQ ID NO: 41408 - DNA, 20 bp, Artificial Sequence
  Description of Artificial Sequence: Synthetic oligonucleotide
  Target: ATXN1; (-) strand; PAM type: NRG; PAM sequence: TGG
tcctcccgactgtcctggcg

SEQ ID NO: 41409 - DNA, 20 bp, Artificial Sequence
  Description of Artificial Sequence: Synthetic oligonucleotide
  Target: ATXN1; (-) strand; PAM type: NRG; PAM sequence: TGG
tttcctcctcccgactgtcc

SEQ ID NO: 41410 - DNA, 20 bp, Artificial Sequence
  Description of Artificial Sequence: Synthetic oligonucleotide
  Target: ATXN1; (-) strand; PAM type: NRG; PAM sequence: CAG
ctcggtggctgcttaatatt

SEQ ID NO: 41411 - DNA, 20 bp, Artificial Sequence
  Description of Artificial Sequence: Synthetic oligonucleotide
  Target: ATXN1; (-) strand; PAM type: NRG; PAM sequence: TGG
tgactgcttccctgactcgg

SEQ ID NO: 41412 - DNA, 20 bp, Artificial Sequence
  Description of Artificial Sequence: Synthetic oligonucleotide
  Target: ATXN1; (-) strand; PAM type: NRG; PAM sequence: CGG
aggtgactgcttccctgact

SEQ ID NO: 41413 - DNA, 20 bp, Artificial Sequence
  Description of Artificial Sequence: Synthetic oligonucleotide
  Target: ATXN1; (-) strand; PAM type: NRG; PAM sequence: AGG
tcgcttcccagcgcctcccg

SEQ ID NO: 41414 - DNA, 20 bp, Artificial Sequence
  Description of Artificial Sequence: Synthetic oligonucleotide
  Target: ATXN1; (-) strand; PAM type: NRG; PAM sequence: GAG
gtcgcttcccagcgcctccc

SEQ ID NO: 41415 - DNA, 20 bp, Artificial Sequence
  Description of Artificial Sequence: Synthetic oligonucleotide
  Target: ATXN1; (-) strand; PAM type: NRG; PAM sequence: CAG
tagggccgtctgtcgcttcc

SEQ ID NO: 41416 - DNA, 20 bp, Artificial Sequence
  Description of Artificial Sequence: Synthetic oligonucleotide
  Target: ATXN1; (-) strand; PAM type: NRG; PAM sequence: GGG
tgccaggctctgtgttatta

SEQ ID NO: 41417 - DNA, 20 bp, Artificial Sequence
  Description of Artificial Sequence: Synthetic oligonucleotide
  Target: ATXN1; (-) strand; PAM type: NRG; PAM sequence: AGG
atgccaggctctgtgttatt

SEQ ID NO: 41418 - DNA, 20 bp, Artificial Sequence
  Description of Artificial Sequence: Synthetic oligonucleotide
  Target: ATXN1; (-) strand; PAM type: NRG; PAM sequence: TAG
aatgccaggctctgtgttat

SEQ ID NO: 41419 - DNA, 20 bp, Artificial Sequence
  Description of Artificial Sequence: Synthetic oligonucleotide
  Target: ATXN1; (-) strand; PAM type: NRG; PAM sequence: AGG
ttgcttctttcctaaatgcc

SEQ ID NO: 41420 - DNA, 20 bp, Artificial Sequence
  Description of Artificial Sequence: Synthetic oligonucleotide
  Target: ATXN1; (-) strand; PAM type: NRG; PAM sequence: CAG
tttgcttctttcctaaatgc

SEQ ID NO: 41421 - DNA, 20 bp, Artificial Sequence
  Description of Artificial Sequence: Synthetic oligonucleotide
  Target: ATXN1; (-) strand; PAM type: NRG; PAM sequence: GGG
atgtattggtaaagtgctct

SEQ ID NO: 41422 - DNA, 20 bp, Artificial Sequence
  Description of Artificial Sequence: Synthetic oligonucleotide
  Target: ATXN1; (-) strand; PAM type: NRG; PAM sequence: TGG
aatgtattggtaaagtgctc

SEQ ID NO: 41423 - DNA, 20 bp, Artificial Sequence
  Description of Artificial Sequence: Synthetic oligonucleotide
  Target: ATXN1; (-) strand; PAM type: NRG; PAM sequence: AAG
agttgtaaaatgtattggta

SEQ ID NO: 41424 - DNA, 20 bp, Artificial Sequence
  Description of Artificial Sequence: Synthetic oligonucleotide
  Target: ATXN1; (-) strand; PAM type: NRG; PAM sequence: TGG
agtggagttgtaaaatgtat

SEQ ID NO: 41425 - DNA, 20 bp, Artificial Sequence
  Description of Artificial Sequence: Synthetic oligonucleotide
  Target: ATXN1; (-) strand; PAM type: NRG; PAM sequence: GAG
tacacagcatttgctcagtg

SEQ ID NO: 41426 - DNA, 20 bp, Artificial Sequence
  Description of Artificial Sequence: Synthetic oligonucleotide
  Target: ATXN1; (-) strand; PAM type: NRG; PAM sequence: TGG
agtacacagcatttgctcag

SEQ ID NO: 41427 - DNA, 20 bp, Artificial Sequence
  Description of Artificial Sequence: Synthetic oligonucleotide
  Target: ATXN1; (-) strand; PAM type: NRG; PAM sequence: CAG
aagagtacacagcatttgct

SEQ ID NO: 41428 - DNA, 20 bp, Artificial Sequence
  Description of Artificial Sequence: Synthetic oligonucleotide
  Target: ATXN1; (-) strand; PAM type: NRG; PAM sequence: CAG
cagcttctctgaagagtaca

SEQ ID NO: 41429 - DNA, 20 bp, Artificial Sequence
  Description of Artificial Sequence: Synthetic oligonucleotide
  Target: ATXN1; (-) strand; PAM type: NRG; PAM sequence: GAG
ctaggttcagcttctctgaa

SEQ ID NO: 41430 - DNA, 20 bp, Artificial Sequence
  Description of Artificial Sequence: Synthetic oligonucleotide
  Target: ATXN1; (-) strand; PAM type: NRG; PAM sequence: AAG
tcctaggttcagcttctctg

SEQ ID NO: 41431 - DNA, 20 bp, Artificial Sequence
  Description of Artificial Sequence: Synthetic oligonucleotide
  Target: ATXN1; (-) strand; PAM type: NRG; PAM sequence: CAG
tgtctcacccttcctaggtt

SEQ ID NO: 41432 - DNA, 20 bp, Artificial Sequence
  Description of Artificial Sequence: Synthetic oligonucleotide
  Target: ATXN1; (-) strand; PAM type: NRG; PAM sequence: AGG
ccttctgtctcacccttcct

SEQ ID NO: 41433 - DNA, 20 bp, Artificial Sequence
  Description of Artificial Sequence: Synthetic oligonucleotide
  Target: ATXN1; (-) strand; PAM type: NRG; PAM sequence: TAG
tccttctgtctcacccttcc

SEQ ID NO: 41434 - DNA, 20 bp, Artificial Sequence
  Description of Artificial Sequence: Synthetic oligonucleotide
  Target: ATXN1; (-) strand; PAM type: NRG; PAM sequence: CGG
agcctttggcttccatctgg

SEQ ID NO: 41435 - DNA, 20 bp, Artificial Sequence
  Description of Artificial Sequence: Synthetic oligonucleotide
  Target: ATXN1; (-) strand; PAM type: NRG; PAM sequence: TGG
gggagcctttggcttccatc

SEQ ID NO: 41436 - DNA, 20 bp, Artificial Sequence
  Description of Artificial Sequence: Synthetic oligonucleotide
  Target: ATXN1; (-) strand; PAM type: NRG; PAM sequence: TGG
ggccccagctggggagcctt

SEQ ID NO: 41437 - DNA, 20 bp, Artificial Sequence
  Description of Artificial Sequence: Synthetic oligonucleotide
  Target: ATXN1; (-) strand; PAM type: NRG; PAM sequence: GAG
ccaggatggccccagctggg

SEQ ID NO: 41438 - DNA, 20 bp, Artificial Sequence
  Description of Artificial Sequence: Synthetic oligonucleotide
  Target: ATXN1; (-) strand; PAM type: NRG; PAM sequence: GGG
gcccaggatggccccagctg

SEQ ID NO: 41439 - DNA, 20 bp, Artificial Sequence
  Description of Artificial Sequence: Synthetic oligonucleotide
  Target: ATXN1; (-) strand; PAM type: NRG; PAM sequence: GGG
tgcccaggatggccccagct

SEQ ID NO: 41440 - DNA, 20 bp, Artificial Sequence
  Description of Artificial Sequence: Synthetic oligonucleotide
  Target: ATXN1; (-) strand; PAM type: NRG; PAM sequence: TGG
ctgcccaggatggccccagc

SEQ ID NO: 41441 - DNA, 20 bp, Artificial Sequence
  Description of Artificial Sequence: Synthetic oligonucleotide
  Target: ATXN1; (-) strand; PAM type: NRG; PAM sequence: CAG
agccctgcccaggatggccc

SEQ ID NO: 41442 - DNA, 20 bp, Artificial Sequence
  Description of Artificial Sequence: Synthetic oligonucleotide
  Target: ATXN1; (-) strand; PAM type: NRG; PAM sequence: TGG
tgggacagccctgcccagga

SEQ ID NO: 41443 - DNA, 20 bp, Artificial Sequence
  Description of Artificial Sequence: Synthetic oligonucleotide
  Target: ATXN1; (-) strand; PAM type: NRG; PAM sequence: AGG
ccgctgggacagccctgccc

SEQ ID NO: 41444 - DNA, 20 bp, Artificial Sequence
  Description of Artificial Sequence: Synthetic oligonucleotide
  Target: ATXN1; (-) strand; PAM type: NRG; PAM sequence: CAG
cccgctgggacagccctgcc

SEQ ID NO: 41445 - DNA, 20 bp, Artificial Sequence
  Description of Artificial Sequence: Synthetic oligonucleotide
  Target: ATXN1; (-) strand; PAM type: NRG; PAM sequence: CAG
tagtgacgtgcccgctggga

SEQ ID NO: 41446 - DNA, 20 bp, Artificial Sequence
  Description of Artificial Sequence: Synthetic oligonucleotide
  Target: ATXN1; (-) strand; PAM type: NRG; PAM sequence: GGG
ctgttagtgacgtgcccgct

SEQ ID NO: 41447 - DNA, 20 bp, Artificial Sequence
  Description of Artificial Sequence: Synthetic oligonucleotide
  Target: ATXN1; (-) strand; PAM type: NRG; PAM sequence: TGG
gctgttagtgacgtgcccgc

SEQ ID NO: 41448 - DNA, 20 bp, Artificial Sequence
  Description of Artificial Sequence: Synthetic oligonucleotide
  Target: ATXN1; (-) strand; PAM type: NRG; PAM sequence: TAG
cctcttctgcaagaggctgt

SEQ ID NO: 41449 - DNA, 20 bp, Artificial Sequence
  Description of Artificial Sequence: Synthetic oligonucleotide
  Target: ATXN1; (-) strand; PAM type: NRG; PAM sequence: AGG
ccaggctcctcttctgcaag

SEQ ID NO: 41450 - DNA, 20 bp, Artificial Sequence
  Description of Artificial Sequence: Synthetic oligonucleotide
  Target: ATXN1; (-) strand; PAM type: NRG; PAM sequence: GAG
cccaggctcctcttctgcaa

SEQ ID NO: 41451 - DNA, 20 bp, Artificial Sequence
  Description of Artificial Sequence: Synthetic oligonucleotide
  Target: ATXN1; (-) strand; PAM type: NRG; PAM sequence: AAG
ctcccaggctcctcttctgc

SEQ ID NO: 41452 - DNA, 20 bp, Artificial Sequence
  Description of Artificial Sequence: Synthetic oligonucleotide
  Target: ATXN1; (-) strand; PAM type: NRG; PAM sequence: AGG
atgcagaaacaagggctccc

SEQ ID NO: 41453 - DNA, 20 bp, Artificial Sequence
  Description of Artificial Sequence: Synthetic oligonucleotide
  Target: ATXN1; (-) strand; PAM type: NRG; PAM sequence: CAG
aatgcagaaacaagggctcc

SEQ ID NO: 41454 - DNA, 20 bp, Artificial Sequence
  Description of Artificial Sequence: Synthetic oligonucleotide
  Target: ATXN1; (-) strand; PAM type: NRG; PAM sequence: GGG
gacaaccaatgcagaaacaa

SEQ ID NO: 41455 - DNA, 20 bp, Artificial Sequence
  Description of Artificial Sequence: Synthetic oligonucleotide
  Target: ATXN1; (-) strand; PAM type: NRG; PAM sequence: AGG
agacaaccaatgcagaaaca

SEQ ID NO: 41456 - DNA, 20 bp, Artificial Sequence
  Description of Artificial Sequence: Synthetic oligonucleotide
  Target: ATXN1; (-) strand; PAM type: NRG; PAM sequence: AAG
aagacaaccaatgcagaaac

SEQ ID NO: 41457 - DNA, 20 bp, Artificial Sequence
  Description of Artificial Sequence: Synthetic oligonucleotide
  Target: ATXN1; (-) strand; PAM type: NRG; PAM sequence: CAG
gatcagtaagacaaccaatg

SEQ ID NO: 41458 - DNA, 20 bp, Artificial Sequence
  Description of Artificial Sequence: Synthetic oligonucleotide
  Target: ATXN1; (-) strand; PAM type: NRG; PAM sequence: AAG
ctccagccctccagatcagt

SEQ ID NO: 41459 - DNA, 20 bp, Artificial Sequence
  Description of Artificial Sequence: Synthetic oligonucleotide
  Target: ATXN1; (-) strand; PAM type: NRG; PAM sequence: CAG
ggtgctccagccctccagat

SEQ ID NO: 41460 - DNA, 20 bp, Artificial Sequence
  Description of Artificial Sequence: Synthetic oligonucleotide
  Target: ATXN1; (-) strand; PAM type: NRG; PAM sequence: CAG
gcattggtgctccagccctc

SEQ ID NO: 41461 - DNA, 20 bp, Artificial Sequence
  Description of Artificial Sequence: Synthetic oligonucleotide
  Target: ATXN1; (-) strand; PAM type: NRG; PAM sequence: CAG
tgaggggtgcattggtgctc

SEQ ID NO: 41462 - DNA, 20 bp, Artificial Sequence
  Description of Artificial Sequence: Synthetic oligonucleotide
  Target: ATXN1; (-) strand; PAM type: NRG; PAM sequence: TGG
actggatttgaggggtgcat

SEQ ID NO: 41463 - DNA, 20 bp, Artificial Sequence
  Description of Artificial Sequence: Synthetic oligonucleotide
  Target: ATXN1; (-) strand; PAM type: NRG; PAM sequence: GGG
gagtatgaactggatttgag

SEQ ID NO: 41464 - DNA, 20 bp, Artificial Sequence
  Description of Artificial Sequence: Synthetic oligonucleotide
  Target: ATXN1; (-) strand; PAM type: NRG; PAM sequence: GGG
tgagtatgaactggatttga

SEQ ID NO: 41465 - DNA, 20 bp, Artificial Sequence
  Description of Artificial Sequence: Synthetic oligonucleotide
  Target: ATXN1; (-) strand; PAM type: NRG; PAM sequence: AGG
ctgagtatgaactggatttg

SEQ ID NO: 41466 - DNA, 20 bp, Artificial Sequence
  Description of Artificial Sequence: Synthetic oligonucleotide
  Target: ATXN1; (-) strand; PAM type: NRG; PAM sequence: GAG
tctgagtatgaactggattt

SEQ ID NO: 41467 - DNA, 20 bp, Artificial Sequence
  Description of Artificial Sequence: Synthetic oligonucleotide
  Target: ATXN1; (-) strand; PAM type: NRG; PAM sequence: TGG
ctgtatttctgagtatgaac

SEQ ID NO: 41468 - DNA, 20 bp, Artificial Sequence
  Description of Artificial Sequence: Synthetic oligonucleotide
  Target: ATXN1; (-) strand; PAM type: NRG; PAM sequence: GAG
gcatatcaatctgtatttct

SEQ ID NO: 41469 - DNA, 20 bp, Artificial Sequence
  Description of Artificial Sequence: Synthetic oligonucleotide
  Target: ATXN1; (-) strand; PAM type: NRG; PAM sequence: GAG
gatgtcatgccagcctgcgt

SEQ ID NO: 41470 - DNA, 20 bp, Artificial Sequence
  Description of Artificial Sequence: Synthetic oligonucleotide
  Target: ATXN1; (-) strand; PAM type: NRG; PAM sequence: CAG
aaggctaaatgatgtcatgc

SEQ ID NO: 41471 - DNA, 20 bp, Artificial Sequence
  Description of Artificial Sequence: Synthetic oligonucleotide
  Target: ATXN1; (-) strand; PAM type: NRG; PAM sequence: AGG
tcccgccgttcctgtttcta

SEQ ID NO: 41472 - DNA, 20 bp, Artificial Sequence
  Description of Artificial Sequence: Synthetic oligonucleotide
  Target: ATXN1; (-) strand; PAM type: NRG; PAM sequence: AAG
ttcccgccgttcctgtttct

SEQ ID NO: 41473 - DNA, 20 bp, Artificial Sequence
  Description of Artificial Sequence: Synthetic oligonucleotide
  Target: ATXN1; (-) strand; PAM type: NRG; PAM sequence: GAG
atcccgcgagtggccgaggc

SEQ ID NO: 41474 - DNA, 20 bp, Artificial Sequence
  Description of Artificial Sequence: Synthetic oligonucleotide
  Target: ATXN1; (-) strand; PAM type: NRG; PAM sequence: AGG
tggaatcccgcgagtggccg

SEQ ID NO: 41475 - DNA, 20 bp, Artificial Sequence
  Description of Artificial Sequence: Synthetic oligonucleotide
  Target: ATXN1; (-) strand; PAM type: NRG; PAM sequence: GAG
gtggaatcccgcgagtggcc

SEQ ID NO: 41476 - DNA, 20 bp, Artificial Sequence
  Description of Artificial Sequence: Synthetic oligonucleotide
  Target: ATXN1; (-) strand; PAM type: NRG; PAM sequence: TGG
tcggggtggaatcccgcgag

SEQ ID NO: 41477 - DNA, 20 bp, Artificial Sequence
  Description of Artificial Sequence: Synthetic oligonucleotide
  Target: ATXN1; (-) strand; PAM type: NRG; PAM sequence: GAG
tcctcggggtggaatcccgc

SEQ ID NO: 41478 - DNA, 20 bp, Artificial Sequence
  Description of Artificial Sequence: Synthetic oligonucleotide
  Target: ATXN1; (-) strand; PAM type: NRG; PAM sequence: TGG
cctgcctgtaatcctcgggg

SEQ ID NO: 41479 - DNA, 20 bp, Artificial Sequence
  Description of Artificial Sequence: Synthetic oligonucleotide
  Target: ATXN1; (-) strand; PAM type: NRG; PAM sequence: GGG
taccctgcctgtaatcctcg

SEQ ID NO: 41480 - DNA, 20 bp, Artificial Sequence
  Description of Artificial Sequence: Synthetic oligonucleotide
  Target: ATXN1; (-) strand; PAM type: NRG; PAM sequence: GGG
ttaccctgcctgtaatcctc

SEQ ID NO: 41481 - DNA, 20 bp, Artificial Sequence
  Description of Artificial Sequence: Synthetic oligonucleotide
  Target: ATXN1; (-) strand; PAM type: NRG; PAM sequence: CGG
tttaccctgcctgtaatcct

SEQ ID NO: 41482 - DNA, 20 bp, Artificial Sequence
  Description of Artificial Sequence: Synthetic oligonucleotide
  Target: ATXN1; (-) strand; PAM type: NRG; PAM sequence: AAG
acttttccaatgagcacaat

SEQ ID NO: 41483 - DNA, 20 bp, Artificial Sequence
  Description of Artificial Sequence: Synthetic oligonucleotide
  Target: ATXN1; (-) strand; PAM type: NRG; PAM sequence: GAG
gaaggctgaacttttccaat

SEQ ID NO: 41484 - DNA, 20 bp, Artificial Sequence
  Description of Artificial Sequence: Synthetic oligonucleotide
  Target: ATXN1; (-) strand; PAM type: NRG; PAM sequence: AGG
ctgatgaaagtctagaaaga

SEQ ID NO: 41485 - DNA, 20 bp, Artificial Sequence
  Description of Artificial Sequence: Synthetic oligonucleotide
  Target: ATXN1; (-) strand; PAM type: NRG; PAM sequence: AAG
gctgatgaaagtctagaaag

SEQ ID NO: 41486 - DNA, 20 bp, Artificial Sequence
  Description of Artificial Sequence: Synthetic oligonucleotide
  Target: ATXN1; (-) strand; PAM type: NRG; PAM sequence: AAG
gcagctgatgaaagtctaga

SEQ ID NO: 41487 - DNA, 20 bp, Artificial Sequence
  Description of Artificial Sequence: Synthetic oligonucleotide
  Target: ATXN1; (-) strand; PAM type: NRG; PAM sequence: TAG
agaggcagctgatgaaagtc

SEQ ID NO: 41488 - DNA, 20 bp, Artificial Sequence
  Description of Artificial Sequence: Synthetic oligonucleotide
  Target: ATXN1; (-) strand; PAM type: NRG; PAM sequence: AAG
gaaggagaggcagctgatga

SEQ ID NO: 41489 - DNA, 20 bp, Artificial Sequence
  Description of Artificial Sequence: Synthetic oligonucleotide
  Target: ATXN1; (-) strand; PAM type: NRG; PAM sequence: CAG
agagtttatggaaggagagg

SEQ ID NO: 41490 - DNA, 20 bp, Artificial Sequence
  Description of Artificial Sequence: Synthetic oligonucleotide
  Target: ATXN1; (-) strand; PAM type: NRG; PAM sequence: AGG
aaaagagtttatggaaggag

SEQ ID NO: 41491 - DNA, 20 bp, Artificial Sequence
  Description of Artificial Sequence: Synthetic oligonucleotide
  Target: ATXN1; (-) strand; PAM type: NRG; PAM sequence: GAG
aaaaagagtttatggaagga

SEQ ID NO: 41492 - DNA, 20 bp, Artificial Sequence
  Description of Artificial Sequence: Synthetic oligonucleotide
  Target: ATXN1; (-) strand; PAM type: NRG; PAM sequence: GAG
ctaaaaagagtttatggaag

SEQ ID NO: 41493 - DNA, 20 bp, Artificial Sequence
  Description of Artificial Sequence: Synthetic oligonucleotide
  Target: ATXN1; (-) strand; PAM type: NRG; PAM sequence: AGG
ttctaaaaagagtttatgga

SEQ ID NO: 41494 - DNA, 20 bp, Artificial Sequence
  Description of Artificial Sequence: Synthetic oligonucleotide
  Target: ATXN1; (-) strand; PAM type: NRG; PAM sequence: AAG
gttctaaaaagagtttatgg

SEQ ID NO: 41495 - DNA, 20 bp, Artificial Sequence
  Description of Artificial Sequence: Synthetic oligonucleotide
  Target: ATXN1; (-) strand; PAM type: NRG; PAM sequence: TGG
cgtgttctaaaaagagttta

SEQ ID NO: 41496 - DNA, 20 bp, Artificial Sequence
  Description of Artificial Sequence: Synthetic oligonucleotide
  Target: ATXN1; (-) strand; PAM type: NRG; PAM sequence: GAG
aaggcctcgtgttctaaaaa

SEQ ID NO: 41497 - DNA, 20 bp, Artificial Sequence
  Description of Artificial Sequence: Synthetic oligonucleotide
  Target: ATXN1; (-) strand; PAM type: NRG; PAM sequence: AAG
caaaggcctcgtgttctaaa

SEQ ID NO: 41498 - DNA, 20 bp, Artificial Sequence
  Description of Artificial Sequence: Synthetic oligonucleotide
  Target: ATXN1; (-) strand; PAM type: NRG; PAM sequence: AGG
acagctgaaaaataaatcaa

SEQ ID NO: 41499 - DNA, 20 bp, Artificial Sequence
  Description of Artificial Sequence: Synthetic oligonucleotide
  Target: ATXN1; (-) strand; PAM type: NRG; PAM sequence: AAG
cacagctgaaaaataaatca

SEQ ID NO: 41500 - DNA, 20 bp, Artificial Sequence
  Description of Artificial Sequence: Synthetic oligonucleotide
  Target: ATXN1; (-) strand; PAM type: NRG; PAM sequence: CAG
ggccctgagaaagtgattca

SEQ ID NO: 41501 - DNA, 20 bp, Artificial Sequence
  Description of Artificial Sequence: Synthetic oligonucleotide
  Target: ATXN1; (-) strand; PAM type: NRG; PAM sequence: AAG
agatggctcgggccctgaga

SEQ ID NO: 41502 - DNA, 20 bp, Artificial Sequence
  Description of Artificial Sequence: Synthetic oligonucleotide
  Target: ATXN1; (-) strand; PAM type: NRG; PAM sequence: GAG
acttagatggctcgggccct

SEQ ID NO: 41503 - DNA, 20 bp, Artificial Sequence
  Description of Artificial Sequence: Synthetic oligonucleotide
  Target: ATXN1; (-) strand; PAM type: NRG; PAM sequence: GGG
tgcttcaacttagatggctc

SEQ ID NO: 41504 - DNA, 20 bp, Artificial Sequence
  Description of Artificial Sequence: Synthetic oligonucleotide
  Target: ATXN1; (-) strand; PAM type: NRG; PAM sequence: CGG
ctgcttcaacttagatggct

SEQ ID NO: 41505 - DNA, 20 bp, Artificial Sequence
  Description of Artificial Sequence: Synthetic oligonucleotide
  Target: ATXN1; (-) strand; PAM type: NRG; PAM sequence: TGG
cttccctgcttcaacttaga

SEQ ID NO: 41506 - DNA, 20 bp, Artificial Sequence
  Description of Artificial Sequence: Synthetic oligonucleotide
  Target: ATXN1; (-) strand; PAM type: NRG; PAM sequence: TAG
ttcccttccctgcttcaact

SEQ ID NO: 41507 - DNA, 20 bp, Artificial Sequence
  Description of Artificial Sequence: Synthetic oligonucleotide
  Target: ATXN1; (-) strand; PAM type: NRG; PAM sequence: TAG
actgggaccttgtgcaatgt

SEQ ID NO: 41508 - DNA, 20 bp, Artificial Sequence
  Description of Artificial Sequence: Synthetic oligonucleotide
  Target: ATXN1; (-) strand; PAM type: NRG; PAM sequence: GGG
cctcacccgtcagtagcact

SEQ ID NO: 41509 - DNA, 20 bp, Artificial Sequence
  Description of Artificial Sequence: Synthetic oligonucleotide
  Target: ATXN1; (-) strand; PAM type: NRG; PAM sequence: TGG
ccctcacccgtcagtagcac

SEQ ID NO: 41510 - DNA, 20 bp, Artificial Sequence
  Description of Artificial Sequence: Synthetic oligonucleotide
  Target: ATXN1; (-) strand; PAM type: NRG; PAM sequence: TAG
acatatccctcacccgtcag

SEQ ID NO: 41511 - DNA, 20 bp, Artificial Sequence
  Description of Artificial Sequence: Synthetic oligonucleotide
  Target: ATXN1; (-) strand; PAM type: NRG; PAM sequence: CAG
tgaacatatccctcacccgt

SEQ ID NO: 41512 - DNA, 20 bp, Artificial Sequence
  Description of Artificial Sequence: Synthetic oligonucleotide
  Target: ATXN1; (-) strand; PAM type: NRG; PAM sequence: GAG
aactggcactgaagagatct

SEQ ID NO: 41513 - DNA, 20 bp, Artificial Sequence
  Description of Artificial Sequence: Synthetic oligonucleotide
  Target: ATXN1; (-) strand; PAM type: NRG; PAM sequence: GAG
atgcaggaactggcactgaa

SEQ ID NO: 41514 - DNA, 20 bp, Artificial Sequence
  Description of Artificial Sequence: Synthetic oligonucleotide
  Target: ATXN1; (-) strand; PAM type: NRG; PAM sequence: AAG
aaatgcaggaactggcactg

SEQ ID NO: 41515 - DNA, 20 bp, Artificial Sequence
  Description of Artificial Sequence: Synthetic oligonucleotide
  Target: ATXN1; (-) strand; PAM type: NRG; PAM sequence: TGG
tgcttggaaaatgcaggaac

SEQ ID NO: 41516 - DNA, 20 bp, Artificial Sequence
  Description of Artificial Sequence: Synthetic oligonucleotide
  Target: ATXN1; (-) strand; PAM type: NRG; PAM sequence: AGG
gttagctgcttggaaaatgc

SEQ ID NO: 41517 - DNA, 20 bp, Artificial Sequence
  Description of Artificial Sequence: Synthetic oligonucleotide
  Target: ATXN1; (-) strand; PAM type: NRG; PAM sequence: CAG
ggttagctgcttggaaaatg

SEQ ID NO: 41518 - DNA, 20 bp, Artificial Sequence
  Description of Artificial Sequence: Synthetic oligonucleotide
  Target: ATXN1; (-) strand; PAM type: NRG; PAM sequence: TGG
taggaagtaggttagctgct

SEQ ID NO: 41519 - DNA, 20 bp, Artificial Sequence
  Description of Artificial Sequence: Synthetic oligonucleotide
  Target: ATXN1; (-) strand; PAM type: NRG; PAM sequence: TAG
tccttgggtaggaagtaggt

SEQ ID NO: 41520 - DNA, 20 bp, Artificial Sequence
  Description of Artificial Sequence: Synthetic oligonucleotide
  Target: ATXN1; (-) strand; PAM type: NRG; PAM sequence: AGG
ctcctccttgggtaggaagt

SEQ ID NO: 41521 - DNA, 20 bp, Artificial Sequence
  Description of Artificial Sequence: Synthetic oligonucleotide
  Target: ATXN1; (-) strand; PAM type: NRG; PAM sequence: TAG
cctcctccttgggtaggaag

SEQ ID NO: 41522 - DNA, 20 bp, Artificial Sequence
  Description of Artificial Sequence: Synthetic oligonucleotide
  Target: ATXN1; (-) strand; PAM type: NRG; PAM sequence: AAG
gcacctcctccttgggtagg

SEQ ID NO: 41523 - DNA, 20 bp, Artificial Sequence
  Description of Artificial Sequence: Synthetic oligonucleotide
  Target: ATXN1; (-) strand; PAM type: NRG; PAM sequence: AGG
ttcgcacctcctccttgggt

SEQ ID NO: 41524 - DNA, 20 bp, Artificial Sequence
  Description of Artificial Sequence: Synthetic oligonucleotide
  Target: ATXN1; (-) strand; PAM type: NRG; PAM sequence: TAG
cttcgcacctcctccttggg

SEQ ID NO: 41525 - DNA, 20 bp, Artificial Sequence
  Description of Artificial Sequence: Synthetic oligonucleotide
  Target: ATXN1; (-) strand; PAM type: NRG; PAM sequence: GGG
gggcttcgcacctcctcctt

SEQ ID NO: 41526 - DNA, 20 bp, Artificial Sequence
  Description of Artificial Sequence: Synthetic oligonucleotide
  Target: ATXN1; (-) strand; PAM type: NRG; PAM sequence: TGG
ggggcttcgcacctcctcct

SEQ ID NO: 41527 - DNA, 20 bp, Artificial Sequence
  Description of Artificial Sequence: Synthetic oligonucleotide
  Target: ATXN1; (-) strand; PAM type: NRG; PAM sequence: GGG
tgcaactcaaaagaaggatg

SEQ ID NO: 41528 - DNA, 20 bp, Artificial Sequence
  Description of Artificial Sequence: Synthetic oligonucleotide
  Target: ATXN1; (-) strand; PAM type: NRG; PAM sequence: GGG
atgcaactcaaaagaaggat

SEQ ID NO: 41529 - DNA, 20 bp, Artificial Sequence
  Description of Artificial Sequence: Synthetic oligonucleotide
  Target: ATXN1; (-) strand; PAM type: NRG; PAM sequence: TGG
aatgcaactcaaaagaagga

SEQ ID NO: 41530 - DNA, 20 bp, Artificial Sequence
  Description of Artificial Sequence: Synthetic oligonucleotide
  Target: ATXN1; (-) strand; PAM type: NRG; PAM sequence: AGG
agccaatgcaactcaaaaga

SEQ ID NO: 41531 - DNA, 20 bp, Artificial Sequence
  Description of Artificial Sequence: Synthetic oligonucleotide
  Target: ATXN1; (-) strand; PAM type: NRG; PAM sequence: AAG
gagccaatgcaactcaaaag

SEQ ID NO: 41532 - DNA, 20 bp, Artificial Sequence
  Description of Artificial Sequence: Synthetic oligonucleotide
  Target: ATXN1; (-) strand; PAM type: NRG; PAM sequence: AAG
tgggagccaatgcaactcaa

SEQ ID NO: 41533 - DNA, 20 bp, Artificial Sequence
  Description of Artificial Sequence: Synthetic oligonucleotide
  Target: ATXN1; (-) strand; PAM type: NRG; PAM sequence: GAG
aggcgatagcatcaacgtgg

SEQ ID NO: 41534 - DNA, 20 bp, Artificial Sequence
  Description of Artificial Sequence: Synthetic oligonucleotide
  Target: ATXN1; (-) strand; PAM type: NRG; PAM sequence: GGG
cgaggcgatagcatcaacgt

SEQ ID NO: 41535 - DNA, 20 bp, Artificial Sequence
  Description of Artificial Sequence: Synthetic oligonucleotide
  Target: ATXN1; (-) strand; PAM type: NRG; PAM sequence: TGG
ccgaggcgatagcatcaacg

SEQ ID NO: 41536 - DNA, 20 bp, Artificial Sequence
  Description of Artificial Sequence: Synthetic oligonucleotide
  Target: ATXN1; (-) strand; PAM type: NRG; PAM sequence: TAG
agatgcgacccccgaggcga

SEQ ID NO: 41537 - DNA, 20 bp, Artificial Sequence
  Description of Artificial Sequence: Synthetic oligonucleotide
  Target: ATXN1; (-) strand; PAM type: NRG; PAM sequence: AGG
gcatccagatgcgacccccg

SEQ ID NO: 41538 - DNA, 20 bp, Artificial Sequence
  Description of Artificial Sequence: Synthetic oligonucleotide
  Target: ATXN1; (-) strand; PAM type: NRG; PAM sequence: GAG
cgcatccagatgcgaccccc

SEQ ID NO: 41539 - DNA, 20 bp, Artificial Sequence
  Description of Artificial Sequence: Synthetic oligonucleotide
  Target: ATXN1; (-) strand; PAM type: NRG; PAM sequence: CAG
ccataagtctgtggcgcatc

SEQ ID NO: 41540 - DNA, 20 bp, Artificial Sequence
  Description of Artificial Sequence: Synthetic oligonucleotide
  Target: ATXN1; (-) strand; PAM type: NRG; PAM sequence: TGG
agtttgaggccataagtctg

SEQ ID NO: 41541 - DNA, 20 bp, Artificial Sequence
  Description of Artificial Sequence: Synthetic oligonucleotide
  Target: ATXN1; (-) strand; PAM type: NRG; PAM sequence: AAG
tcctccaagtttgaggccat

SEQ ID NO: 41542 - DNA, 20 bp, Artificial Sequence
  Description of Artificial Sequence: Synthetic oligonucleotide
  Target: ATXN1; (-) strand; PAM type: NRG; PAM sequence: AGG
cttaatatcctccaagtttg

SEQ ID NO: 41543 - DNA, 20 bp, Artificial Sequence
  Description of Artificial Sequence: Synthetic oligonucleotide
  Target: ATXN1; (-) strand; PAM type: NRG; PAM sequence: GAG
acttaatatcctccaagttt

SEQ ID NO: 41544 - DNA, 20 bp, Artificial Sequence
  Description of Artificial Sequence: Synthetic oligonucleotide
  Target: ATXN1; (-) strand; PAM type: NRG; PAM sequence: AAG
taatccacttaatatcctcc

SEQ ID NO: 41545 - DNA, 20 bp, Artificial Sequence
  Description of Artificial Sequence: Synthetic oligonucleotide
  Target: ATXN1; (-) strand; PAM type: NRG; PAM sequence: GGG
atgacagaatcacttccctt

SEQ ID NO: 41546 - DNA, 20 bp, Artificial Sequence
  Description of Artificial Sequence: Synthetic oligonucleotide
  Target: ATXN1; (-) strand; PAM type: NRG; PAM sequence: TGG
gatgacagaatcacttccct

SEQ ID NO: 41547 - DNA, 20 bp, Artificial Sequence
  Description of Artificial Sequence: Synthetic oligonucleotide
  Target: ATXN1; (-) strand; PAM type: NRG; PAM sequence: CAG
ttgagagtcccaaaggatga

SEQ ID NO: 41548 - DNA, 20 bp, Artificial Sequence
  Description of Artificial Sequence: Synthetic oligonucleotide
  Target: ATXN1; (-) strand; PAM type: NRG; PAM sequence: AGG
attctggttgagagtcccaa

SEQ ID NO: 41549 - DNA, 20 bp, Artificial Sequence
  Description of Artificial Sequence: Synthetic oligonucleotide
  Target: ATXN1; (-) strand; PAM type: NRG; PAM sequence: AAG
gattctggttgagagtccca

SEQ ID NO: 41550 - DNA, 20 bp, Artificial Sequence
  Description of Artificial Sequence: Synthetic oligonucleotide
  Target: ATXN1; (-) strand; PAM type: NRG; PAM sequence: GAG
catgccttgattctggttga

SEQ ID NO: 41551 - DNA, 20 bp, Artificial Sequence
  Description of Artificial Sequence: Synthetic oligonucleotide
  Target: ATXN1; (-) strand; PAM type: NRG; PAM sequence: GAG
gccatgccttgattctggtt

SEQ ID NO: 41552 - DNA, 20 bp, Artificial Sequence
  Description of Artificial Sequence: Synthetic oligonucleotide
  Target: ATXN1; (-) strand; PAM type: NRG; PAM sequence: TGG
gctttgccatgccttgattc

SEQ ID NO: 41553 - DNA, 20 bp, Artificial Sequence
  Description of Artificial Sequence: Synthetic oligonucleotide
  Target: ATXN1; (-) strand; PAM type: NRG; PAM sequence: GAG
acgttccccaccctggaaga

SEQ ID NO: 41554 - DNA, 20 bp, Artificial Sequence
  Description of Artificial Sequence: Synthetic oligonucleotide
  Target: ATXN1; (-) strand; PAM type: NRG; PAM sequence: GAG
gcacgttccccaccctggaa

SEQ ID NO: 41555 - DNA, 20 bp, Artificial Sequence
  Description of Artificial Sequence: Synthetic oligonucleotide
  Target: ATXN1; (-) strand; PAM type: NRG; PAM sequence: AAG
tagcacgttccccaccctgg

SEQ ID NO: 41556 - DNA, 20 bp, Artificial Sequence
  Description of Artificial Sequence: Synthetic oligonucleotide
  Target: ATXN1; (-) strand; PAM type: NRG; PAM sequence: TGG
tgatagcacgttccccaccc

SEQ ID NO: 41557 - DNA, 20 bp, Artificial Sequence
  Description of Artificial Sequence: Synthetic oligonucleotide
  Target: ATXN1; (-) strand; PAM type: NRG; PAM sequence: TAG
tcctcttcagtggagggtga

SEQ ID NO: 41558 - DNA, 20 bp, Artificial Sequence
  Description of Artificial Sequence: Synthetic oligonucleotide
  Target: ATXN1; (-) strand; PAM type: NRG; PAM sequence: GGG
cctccttcctcttcagtgga

SEQ ID NO: 41559 - DNA, 20 bp, Artificial Sequence
  Description of Artificial Sequence: Synthetic oligonucleotide
  Target: ATXN1; (-) strand; PAM type: NRG; PAM sequence: AGG
gcctccttcctcttcagtgg

SEQ ID NO: 41560 - DNA, 20 bp, Artificial Sequence
  Description of Artificial Sequence: Synthetic oligonucleotide
  Target: ATXN1; (-) strand; PAM type: NRG; PAM sequence: GAG
agcctccttcctcttcagtg

SEQ ID NO: 41561 - DNA, 20 bp, Artificial Sequence
  Description of Artificial Sequence: Synthetic oligonucleotide
  Target: ATXN1; (-) strand; PAM type: NRG; PAM sequence: TGG
gaagcctccttcctcttcag

SEQ ID NO: 41562 - DNA, 20 bp, Artificial Sequence
  Description of Artificial Sequence: Synthetic oligonucleotide
  Target: ATXN1; (-) strand; PAM type: NRG; PAM sequence: CAG
aaggaagcctccttcctctt

SEQ ID NO: 41563 - DNA, 20 bp, Artificial Sequence
  Description of Artificial Sequence: Synthetic oligonucleotide
  Target: ATXN1; (-) strand; PAM type: NRG; PAM sequence: AAG
gttactgcgtgcaccaaagg

SEQ ID NO: 41564 - DNA, 20 bp, Artificial Sequence
  Description of Artificial Sequence: Synthetic oligonucleotide
  Target: ATXN1; (-) strand; PAM type: NRG; PAM sequence: AGG
attgttactgcgtgcaccaa

SEQ ID NO: 41565 - DNA, 20 bp, Artificial Sequence
  Description of Artificial Sequence: Synthetic oligonucleotide
  Target: ATXN1; (-) strand; PAM type: NRG; PAM sequence: AAG
cattgttactgcgtgcacca

SEQ ID NO: 41566 - DNA, 20 bp, Artificial Sequence
  Description of Artificial Sequence: Synthetic oligonucleotide
  Target: ATXN1; (-) strand; PAM type: NRG; PAM sequence: AGG
tgggaggaaaggggaatgcc

SEQ ID NO: 41567 - DNA, 20 bp, Artificial Sequence
  Description of Artificial Sequence: Synthetic oligonucleotide
  Target: ATXN1; (-) strand; PAM type: NRG; PAM sequence: CAG
gtgggaggaaaggggaatgc

SEQ ID NO: 41568 - DNA, 20 bp, Artificial Sequence
  Description of Artificial Sequence: Synthetic oligonucleotide
  Target: ATXN1; (-) strand; PAM type: NRG; PAM sequence: GGG
taggtgctgtgggaggaaag

SEQ ID NO: 41569 - DNA, 20 bp, Artificial Sequence
  Description of Artificial Sequence: Synthetic oligonucleotide
  Target: ATXN1; (-) strand; PAM type: NRG; PAM sequence: GGG
ctaggtgctgtgggaggaaa

SEQ ID NO: 41570 - DNA, 20 bp, Artificial Sequence
  Description of Artificial Sequence: Synthetic oligonucleotide
  Target: ATXN1; (-) strand; PAM type: NRG; PAM sequence: AGG
cctaggtgctgtgggaggaa

SEQ ID NO: 41571 - DNA, 20 bp, Artificial Sequence
  Description of Artificial Sequence: Synthetic oligonucleotide
  Target: ATXN1; (-) strand; PAM type: NRG; PAM sequence: AAG
acctaggtgctgtgggagga

SEQ ID NO: 41572 - DNA, 20 bp, Artificial Sequence
  Description of Artificial Sequence: Synthetic oligonucleotide
  Target: ATXN1; (-) strand; PAM type: NRG; PAM sequence: AGG
ccccacctaggtgctgtggg

SEQ ID NO: 41573 - DNA, 20 bp, Artificial Sequence
  Description of Artificial Sequence: Synthetic oligonucleotide
  Target: ATXN1; (-) strand; PAM type: NRG; PAM sequence: GAG
cccccacctaggtgctgtgg

SEQ ID NO: 41574 - DNA, 20 bp, Artificial Sequence
  Description of Artificial Sequence: Synthetic oligonucleotide
  Target: ATXN1; (-) strand; PAM type: NRG; PAM sequence: GGG
ggcccccacctaggtgctgt

SEQ ID NO: 41575 - DNA, 20 bp, Artificial Sequence
  Description of Artificial Sequence: Synthetic oligonucleotide
  Target: ATXN1; (-) strand; PAM type: NRG; PAM sequence: TGG
aggcccccacctaggtgctg

SEQ ID NO: 41576 - DNA, 20 bp, Artificial Sequence
  Description of Artificial Sequence: Synthetic oligonucleotide
  Target: ATXN1; (-) strand; PAM type: NRG; PAM sequence: AGG
catcccccaggcccccacct

SEQ ID NO: 41577 - DNA, 20 bp, Artificial Sequence
  Description of Artificial Sequence: Synthetic oligonucleotide
  Target: ATXN1; (-) strand; PAM type: NRG; PAM sequence: TAG
gcatcccccaggcccccacc

SEQ ID NO: 41578 - DNA, 20 bp, Artificial Sequence
  Description of Artificial Sequence: Synthetic oligonucleotide
  Target: ATXN1; (-) strand; PAM type: NRG; PAM sequence: AGG
aaagcgtctatgcatccccc

SEQ ID NO: 41579 - DNA, 20 bp, Artificial Sequence
  Description of Artificial Sequence: Synthetic oligonucleotide
  Target: ATXN1; (-) strand; PAM type: NRG; PAM sequence: CAG
caaagcgtctatgcatcccc

SEQ ID NO: 41580 - DNA, 20 bp, Artificial Sequence
  Description of Artificial Sequence: Synthetic oligonucleotide
  Target: ATXN1; (-) strand; PAM type: NRG; PAM sequence: AAG
agcttttctccactcgagca

SEQ ID NO: 41581 - DNA, 20 bp, Artificial Sequence
  Description of Artificial Sequence: Synthetic oligonucleotide
  Target: ATXN1; (-) strand; PAM type: NRG; PAM sequence: GAG
agtacagcttttctccactc

SEQ ID NO: 41582 - DNA, 20 bp, Artificial Sequence
  Description of Artificial Sequence: Synthetic oligonucleotide
  Target: ATXN1; (-) strand; PAM type: NRG; PAM sequence: CAG
tggcattgccctgcccagta

SEQ ID NO: 41583 - DNA, 20 bp, Artificial Sequence
  Description of Artificial Sequence: Synthetic oligonucleotide
  Target: ATXN1; (-) strand; PAM type: NRG; PAM sequence: CAG
ccctgtggcattgccctgcc

SEQ ID NO: 41584 - DNA, 20 bp, Artificial Sequence
  Description of Artificial Sequence: Synthetic oligonucleotide
  Target: ATXN1; (-) strand; PAM type: NRG; PAM sequence: TGG
cgtgtttgtcactatccctg

SEQ ID NO: 41585 - DNA, 20 bp, Artificial Sequence
  Description of Artificial Sequence: Synthetic oligonucleotide
  Target: ATXN1; (-) strand; PAM type: NRG; PAM sequence: GAG
ctccagacgaggcaatgtag

SEQ ID NO: 41586 - DNA, 20 bp, Artificial Sequence
  Description of Artificial Sequence: Synthetic oligonucleotide
  Target: ATXN1; (-) strand; PAM type: NRG; PAM sequence: AGG
cgctccagacgaggcaatgt

SEQ ID NO: 41587 - DNA, 20 bp, Artificial Sequence
  Description of Artificial Sequence: Synthetic oligonucleotide
  Target: ATXN1; (-) strand; PAM type: NRG; PAM sequence: TAG
acgctccagacgaggcaatg

SEQ ID NO: 41588 - DNA, 20 bp, Artificial Sequence
  Description of Artificial Sequence: Synthetic oligonucleotide
  Target: ATXN1; (-) strand; PAM type: NRG; PAM sequence: AGG
cccagctgacgctccagacg

SEQ ID NO: 41589 - DNA, 20 bp, Artificial Sequence
  Description of Artificial Sequence: Synthetic oligonucleotide
  Target: ATXN1; (-) strand; PAM type: NRG; PAM sequence: GAG
tcccagctgacgctccagac

SEQ ID NO: 41590 - DNA, 20 bp, Artificial Sequence
  Description of Artificial Sequence: Synthetic oligonucleotide
  Target: ATXN1; (-) strand; PAM type: NRG; PAM sequence: CAG
cattgtcccagctgacgctc

SEQ ID NO: 41591 - DNA, 20 bp, Artificial Sequence
  Description of Artificial Sequence: Synthetic oligonucleotide
  Target: ATXN1; (-) strand; PAM type: NRG; PAM sequence: CAG
agatgcccccagcattgtcc

SEQ ID NO: 41592 - DNA, 20 bp, Artificial Sequence
  Description of Artificial Sequence: Synthetic oligonucleotide
  Target: ATXN1; (-) strand; PAM type: NRG; PAM sequence: CAG
agactgtggaaagatgcccc

SEQ ID NO: 41593 - DNA, 20 bp, Artificial Sequence
  Description of Artificial Sequence: Synthetic oligonucleotide
  Target: ATXN1; (-) strand; PAM type: NRG; PAM sequence: AAG
ttcctcattaagactgtgga

SEQ ID NO: 41594 - DNA, 20 bp, Artificial Sequence
  Description of Artificial Sequence: Synthetic oligonucleotide
  Target: ATXN1; (-) strand; PAM type: NRG; PAM sequence: TGG
tgaattcctcattaagactg

SEQ ID NO: 41595 - DNA, 20 bp, Artificial Sequence
  Description of Artificial Sequence: Synthetic oligonucleotide
  Target: ATXN1; (-) strand; PAM type: NRG; PAM sequence: AAG
aaggggctgaattcctcatt

SEQ ID NO: 41596 - DNA, 20 bp, Artificial Sequence
  Description of Artificial Sequence: Synthetic oligonucleotide
  Target: ATXN1; (-) strand; PAM type: NRG; PAM sequence: GGG
gtttggggatgatttttaag

SEQ ID NO: 41597 - DNA, 20 bp, Artificial Sequence
  Description of Artificial Sequence: Synthetic oligonucleotide
  Target: ATXN1; (-) strand; PAM type: NRG; PAM sequence: GGG
agtttggggatgatttttaa

SEQ ID NO: 41598 - DNA, 20 bp, Artificial Sequence
  Description of Artificial Sequence: Synthetic oligonucleotide
  Target: ATXN1; (-) strand; PAM type: NRG; PAM sequence: AGG
tagtttggggatgattttta

SEQ ID NO: 41599 - DNA, 20 bp, Artificial Sequence
  Description of Artificial Sequence: Synthetic oligonucleotide
  Target: ATXN1; (-) strand; PAM type: NRG; PAM sequence: AAG
ttagtttggggatgattttt

SEQ ID NO: 41600 - DNA, 20 bp, Artificial Sequence
  Description of Artificial Sequence: Synthetic oligonucleotide
  Target: ATXN1; (-) strand; PAM type: NRG; PAM sequence: GGG
actgaggggtgtttagtttg

SEQ ID NO: 41601 - DNA, 20 bp, Artificial Sequence
  Description of Artificial Sequence: Synthetic oligonucleotide
  Target: ATXN1; (-) strand; PAM type: NRG; PAM sequence: GGG
aactgaggggtgtttagttt

SEQ ID NO: 41602 - DNA, 20 bp, Artificial Sequence
  Description of Artificial Sequence: Synthetic oligonucleotide
  Target: ATXN1; (-) strand; PAM type: NRG; PAM sequence: TGG
aaactgaggggtgtttagtt

SEQ ID NO: 41603 - DNA, 20 bp, Artificial Sequence
  Description of Artificial Sequence: Synthetic oligonucleotide
  Target: ATXN1; (-) strand; PAM type: NRG; PAM sequence: TAG
atataaaactgaggggtgtt

SEQ ID NO: 41604 - DNA, 20 bp, Artificial Sequence
  Description of Artificial Sequence: Synthetic oligonucleotide
  Target: ATXN1; (-) strand; PAM type: NRG; PAM sequence: GGG
ccatggcatataaaactgag

SEQ ID NO: 41605 - DNA, 20 bp, Artificial Sequence
  Description of Artificial Sequence: Synthetic oligonucleotide
  Target: ATXN1; (-) strand; PAM type: NRG; PAM sequence: GGG
gccatggcatataaaactga

SEQ ID NO: 41606 - DNA, 20 bp, Artificial Sequence
  Description of Artificial Sequence: Synthetic oligonucleotide
  Target: ATXN1; (-) strand; PAM type: NRG; PAM sequence: AGG
agccatggcatataaaactg

SEQ ID NO: 41607 - DNA, 20 bp, Artificial Sequence
  Description of Artificial Sequence: Synthetic oligonucleotide
  Target: ATXN1; (-) strand; PAM type: NRG; PAM sequence: GAG
aagccatggcatataaaact

SEQ ID NO: 41608 - DNA, 20 bp, Artificial Sequence
  Description of Artificial Sequence: Synthetic oligonucleotide
  Target: ATXN1; (-) strand; PAM type: NRG; PAM sequence: TGG
cctcatgggaactaaagcca

SEQ ID NO: 41609 - DNA, 20 bp, Artificial Sequence
  Description of Artificial Sequence: Synthetic oligonucleotide
  Target: ATXN1; (-) strand; PAM type: NRG; PAM sequence: AAG
cacagacctcatgggaacta

SEQ ID NO: 41610 - DNA, 20 bp, Artificial Sequence
  Description of Artificial Sequence: Synthetic oligonucleotide
  Target: ATXN1; (-) strand; PAM type: NRG; PAM sequence: GGG
aagcggcacacagacctcat

SEQ ID NO: 41611 - DNA, 20 bp, Artificial Sequence
  Description of Artificial Sequence: Synthetic oligonucleotide
  Target: ATXN1; (-) strand; PAM type: NRG; PAM sequence: TGG
taagcggcacacagacctca

SEQ ID NO: 41612 - DNA, 20 bp, Artificial Sequence
  Description of Artificial Sequence: Synthetic oligonucleotide
  Target: ATXN1; (-) strand; PAM type: NRG; PAM sequence: CAG
acctcatgctaagcggcaca

SEQ ID NO: 41613 - DNA, 20 bp, Artificial Sequence
  Description of Artificial Sequence: Synthetic oligonucleotide
  Target: ATXN1; (-) strand; PAM type: NRG; PAM sequence: CGG
tgtactgacctcatgctaag

SEQ ID NO: 41614 - DNA, 20 bp, Artificial Sequence
  Description of Artificial Sequence: Synthetic oligonucleotide
  Target: ATXN1; (-) strand; PAM type: NRG; PAM sequence: AAG
acatgtactgacctcatgct

SEQ ID NO: 41615 - DNA, 20 bp, Artificial Sequence
  Description of Artificial Sequence: Synthetic oligonucleotide
  Target: ATXN1; (-) strand; PAM type: NRG; PAM sequence: AAG
aaaaaaccaagaagagcatt

SEQ ID NO: 41616 - DNA, 20 bp, Artificial Sequence
  Description of Artificial Sequence: Synthetic oligonucleotide
  Target: ATXN1; (-) strand; PAM type: NRG; PAM sequence: GAG
ggttaacaaaaaaccaagaa

SEQ ID NO: 41617 - DNA, 20 bp, Artificial Sequence
  Description of Artificial Sequence: Synthetic oligonucleotide
  Target: ATXN1; (-) strand; PAM type: NRG; PAM sequence: AAG
tcggttaacaaaaaaccaag

SEQ ID NO: 41618 - DNA, 20 bp, Artificial Sequence
  Description of Artificial Sequence: Synthetic oligonucleotide
  Target: ATXN1; (-) strand; PAM type: NRG; PAM sequence: AAG
gcgtcggttaacaaaaaacc

SEQ ID NO: 41619 - DNA, 20 bp, Artificial Sequence
  Description of Artificial Sequence: Synthetic oligonucleotide
  Target: ATXN1; (-) strand; PAM type: NRG; PAM sequence: CGG
ttgtaaaaatttattagcgt

SEQ ID NO: 41620 - DNA, 20 bp, Artificial Sequence
  Description of Artificial Sequence: Synthetic oligonucleotide
  Target: ATXN1; (-) strand; PAM type: NRG; PAM sequence: TAG
cagcccttgtaaaaatttat

SEQ ID NO: 41621 - DNA, 20 bp, Artificial Sequence
  Description of Artificial Sequence: Synthetic oligonucleotide
  Target: ATXN1; (-) strand; PAM type: NRG; PAM sequence: CAG
ttatactttccagaacagca

SEQ ID NO: 41622 - DNA, 20 bp, Artificial Sequence
  Description of Artificial Sequence: Synthetic oligonucleotide
  Target: ATXN1; (-) strand; PAM type: NRG; PAM sequence: CAG
cacttttatactttccagaa

SEQ ID NO: 41623 - DNA, 20 bp, Artificial Sequence
  Description of Artificial Sequence: Synthetic oligonucleotide
  Target: ATXN1; (-) strand; PAM type: NRG; PAM sequence: CAG
tgcttcacttttatactttc

SEQ ID NO: 41624 - DNA, 20 bp, Artificial Sequence
  Description of Artificial Sequence: Synthetic oligonucleotide
  Target: ATXN1; (-) strand; PAM type: NRG; PAM sequence: GGG
taggagataatctcttgaga

SEQ ID NO: 41625 - DNA, 20 bp, Artificial Sequence
  Description of Artificial Sequence: Synthetic oligonucleotide
  Target: ATXN1; (-) strand; PAM type: NRG; PAM sequence: AGG
ataggagataatctcttgag

SEQ ID NO: 41626 - DNA, 20 bp, Artificial Sequence
  Description of Artificial Sequence: Synthetic oligonucleotide
  Target: ATXN1; (-) strand; PAM type: NRG; PAM sequence: GAG
cataggagataatctcttga

SEQ ID NO: 41627 - DNA, 20 bp, Artificial Sequence
  Description of Artificial Sequence: Synthetic oligonucleotide
  Target: ATXN1; (-) strand; PAM type: NRG; PAM sequence: GAG
ttcataggagataatctctt

SEQ ID NO: 41628 - DNA, 20 bp, Artificial Sequence
  Description of Artificial Sequence: Synthetic oligonucleotide
  Target: ATXN1; (-) strand; PAM type: NRG; PAM sequence: GAG
ccacgtatgattcttcatag

SEQ ID NO: 41629 - DNA, 20 bp, Artificial Sequence
  Description of Artificial Sequence: Synthetic oligonucleotide
  Target: ATXN1; (-) strand; PAM type: NRG; PAM sequence: AGG
ggccacgtatgattcttcat

SEQ ID NO: 41630 - DNA, 20 bp, Artificial Sequence
  Description of Artificial Sequence: Synthetic oligonucleotide
  Target: ATXN1; (-) strand; PAM type: NRG; PAM sequence: TAG
cggccacgtatgattcttca

SEQ ID NO: 41631 - DNA, 20 bp, Artificial Sequence
  Description of Artificial Sequence: Synthetic oligonucleotide
  Target: ATXN1; (-) strand; PAM type: NRG; PAM sequence: CGG
taggcgtgagccacggcgcc

SEQ ID NO: 41632 - DNA, 20 bp, Artificial Sequence
  Description of Artificial Sequence: Synthetic oligonucleotide
  Target: ATXN1; (-) strand; PAM type: NRG; PAM sequence: CGG
gggattataggcgtgagcca

SEQ ID NO: 41633 - DNA, 20 bp, Artificial Sequence
  Description of Artificial Sequence: Synthetic oligonucleotide
  Target: ATXN1; (-) strand; PAM type: NRG; PAM sequence: GAG
aatgctgggattataggcgt

SEQ ID NO: 41634 - DNA, 20 bp, Artificial Sequence
  Description of Artificial Sequence: Synthetic oligonucleotide
  Target: ATXN1; (-) strand; PAM type: NRG; PAM sequence: AGG
tcccaaaatgctgggattat

SEQ ID NO: 41635 - DNA, 20 bp, Artificial Sequence
  Description of Artificial Sequence: Synthetic oligonucleotide
  Target: ATXN1; (-) strand; PAM type: NRG; PAM sequence: TAG
ctcccaaaatgctgggatta

SEQ ID NO: 41636 - DNA, 20 bp, Artificial Sequence
  Description of Artificial Sequence: Synthetic oligonucleotide
  Target: ATXN1; (-) strand; PAM type: NRG; PAM sequence: GGG
cctcggtctcccaaaatgct

SEQ ID NO: 41637 - DNA, 20 bp, Artificial Sequence
  Description of Artificial Sequence: Synthetic oligonucleotide
  Target: ATXN1; (-) strand; PAM type: NRG; PAM sequence: TGG
acctcggtctcccaaaatgc

SEQ ID NO: 41638 - DNA, 20 bp, Artificial Sequence
  Description of Artificial Sequence: Synthetic oligonucleotide
  Target: ATXN1; (-) strand; PAM type: NRG; PAM sequence: CGG
ctcaagcgatccacccacct

SEQ ID NO: 41639 - DNA, 20 bp, Artificial Sequence
  Description of Artificial Sequence: Synthetic oligonucleotide
  Target: ATXN1; (-) strand; PAM type: NRG; PAM sequence: AAG
ggtctggaactcctgggctc

SEQ ID NO: 41640 - DNA, 20 bp, Artificial Sequence
  Description of Artificial Sequence: Synthetic oligonucleotide
  Target: ATXN1; (-) strand; PAM type: NRG; PAM sequence: GGG
cgtgctggtctggaactcct

SEQ ID NO: 41641 - DNA, 20 bp, Artificial Sequence
  Description of Artificial Sequence: Synthetic oligonucleotide
  Target: ATXN1; (-) strand; PAM type: NRG; PAM sequence: TGG
ccgtgctggtctggaactcc

SEQ ID NO: 41642 - DNA, 20 bp, Artificial Sequence
  Description of Artificial Sequence: Synthetic oligonucleotide
  Target: ATXN1; (-) strand; PAM type: NRG; PAM sequence: TGG
ctatcttgcccgtgctggtc

SEQ ID NO: 41643 - DNA, 20 bp, Artificial Sequence
  Description of Artificial Sequence: Synthetic oligonucleotide
  Target: ATXN1; (-) strand; PAM type: NRG; PAM sequence: TGG
ttttgctatcttgcccgtgc

SEQ ID NO: 41644 - DNA, 20 bp, Artificial Sequence
  Description of Artificial Sequence: Synthetic oligonucleotide
  Target: ATXN1; (-) strand; PAM type: NRG; PAM sequence: GGG
tgtgtttttttgtagagaca

SEQ ID NO: 41645 - DNA, 20 bp, Artificial Sequence
  Description of Artificial Sequence: Synthetic oligonucleotide
  Target: ATXN1; (-) strand; PAM type: NRG; PAM sequence: AGG
ctgtgtttttttgtagagac

SEQ ID NO: 41646 - DNA, 20 bp, Artificial Sequence
  Description of Artificial Sequence: Synthetic oligonucleotide
  Target: ATXN1; (-) strand; PAM type: NRG; PAM sequence: CAG
tctgtgtttttttgtagaga

SEQ ID NO: 41647 - DNA, 20 bp, Artificial Sequence
  Description of Artificial Sequence: Synthetic oligonucleotide
  Target: ATXN1; (-) strand; PAM type: NRG; PAM sequence: GAG
attttctgtgtttttttgta

SEQ ID NO: 41648 - DNA, 20 bp, Artificial Sequence
  Description of Artificial Sequence: Synthetic oligonucleotide
  Target: ATXN1; (-) strand; PAM type: NRG; PAM sequence: TAG
taattttctgtgtttttttg

SEQ ID NO: 41649 - DNA, 20 bp, Artificial Sequence
  Description of Artificial Sequence: Synthetic oligonucleotide
  Target: ATXN1; (-) strand; PAM type: NRG; PAM sequence: CAG
tgggtgtgtaccactacacc

SEQ ID NO: 41650 - DNA, 20 bp, Artificial Sequence
  Description of Artificial Sequence: Synthetic oligonucleotide
  Target: ATXN1; (-) strand; PAM type: NRG; PAM sequence: GGG
tccccagtagctgggactat

SEQ ID NO: 41651 - DNA, 20 bp, Artificial Sequence
  Description of Artificial Sequence: Synthetic oligonucleotide
  Target: ATXN1; (-) strand; PAM type: NRG; PAM sequence: TGG
ctccccagtagctgggacta

SEQ ID NO: 41652 - DNA, 20 bp, Artificial Sequence
  Description of Artificial Sequence: Synthetic oligonucleotide
  Target: ATXN1; (-) strand; PAM type: NRG; PAM sequence: GGG
cctcagcctccccagtagct

SEQ ID NO: 41653 - DNA, 20 bp, Artificial Sequence
  Description of Artificial Sequence: Synthetic oligonucleotide
  Target: ATXN1; (-) strand; PAM type: NRG; PAM sequence: TGG
acctcagcctccccagtagc

SEQ ID NO: 41654 - DNA, 20 bp, Artificial Sequence
  Description of Artificial Sequence: Synthetic oligonucleotide
  Target: ATXN1; (-) strand; PAM type: NRG; PAM sequence: TAG
tcccacctcagcctccccag

SEQ ID NO: 41655 - DNA, 20 bp, Artificial Sequence
  Description of Artificial Sequence: Synthetic oligonucleotide
  Target: ATXN1; (-) strand; PAM type: NRG; PAM sequence: CAG
tcctcccacctcagcctccc

SEQ ID NO: 41656 - DNA, 20 bp, Artificial Sequence
  Description of Artificial Sequence: Synthetic oligonucleotide
  Target: ATXN1; (-) strand; PAM type: NRG; PAM sequence: CAG
ctcaattgatcctcccacct

SEQ ID NO: 41657 - DNA, 20 bp, Artificial Sequence
  Description of Artificial Sequence: Synthetic oligonucleotide
  Target: ATXN1; (-) strand; PAM type: NRG; PAM sequence: TGG
tcactgcagcctcaacctcc

SEQ ID NO: 41658 - DNA, 20 bp, Artificial Sequence
  Description of Artificial Sequence: Synthetic oligonucleotide
  Target: ATXN1; (-) strand; PAM type: NRG; PAM sequence: CAG
atgggatcattggctcactg

SEQ ID NO: 41659 - DNA, 20 bp, Artificial Sequence
  Description of Artificial Sequence: Synthetic oligonucleotide
  Target: ATXN1; (-) strand; PAM type: NRG; PAM sequence: TGG
aagtgcagtgatgggatcat

SEQ ID NO: 41660 - DNA, 20 bp, Artificial Sequence
  Description of Artificial Sequence: Synthetic oligonucleotide
  Target: ATXN1; (-) strand; PAM type: NRG; PAM sequence: GGG
ccaggctgaagtgcagtgat

SEQ ID NO: 41661 - DNA, 20 bp, Artificial Sequence
  Description of Artificial Sequence: Synthetic oligonucleotide
  Target: ATXN1; (-) strand; PAM type: NRG; PAM sequence: TGG
cccaggctgaagtgcagtga

SEQ ID NO: 41662 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctgaagtg

SEQ ID NO: 41663 - DNA, 20 bp, Artificial Sequence
  Description of Artificial Sequence: Synthetic oligonucleotide
  Target: ATXN1; (-) strand; PAM type: NRG; PAM sequence: AAG
ttgccctgtcacccaggctg

SEQ ID NO: 41664 - DNA, 20 bp, Artificial Sequence
  Description of Artificial Sequence: Synthetic oligonucleotide
  Target: ATXN1; (-) strand; PAM type: NRG; PAM sequence: AGG
agggtcttgccctgtcaccc

SEQ ID NO: 41665 - DNA, 20 bp, Artificial Sequence
  Description of Artificial Sequence: Synthetic oligonucleotide
  Target: ATXN1; (-) strand; PAM type: NRG; PAM sequence: CAG
cagggtcttgccctgtcacc

SEQ ID NO: 41666 - DNA, 20 bp, Artificial Sequence
  Description of Artificial Sequence: Synthetic oligonucleotide
  Target: ATXN1; (-) strand; PAM type: NRG; PAM sequence: GGG
tgtttgcttgttttgagaca

SEQ ID NO: 41667 - DNA, 20 bp, Artificial Sequence
  Description of Artificial Sequence: Synthetic oligonucleotide
  Target: ATXN1; (-) strand; PAM type: NRG; PAM sequence: AGG
ttgtttgcttgttttgagac

SEQ ID NO: 41668 - DNA, 20 bp, Artificial Sequence
  Description of Artificial Sequence: Synthetic oligonucleotide
  Target: ATXN1; (-) strand; PAM type: NRG; PAM sequence: CAG
tttgtttgcttgttttgaga

SEQ ID NO: 41669 - DNA, 20 bp, Artificial Sequence
  Description of Artificial Sequence: Synthetic oligonucleotide
  Target: ATXN1; (-) strand; PAM type: NRG; PAM sequence: GAG
ttcgtttgtttgcttgtttt

SEQ ID NO: 41670 - DNA, 20 bp, Artificial Sequence
  Description of Artificial Sequence: Synthetic oligonucleotide
  Target: ATXN1; (-) strand; PAM type: NRG; PAM sequence: GGG
aatgagttttgtttttctgt

SEQ ID NO: 41671 - DNA, 20 bp, Artificial Sequence
  Description of Artificial Sequence: Synthetic oligonucleotide
  Target: ATXN1; (-) strand; PAM type: NRG; PAM sequence: TGG
aaatgagttttgtttttctg

SEQ ID NO: 41672 - DNA, 20 bp, Artificial Sequence
  Description of Artificial Sequence: Synthetic oligonucleotide
  Target: ATXN1; (-) strand; PAM type: NRG; PAM sequence: GAG
cctctctaaaccaggcaaat

SEQ ID NO: 41673 - DNA, 20 bp, Artificial Sequence
  Description of Artificial Sequence: Synthetic oligonucleotide
  Target: ATXN1; (-) strand; PAM type: NRG; PAM sequence: AGG
agcactctcctctctaaacc

SEQ ID NO: 41674 - DNA, 20 bp, Artificial Sequence
  Description of Artificial Sequence: Synthetic oligonucleotide
  Target: ATXN1; (-) strand; PAM type: NRG; PAM sequence: CAG
cagcactctcctctctaaac

SEQ ID NO: 41675 - DNA, 20 bp, Artificial Sequence
  Description of Artificial Sequence: Synthetic oligonucleotide
  Target: ATXN1; (-) strand; PAM type: NRG; PAM sequence: CAG
tacttcacctctctgagctg

SEQ ID NO: 41676 - DNA, 20 bp, Artificial Sequence
  Description of Artificial Sequence: Synthetic oligonucleotide
  Target: ATXN1; (-) strand; PAM type: NRG; PAM sequence: GAG
acaagttacttcacctctct

SEQ ID NO: 41677 - DNA, 20 bp, Artificial Sequence
  Description of Artificial Sequence: Synthetic oligonucleotide
  Target: ATXN1; (-) strand; PAM type: NRG; PAM sequence: AAG
atttgggtctctggcaggac

SEQ ID NO: 41678 - DNA, 20 bp, Artificial Sequence
  Description of Artificial Sequence: Synthetic oligonucleotide
  Target: ATXN1; (-) strand; PAM type: NRG; PAM sequence: AGG
tgcggatttgggtctctggc

SEQ ID NO: 41679 - DNA, 20 bp, Artificial Sequence
  Description of Artificial Sequence: Synthetic oligonucleotide
  Target: ATXN1; (-) strand; PAM type: NRG; PAM sequence: CAG
gtgcggatttgggtctctgg

SEQ ID NO: 41680 - DNA, 20 bp, Artificial Sequence
  Description of Artificial Sequence: Synthetic oligonucleotide
  Target: ATXN1; (-) strand; PAM type: NRG; PAM sequence: TGG
ggggtgcggatttgggtctc

SEQ ID NO: 41681 - DNA, 20 bp, Artificial Sequence
  Description of Artificial Sequence: Synthetic oligonucleotide
  Target: ATXN1; (-) strand; PAM type: NRG; PAM sequence: GGG
agacccaggggtgcggattt

SEQ ID NO: 41682 - DNA, 20 bp, Artificial Sequence
  Description of Artificial Sequence: Synthetic oligonucleotide
  Target: ATXN1; (-) strand; PAM type: NRG; PAM sequence: TGG
cagacccaggggtgcggatt

SEQ ID NO: 41683 - DNA, 20 bp, Artificial Sequence
  Description of Artificial Sequence: Synthetic oligonucleotide
  Target: ATXN1; (-) strand; PAM type: NRG; PAM sequence: CGG
tggtgacagacccaggggtg

SEQ ID NO: 41684 - DNA, 20 bp, Artificial Sequence
  Description of Artificial Sequence: Synthetic oligonucleotide
  Target: ATXN1; (-) strand; PAM type: NRG; PAM sequence: GGG
tatggtggtgacagacccag

SEQ ID NO: 41685 - DNA, 20 bp, Artificial Sequence
  Description of Artificial Sequence: Synthetic oligonucleotide
  Target: ATXN1; (-) strand; PAM type: NRG; PAM sequence: GGG
gtatggtggtgacagaccca

SEQ ID NO: 41686 - DNA, 20 bp, Artificial Sequence
  Description of Artificial Sequence: Synthetic oligonucleotide
  Target: ATXN1; (-) strand; PAM type: NRG; PAM sequence: AGG
agtatggtggtgacagaccc

SEQ ID NO: 41687 - DNA, 20 bp, Artificial Sequence
  Description of Artificial Sequence: Synthetic oligonucleotide
  Target: ATXN1; (-) strand; PAM type: NRG; PAM sequence: CAG
tagtatggtggtgacagacc

SEQ ID NO: 41688 - DNA, 20 bp, Artificial Sequence
  Description of Artificial Sequence: Synthetic oligonucleotide
  Target: ATXN1; (-) strand; PAM type: NRG; PAM sequence: CAG
gtgatatagtatggtggtga

SEQ ID NO: 41689 - DNA, 20 bp, Artificial Sequence
  Description of Artificial Sequence: Synthetic oligonucleotide
  Target: ATXN1; (-) strand; PAM type: NRG; PAM sequence: TGG
agcagtgtgatatagtatgg

SEQ ID NO: 41690 - DNA, 20 bp, Artificial Sequence
  Description of Artificial Sequence: Synthetic oligonucleotide
  Target: ATXN1; (-) strand; PAM type: NRG; PAM sequence: TGG
gaaagcagtgtgatatagta

SEQ ID NO: 41691 - DNA, 20 bp, Artificial Sequence
  Description of Artificial Sequence: Synthetic oligonucleotide
  Target: ATXN1; (-) strand; PAM type: NRG; PAM sequence: TAG
ccagggaaagcagtgtgata

SEQ ID NO: 41692 - DNA, 20 bp, Artificial Sequence
  Description of Artificial Sequence: Synthetic oligonucleotide
  Target: ATXN1; (-) strand; PAM type: NRG; PAM sequence: CAG
catcacacccccagggaaag

SEQ ID NO: 41693 - DNA, 20 bp, Artificial Sequence
  Description of Artificial Sequence: Synthetic oligonucleotide
  Target: ATXN1; (-) strand; PAM type: NRG; PAM sequence: AAG
caacatcacacccccaggga

SEQ ID NO: 41694 - DNA, 20 bp, Artificial Sequence
  Description of Artificial Sequence: Synthetic oligonucleotide
  Target: ATXN1; (-) strand; PAM type: NRG; PAM sequence: GGG
cccccaacatcacaccccca

SEQ ID NO: 41695 - DNA, 20 bp, Artificial Sequence
  Description of Artificial Sequence: Synthetic oligonucleotide
  Target: ATXN1; (-) strand; PAM type: NRG; PAM sequence: AGG
ccccccaacatcacaccccc

SEQ ID NO: 41696 - DNA, 20 bp, Artificial Sequence
  Description of Artificial Sequence: Synthetic oligonucleotide
  Target: ATXN1; (-) strand; PAM type: NRG; PAM sequence: CAG
cccccccaacatcacacccc

SEQ ID NO: 41697 - DNA, 20 bp, Artificial Sequence
  Description of Artificial Sequence: Synthetic oligonucleotide
  Target: ATXN1; (-) strand; PAM type: NRG; PAM sequence: AAG
ttgaggatgcctgaactcat

SEQ ID NO: 41698 - DNA, 20 bp, Artificial Sequence
  Description of Artificial Sequence: Synthetic oligonucleotide
  Target: ATXN1; (-) strand; PAM type: NRG; PAM sequence: AGG
cctgcatgaacagactcttg

SEQ ID NO: 41699 - DNA, 20 bp, Artificial Sequence
  Description of Artificial Sequence: Synthetic oligonucleotide
  Target: ATXN1; (-) strand; PAM type: NRG; PAM sequence: GAG
tcctgcatgaacagactctt

SEQ ID NO: 41700 - DNA, 20 bp, Artificial Sequence
  Description of Artificial Sequence: Synthetic oligonucleotide
  Target: ATXN1; (-) strand; PAM type: NRG; PAM sequence: CAG
aggcagaaatcctgcatgaa

SEQ ID NO: 41701 - DNA, 20 bp, Artificial Sequence
  Description of Artificial Sequence: Synthetic oligonucleotide
  Target: ATXN1; (-) strand; PAM type: NRG; PAM sequence: CAG
gatggcattgtgactctagg

SEQ ID NO: 41702 - DNA, 20 bp, Artificial Sequence
  Description of Artificial Sequence: Synthetic oligonucleotide
  Target: ATXN1; (-) strand; PAM type: NRG; PAM sequence: AGG
acagatggcattgtgactct

SEQ ID NO: 41703 - DNA, 20 bp, Artificial Sequence
  Description of Artificial Sequence: Synthetic oligonucleotide
  Target: ATXN1; (-) strand; PAM type: NRG; PAM sequence: TAG
aacagatggcattgtgactc

SEQ ID NO: 41704 - DNA, 20 bp, Artificial Sequence
  Description of Artificial Sequence: Synthetic oligonucleotide
  Target: ATXN1; (-) strand; PAM type: NRG; PAM sequence: TGG
atggttttctccaaaacaga

SEQ ID NO: 41705 - DNA, 20 bp, Artificial Sequence
  Description of Artificial Sequence: Synthetic oligonucleotide
  Target: ATXN1; (-) strand; PAM type: NRG; PAM sequence: CAG
agagatggttttctccaaaa

SEQ ID NO: 41706 - DNA, 20 bp, Artificial Sequence
  Description of Artificial Sequence: Synthetic oligonucleotide
  Target: ATXN1; (-) strand; PAM type: NRG; PAM sequence: TGG
ggaagttgtggaagaagaga

SEQ ID NO: 41707 - DNA, 20 bp, Artificial Sequence
  Description of Artificial Sequence: Synthetic oligonucleotide
  Target: ATXN1; (-) strand; PAM type: NRG; PAM sequence: GAG
ttggggaagttgtggaagaa

SEQ ID NO: 41708 - DNA, 20 bp, Artificial Sequence
  Description of Artificial Sequence: Synthetic oligonucleotide
  Target: ATXN1; (-) strand; PAM type: NRG; PAM sequence: AAG
gattggggaagttgtggaag

SEQ ID NO: 41709 - DNA, 20 bp, Artificial Sequence
  Description of Artificial Sequence: Synthetic oligonucleotide
  Target: ATXN1; (-) strand; PAM type: NRG; PAM sequence: AAG
tttgattggggaagttgtgg

SEQ ID NO: 41710 - DNA, 20 bp, Artificial Sequence
  Description of Artificial Sequence: Synthetic oligonucleotide
  Target: ATXN1; (-) strand; PAM type: NRG; PAM sequence: TGG
aaatttgattggggaagttg

SEQ ID NO: 41711 - DNA, 20 bp, Artificial Sequence
  Description of Artificial Sequence: Synthetic oligonucleotide
  Target: ATXN1; (-) strand; PAM type: NRG; PAM sequence: AAG
aatcacaaatttgattgggg

SEQ ID NO: 41712 - DNA, 20 bp, Artificial Sequence
  Description of Artificial Sequence: Synthetic oligonucleotide
  Target: ATXN1; (-) strand; PAM type: NRG; PAM sequence: GGG
caaaatcacaaatttgattg

SEQ ID NO: 41713 - DNA, 20 bp, Artificial Sequence
  Description of Artificial Sequence: Synthetic oligonucleotide
  Target: ATXN1; (-) strand; PAM type: NRG; PAM sequence: GGG
gcaaaatcacaaatttgatt

SEQ ID NO: 41714 - DNA, 20 bp, Artificial Sequence
  Description of Artificial Sequence: Synthetic oligonucleotide
  Target: ATXN1; (-) strand; PAM type: NRG; PAM sequence: TGG
agcaaaatcacaaatttgat

SEQ ID NO: 41715 - DNA, 20 bp, Artificial Sequence
  Description of Artificial Sequence: Synthetic oligonucleotide
  Target: ATXN1; (-) strand; PAM type: NRG; PAM sequence: AAG
tgcaaattgttgagcttaat

SEQ ID NO: 41716 - DNA, 20 bp, Artificial Sequence
  Description of Artificial Sequence: Synthetic oligonucleotide
  Target: ATXN1; (-) strand; PAM type: NRG; PAM sequence: GAG
tcagaaatgtgcaaattgtt

SEQ ID NO: 41717 - DNA, 20 bp, Artificial Sequence
  Description of Artificial Sequence: Synthetic oligonucleotide
  Target: ATXN1; (-) strand; PAM type: NRG; PAM sequence: CAG
actgcacccacagagaaatt

SEQ ID NO: 41718 - DNA, 20 bp, Artificial Sequence
  Description of Artificial Sequence: Synthetic oligonucleotide
  Target: ATXN1; (-) strand; PAM type: NRG; PAM sequence: GAG
ctgctgacactgcacccaca

SEQ ID NO: 41719 - DNA, 20 bp, Artificial Sequence
  Description of Artificial Sequence: Synthetic oligonucleotide
  Target: ATXN1; (-) strand; PAM type: NRG; PAM sequence: CAG
cactgctgacactgcaccca

SEQ ID NO: 41720 - DNA, 20 bp, Artificial Sequence
  Description of Artificial Sequence: Synthetic oligonucleotide
  Target: ATXN1; (-) strand; PAM type: NRG; PAM sequence: AGG
cctggtcttctcaactggtt

SEQ ID NO: 41721 - DNA, 20 bp, Artificial Sequence
  Description of Artificial Sequence: Synthetic oligonucleotide
  Target: ATXN1; (-) strand; PAM type: NRG; PAM sequence: TAG
tcctggtcttctcaactggt

SEQ ID NO: 41722 - DNA, 20 bp, Artificial Sequence
  Description of Artificial Sequence: Synthetic oligonucleotide
  Target: ATXN1; (-) strand; PAM type: NRG; PAM sequence: TGG
atcttcctggtcttctcaac

SEQ ID NO: 41723 - DNA, 20 bp, Artificial Sequence
  Description of Artificial Sequence: Synthetic oligonucleotide
  Target: ATXN1; (-) strand; PAM type: NRG; PAM sequence: TGG
cctagcctgaagaatcttcc

SEQ ID NO: 41724 - DNA, 20 bp, Artificial Sequence
  Description of Artificial Sequence: Synthetic oligonucleotide
  Target: ATXN1; (-) strand; PAM type: NRG; PAM sequence: AAG
gggttttctcccctagcctg

SEQ ID NO: 41725 - DNA, 20 bp, Artificial Sequence
  Description of Artificial Sequence: Synthetic oligonucleotide
  Target: ATXN1; (-) strand; PAM type: NRG; PAM sequence: TAG
tcctgaggggttttctcccc

SEQ ID NO: 41726 - DNA, 20 bp, Artificial Sequence
  Description of Artificial Sequence: Synthetic oligonucleotide
  Target: ATXN1; (-) strand; PAM type: NRG; PAM sequence: GGG
ctctgcagtgccttcctgag

SEQ ID NO: 41727 - DNA, 20 bp, Artificial Sequence
  Description of Artificial Sequence: Synthetic oligonucleotide
  Target: ATXN1; (-) strand; PAM type: NRG; PAM sequence: GGG
cctctgcagtgccttcctga

SEQ ID NO: 41728 - DNA, 20 bp, Artificial Sequence
  Description of Artificial Sequence: Synthetic oligonucleotide
  Target: ATXN1; (-) strand; PAM type: NRG; PAM sequence: AGG
ccctctgcagtgccttcctg

SEQ ID NO: 41729 - DNA, 20 bp, Artificial Sequence
  Description of Artificial Sequence: Synthetic oligonucleotide
  Target: ATXN1; (-) strand; PAM type: NRG; PAM sequence: GAG
cccctctgcagtgccttcct

SEQ ID NO: 41730 - DNA, 20 bp, Artificial Sequence
  Description of Artificial Sequence: Synthetic oligonucleotide
  Target: ATXN1; (-) strand; PAM type: NRG; PAM sequence: CAG
ctacatccttctcccctctg

SEQ ID NO: 41731 - DNA, 20 bp, Artificial Sequence
  Description of Artificial Sequence: Synthetic oligonucleotide
  Target: ATXN1; (-) strand; PAM type: NRG; PAM sequence: AGG
ggacttaattgaggttccaa

SEQ ID NO: 41732 - DNA, 20 bp, Artificial Sequence
  Description of Artificial Sequence: Synthetic oligonucleotide
  Target: ATXN1; (-) strand; PAM type: NRG; PAM sequence: AAG
tggacttaattgaggttcca

SEQ ID NO: 41733 - DNA, 20 bp, Artificial Sequence
  Description of Artificial Sequence: Synthetic oligonucleotide
  Target: ATXN1; (-) strand; PAM type: NRG; PAM sequence: AGG
ctcatatctggacttaattg

SEQ ID NO: 41734 - DNA, 20 bp, Artificial Sequence
  Description of Artificial Sequence: Synthetic oligonucleotide
  Target: ATXN1; (-) strand; PAM type: NRG; PAM sequence: GAG
actcatatctggacttaatt

SEQ ID NO: 41735 - DNA, 20 bp, Artificial Sequence
  Description of Artificial Sequence: Synthetic oligonucleotide
  Target: ATXN1; (-) strand; PAM type: NRG; PAM sequence: TGG
ggagagagagaactcatatc

SEQ ID NO: 41736 - DNA, 20 bp, Artificial Sequence
  Description of Artificial Sequence: Synthetic oligonucleotide
  Target: ATXN1; (-) strand; PAM type: NRG; PAM sequence: GAG
ggggagatgggagggagaga

SEQ ID NO: 41737 - DNA, 20 bp, Artificial Sequence
  Description of Artificial Sequence: Synthetic oligonucleotide
  Target: ATXN1; (-) strand; PAM type: NRG; PAM sequence: GAG
agggggagatgggagggaga

SEQ ID NO: 41738 - DNA, 20 bp, Artificial Sequence
  Description of Artificial Sequence: Synthetic oligonucleotide
  Target: ATXN1; (-) strand; PAM type: NRG; PAM sequence: GAG
agagggggagatgggaggga

SEQ ID NO: 41739 - DNA, 20 bp, Artificial Sequence
  Description of Artificial Sequence: Synthetic oligonucleotide
  Target: ATXN1; (-) strand; PAM type: NRG; PAM sequence: GAG
tgagagggggagatgggagg

SEQ ID NO: 41740 - DNA, 20 bp, Artificial Sequence
  Description of Artificial Sequence: Synthetic oligonucleotide
  Target: ATXN1; (-) strand; PAM type: NRG; PAM sequence: GGG
catgagagggggagatggga

SEQ ID NO: 41741 - DNA, 20 bp, Artificial Sequence
  Description of Artificial Sequence: Synthetic oligonucleotide
  Target: ATXN1; (-) strand; PAM type: NRG; PAM sequence: AGG
gcatgagagggggagatggg

SEQ ID NO: 41742 - DNA, 20 bp, Artificial Sequence
  Description of Artificial Sequence: Synthetic oligonucleotide
  Target: ATXN1; (-) strand; PAM type: NRG; PAM sequence: GAG
agcatgagagggggagatgg

SEQ ID NO: 41743 - DNA, 20 bp, Artificial Sequence
  Description of Artificial Sequence: Synthetic oligonucleotide
  Target: ATXN1; (-) strand; PAM type: NRG; PAM sequence: GGG
agagcatgagagggggagat

SEQ ID NO: 41744 - DNA, 20 bp, Artificial Sequence
  Description of Artificial Sequence: Synthetic oligonucleotide
  Target: ATXN1; (-) strand; PAM type: NRG; PAM sequence: TGG
gagagcatgagagggggaga

SEQ ID NO: 41745 - DNA, 20 bp, Artificial Sequence
  Description of Artificial Sequence: Synthetic oligonucleotide
  Target: ATXN1; (-) strand; PAM type: NRG; PAM sequence: GAG
gacagagagcatgagagggg

SEQ ID NO: 41746 - DNA, 20 bp, Artificial Sequence
  Description of Artificial Sequence: Synthetic oligonucleotide
  Target: ATXN1; (-) strand; PAM type: NRG; PAM sequence: GGG
cagacagagagcatgagagg

SEQ ID NO: 41747 - DNA, 20 bp, Artificial Sequence
  Description of Artificial Sequence: Synthetic oligonucleotide
  Target: ATXN1; (-) strand; PAM type: NRG; PAM sequence: GGG
tcagacagagagcatgagag

SEQ ID NO: 41748 - DNA, 20 bp, Artificial Sequence
  Description of Artificial Sequence: Synthetic oligonucleotide
  Target: ATXN1; (-) strand; PAM type: NRG; PAM sequence: GGG
ctcagacagagagcatgaga

SEQ ID NO: 41749 - DNA, 20 bp, Artificial Sequence
  Description of Artificial Sequence: Synthetic oligonucleotide
  Target: ATXN1; (-) strand; PAM type: NRG; PAM sequence: AGG
actcagacagagagcatgag

SEQ ID NO: 41750 - DNA, 20 bp, Artificial Sequence
  Description of Artificial Sequence: Synthetic oligonucleotide
  Target: ATXN1; (-) strand; PAM type: NRG; PAM sequence: GAG
gactcagacagagagcatga

SEQ ID NO: 41751 - DNA, 20 bp, Artificial Sequence
  Description of Artificial Sequence: Synthetic oligonucleotide
  Target: ATXN1; (-) strand; PAM type: NRG; PAM sequence: GAG
gagactcagacagagagcat

SEQ ID NO: 41752 - DNA, 20 bp, Artificial Sequence
  Description of Artificial Sequence: Synthetic oligonucleotide
  Target: ATXN1; (-) strand; PAM type: NRG; PAM sequence: GAG
tcagtggagactcagacaga

SEQ ID NO: 41753 - DNA, 20 bp, Artificial Sequence
  Description of Artificial Sequence: Synthetic oligonucleotide
  Target: ATXN1; (-) strand; PAM type: NRG; PAM sequence: GAG
agtcagtggagactcagaca

SEQ ID NO: 41754 - DNA, 20 bp, Artificial Sequence
  Description of Artificial Sequence: Synthetic oligonucleotide
  Target: ATXN1; (-) strand; PAM type: NRG; PAM sequence: CAG
agagtcagtggagactcaga

SEQ ID NO: 41755 - DNA, 20 bp, Artificial Sequence
  Description of Artificial Sequence: Synthetic oligonucleotide
  Target: ATXN1; (-) strand; PAM type: NRG; PAM sequence: CAG
gttcagagtcagtggagact

SEQ ID NO: 41756 - DNA, 20 bp, Artificial Sequence
  Description of Artificial Sequence: Synthetic oligonucleotide
  Target: ATXN1; (-) strand; PAM type: NRG; PAM sequence: GAG
tgacaggttcagagtcagtg

SEQ ID NO: 41757 - DNA, 20 bp, Artificial Sequence
  Description of Artificial Sequence: Synthetic oligonucleotide
  Target: ATXN1; (-) strand; PAM type: NRG; PAM sequence: TGG
agtgacaggttcagagtcag

SEQ ID NO: 41758 - DNA, 20 bp, Artificial Sequence
  Description of Artificial Sequence: Synthetic oligonucleotide
  Target: ATXN1; (-) strand; PAM type: NRG; PAM sequence: CAG
acaagtgacaggttcagagt

SEQ ID NO: 41759 - DNA, 20 bp, Artificial Sequence
  Description of Artificial Sequence: Synthetic oligonucleotide
  Target: ATXN1; (-) strand; PAM type: NRG; PAM sequence: GAG
tgccacaagtgacaggttca

SEQ ID NO: 41760 - DNA, 20 bp, Artificial Sequence
  Description of Artificial Sequence: Synthetic oligonucleotide
  Target: ATXN1; (-) strand; PAM type: NRG; PAM sequence: CAG
tttgccacaagtgacaggtt

SEQ ID NO: 41761 - DNA, 20 bp, Artificial Sequence
  Description of Artificial Sequence: Synthetic oligonucleotide
  Target: ATXN1; (-) strand; PAM type: NRG; PAM sequence: AGG
ctgtgtttgccacaagtgac

SEQ ID NO: 41762 - DNA, 20 bp, Artificial Sequence
  Description of Artificial Sequence: Synthetic oligonucleotide
  Target: ATXN1; (-) strand; PAM type: NRG; PAM sequence: CAG
gctgtgtttgccacaagtga

SEQ ID NO: 41763 - DNA, 20 bp, Artificial Sequence
  Description of Artificial Sequence: Synthetic oligonucleotide
  Target: ATXN1; (-) strand; PAM type: NRG; PAM sequence: AAG
ccaccagctgtgtttgccac

SEQ ID NO: 41764 - DNA, 20 bp, Artificial Sequence
  Description of Artificial Sequence: Synthetic oligonucleotide
  Target: ATXN1; (-) strand; PAM type: NRG; PAM sequence: CAG
tcacagctaaaatactccac

SEQ ID NO: 41765 - DNA, 20 bp, Artificial Sequence
  Description of Artificial Sequence: Synthetic oligonucleotide
  Target: ATXN1; (-) strand; PAM type: NRG; PAM sequence: CAG
gaaatcggctgacatcatca

SEQ ID NO: 41766 - DNA, 20 bp, Artificial Sequence
  Description of Artificial Sequence: Synthetic oligonucleotide
  Target: ATXN1; (-) strand; PAM type: NRG; PAM sequence: CGG
ccgaggagcctatcagaaat

SEQ ID NO: 41767 - DNA, 20 bp, Artificial Sequence
  Description of Artificial Sequence: Synthetic oligonucleotide
  Target: ATXN1; (-) strand; PAM type: NRG; PAM sequence: CAG
cactttaccgaggagcctat

SEQ ID NO: 41768 - DNA, 20 bp, Artificial Sequence
  Description of Artificial Sequence: Synthetic oligonucleotide
  Target: ATXN1; (-) strand; PAM type: NRG; PAM sequence: GAG
tgatttgtcactttaccgag

SEQ ID NO: 41769 - DNA, 20 bp, Artificial Sequence
  Description of Artificial Sequence: Synthetic oligonucleotide
  Target: ATXN1; (-) strand; PAM type: NRG; PAM sequence: AGG
aatgatttgtcactttaccg

SEQ ID NO: 41770 - DNA, 20 bp, Artificial Sequence
  Description of Artificial Sequence: Synthetic oligonucleotide
  Target: ATXN1; (-) strand; PAM type: NRG; PAM sequence: GAG
caatgatttgtcactttacc

SEQ ID NO: 41771 - DNA, 20 bp, Artificial Sequence
  Description of Artificial Sequence: Synthetic oligonucleotide
  Target: ATXN1; (-) strand; PAM type: NRG; PAM sequence: AGG
gctgtagaaacaaaagtgca

SEQ ID NO: 41772 - DNA, 20 bp, Artificial Sequence
  Description of Artificial Sequence: Synthetic oligonucleotide
  Target: ATXN1; (-) strand; PAM type: NRG; PAM sequence: AAG
cgctgtagaaacaaaagtgc

SEQ ID NO: 41773 - DNA, 20 bp, Artificial Sequence
  Description of Artificial Sequence: Synthetic oligonucleotide
  Target: ATXN1; (-) strand; PAM type: NRG; PAM sequence: AAG
gcttcacgctgtagaaacaa

SEQ ID NO: 41774 - DNA, 20 bp, Artificial Sequence
  Description of Artificial Sequence: Synthetic oligonucleotide
  Target: ATXN1; (-) strand; PAM type: NRG; PAM sequence: TAG
gcagctagggcttcacgctg

SEQ ID NO: 41775 - DNA, 20 bp, Artificial Sequence
  Description of Artificial Sequence: Synthetic oligonucleotide
  Target: ATXN1; (-) strand; PAM type: NRG; PAM sequence: GGG
acctgctgaaaaggcagcta

SEQ ID NO: 41776 - DNA, 20 bp, Artificial Sequence
  Description of Artificial Sequence: Synthetic oligonucleotide
  Target: ATXN1; (-) strand; PAM type: NRG; PAM sequence: AGG
gacctgctgaaaaggcagct

SEQ ID NO: 41777 - DNA, 20 bp, Artificial Sequence
  Description of Artificial Sequence: Synthetic oligonucleotide
  Target: ATXN1; (-) strand; PAM type: NRG; PAM sequence: TAG
agacctgctgaaaaggcagc

SEQ ID NO: 41778 - DNA, 20 bp, Artificial Sequence
  Description of Artificial Sequence: Synthetic oligonucleotide
  Target: ATXN1; (-) strand; PAM type: NRG; PAM sequence: CAG
gctgagacctgctgaaaagg

SEQ ID NO: 41779 - DNA, 20 bp, Artificial Sequence
  Description of Artificial Sequence: Synthetic oligonucleotide
  Target: ATXN1; (-) strand; PAM type: NRG; PAM sequence: AGG
tgtgctgagacctgctgaaa

SEQ ID NO: 41780 - DNA, 20 bp, Artificial Sequence
  Description of Artificial Sequence: Synthetic oligonucleotide
  Target: ATXN1; (-) strand; PAM type: NRG; PAM sequence: AAG
gtgtgctgagacctgctgaa

SEQ ID NO: 41781 - DNA, 20 bp, Artificial Sequence
  Description of Artificial Sequence: Synthetic oligonucleotide
  Target: ATXN1; (-) strand; PAM type: NRG; PAM sequence: GAG
caaagaaaggcaagtgtgct

SEQ ID NO: 41782 - DNA, 20 bp, Artificial Sequence
  Description of Artificial Sequence: Synthetic oligonucleotide
  Target: ATXN1; (-) strand; PAM type: NRG; PAM sequence: AAG
gggcttcctcaaagaaaggc

SEQ ID NO: 41783 - DNA, 20 bp, Artificial Sequence
  Description of Artificial Sequence: Synthetic oligonucleotide
  Target: ATXN1; (-) strand; PAM type: NRG; PAM sequence: AGG
ggaagggcttcctcaaagaa

SEQ ID NO: 41784 - DNA, 20 bp, Artificial Sequence
  Description of Artificial Sequence: Synthetic oligonucleotide
  Target: ATXN1; (-) strand; PAM type: NRG; PAM sequence: AAG
gggaagggcttcctcaaaga

SEQ ID NO: 41785 - DNA, 20 bp, Artificial Sequence
  Description of Artificial Sequence: Synthetic oligonucleotide
  Target: ATXN1; (-) strand; PAM type: NRG; PAM sequence: AAG
tgccgggaagggcttcctca

SEQ ID NO: 41786 - DNA, 20 bp, Artificial Sequence
  Description of Artificial Sequence: Synthetic oligonucleotide
  Target: ATXN1; (-) strand; PAM type: NRG; PAM sequence: GGG
gctatgctgcatgccgggaa

SEQ ID NO: 41787 - DNA, 20 bp, Artificial Sequence
  Description of Artificial Sequence: Synthetic oligonucleotide
  Target: ATXN1; (-) strand; PAM type: NRG; PAM sequence: AGG
ggctatgctgcatgccggga

SEQ ID NO: 41788 - DNA, 20 bp, Artificial Sequence
  Description of Artificial Sequence: Synthetic oligonucleotide
  Target: ATXN1; (-) strand; PAM type: NRG; PAM sequence: AAG
tggctatgctgcatgccggg

SEQ ID NO: 41789 - DNA, 20 bp, Artificial Sequence
  Description of Artificial Sequence: Synthetic oligonucleotide
  Target: ATXN1; (-) strand; PAM type: NRG; PAM sequence: GGG
gcgtggctatgctgcatgcc

SEQ ID NO: 41790 - DNA, 20 bp, Artificial Sequence
  Description of Artificial Sequence: Synthetic oligonucleotide
  Target: ATXN1; (-) strand; PAM type: NRG; PAM sequence: CGG
cgcgtggctatgctgcatgc

SEQ ID NO: 41791 - DNA, 20 bp, Artificial Sequence
  Description of Artificial Sequence: Synthetic oligonucleotide
  Target: ATXN1; (-) strand; PAM type: NRG; PAM sequence: TGG
ctgtgaggttggcccccgcg

SEQ ID NO: 41792 - DNA, 20 bp, Artificial Sequence
  Description of Artificial Sequence: Synthetic oligonucleotide
  Target: ATXN1; (-) strand; PAM type: NRG; PAM sequence: TGG
tgttggcaggtctgtgaggt

SEQ ID NO: 41793 - DNA, 20 bp, Artificial Sequence
  Description of Artificial Sequence: Synthetic oligonucleotide
  Target: ATXN1; (-) strand; PAM type: NRG; PAM sequence: AGG
ggcctgttggcaggtctgtg

SEQ ID NO: 41794 - DNA, 20 bp, Artificial Sequence
  Description of Artificial Sequence: Synthetic oligonucleotide
  Target: ATXN1; (-) strand; PAM type: NRG; PAM sequence: GAG
gggcctgttggcaggtctgt

SEQ ID NO: 41795 - DNA, 20 bp, Artificial Sequence
  Description of Artificial Sequence: Synthetic oligonucleotide
  Target: ATXN1; (-) strand; PAM type: NRG; PAM sequence: AGG
tgttgtcagggcctgttggc

SEQ ID NO: 41796 - DNA, 20 bp, Artificial Sequence
  Description of Artificial Sequence: Synthetic oligonucleotide
  Target: ATXN1; (-) strand; PAM type: NRG; PAM sequence: CAG
gtgttgtcagggcctgttgg

SEQ ID NO: 41797 - DNA, 20 bp, Artificial Sequence
  Description of Artificial Sequence: Synthetic oligonucleotide
  Target: ATXN1; (-) strand; PAM type: NRG; PAM sequence: TGG
gaagtgttgtcagggcctgt

SEQ ID NO: 41798 - DNA, 20 bp, Artificial Sequence
  Description of Artificial Sequence: Synthetic oligonucleotide
  Target: ATXN1; (-) strand; PAM type: NRG; PAM sequence: GGG
agcaggtagaagtgttgtca

SEQ ID NO: 41799 - DNA, 20 bp, Artificial Sequence
  Description of Artificial Sequence: Synthetic oligonucleotide
  Target: ATXN1; (-) strand; PAM type: NRG; PAM sequence: AGG
gagcaggtagaagtgttgtc

SEQ ID NO: 41800 - DNA, 20 bp, Artificial Sequence
  Description of Artificial Sequence: Synthetic oligonucleotide
  Target: ATXN1; (-) strand; PAM type: NRG; PAM sequence: CAG
cgagcaggtagaagtgttgt

SEQ ID NO: 41801 - DNA, 20 bp, Artificial Sequence
  Description of Artificial Sequence: Synthetic oligonucleotide
  Target: ATXN1; (-) strand; PAM type: NRG; PAM sequence: AAG
gggtgcagacgagcaggtag

SEQ ID NO: 41802 - DNA, 20 bp, Artificial Sequence
  Description of Artificial Sequence: Synthetic oligonucleotide
  Target: ATXN1; (-) strand; PAM type: NRG; PAM sequence: TAG
ccagggtgcagacgagcagg

SEQ ID NO: 41803 - DNA, 20 bp, Artificial Sequence
  Description of Artificial Sequence: Synthetic oligonucleotide
  Target: ATXN1; (-) strand; PAM type: NRG; PAM sequence: AGG
cagccagggtgcagacgagc

SEQ ID NO: 41804 - DNA, 20 bp, Artificial Sequence
  Description of Artificial Sequence: Synthetic oligonucleotide
  Target: ATXN1; (-) strand; PAM type: NRG; PAM sequence: CAG
acagccagggtgcagacgag

SEQ ID NO: 41805 - DNA, 20 bp, Artificial Sequence
  Description of Artificial Sequence: Synthetic oligonucleotide
  Target: ATXN1; (-) strand; PAM type: NRG; PAM sequence: GAG
ctgacagccagggtgcagac

SEQ ID NO: 41806 - DNA, 20 bp, Artificial Sequence
  Description of Artificial Sequence: Synthetic oligonucleotide
  Target: ATXN1; (-) strand; PAM type: NRG; PAM sequence: CAG
ctctactgacagccagggtg

SEQ ID NO: 41807 - DNA, 20 bp, Artificial Sequence
  Description of Artificial Sequence: Synthetic oligonucleotide
  Target: ATXN1; (-) strand; PAM type: NRG; PAM sequence: GGG
aatctctctactgacagcca

SEQ ID NO: 41808 - DNA, 20 bp, Artificial Sequence
  Description of Artificial Sequence: Synthetic oligonucleotide
  Target: ATXN1; (-) strand; PAM type: NRG; PAM sequence: AGG
aaatctctctactgacagcc

SEQ ID NO: 41809 - DNA, 20 bp, Artificial Sequence
  Description of Artificial Sequence: Synthetic oligonucleotide
  Target: ATXN1; (-) strand; PAM type: NRG; PAM sequence: CAG
taaatctctctactgacagc

SEQ ID NO: 41810 - DNA, 20 bp, Artificial Sequence
  Description of Artificial Sequence: Synthetic oligonucleotide
  Target: ATXN1; (-) strand; PAM type: NRG; PAM sequence: CAG
tcactaaatctctctactga

SEQ ID NO: 41811 - DNA, 20 bp, Artificial Sequence
  Description of Artificial Sequence: Synthetic oligonucleotide
  Target: ATXN1; (-) strand; PAM type: NRG; PAM sequence: GAG
ctcatgttttttcccatagt

SEQ ID NO: 41812 - DNA, 20 bp, Artificial Sequence
  Description of Artificial Sequence: Synthetic oligonucleotide
  Target: ATXN1; (-) strand; PAM type: NRG; PAM sequence: TAG
tgttctcatgttttttccca

SEQ ID NO: 41813 - DNA, 20 bp, Artificial Sequence
  Description of Artificial Sequence: Synthetic oligonucleotide
  Target: ATXN1; (-) strand; PAM type: NRG; PAM sequence: GAG
ttggcttccctgtgaagtca

SEQ ID NO: 41814 - DNA, 20 bp, Artificial Sequence
  Description of Artificial Sequence: Synthetic oligonucleotide
  Target: ATXN1; (-) strand; PAM type: NRG; PAM sequence: CAG
aattggcttccctgtgaagt

SEQ ID NO: 41815 - DNA, 20 bp, Artificial Sequence
  Description of Artificial Sequence: Synthetic oligonucleotide
  Target: ATXN1; (-) strand; PAM type: NRG; PAM sequence: AAG
gagaaattggcttccctgtg

SEQ ID NO: 41816 - DNA, 20 bp, Artificial Sequence
  Description of Artificial Sequence: Synthetic oligonucleotide
  Target: ATXN1; (-) strand; PAM type: NRG; PAM sequence: TGG
tgattaaatgaaagagaaat

SEQ ID NO: 41817 - DNA, 20 bp, Artificial Sequence
  Description of Artificial Sequence: Synthetic oligonucleotide
  Target: ATXN1; (-) strand; PAM type: NRG; PAM sequence: GAG
aaattaatgattaaatgaaa

SEQ ID NO: 41818 - DNA, 20 bp, Artificial Sequence
  Description of Artificial Sequence: Synthetic oligonucleotide
  Target: ATXN1; (-) strand; PAM type: NRG; PAM sequence: AAG
caaaattaatgattaaatga

SEQ ID NO: 41819 - DNA, 20 bp, Artificial Sequence
  Description of Artificial Sequence: Synthetic oligonucleotide
  Target: ATXN1; (-) strand; PAM type: NRG; PAM sequence: AGG
gttcttggggaggaagatct

SEQ ID NO: 41820 - DNA, 20 bp, Artificial Sequence
  Description of Artificial Sequence: Synthetic oligonucleotide
  Target: ATXN1; (-) strand; PAM type: NRG; PAM sequence: TAG
tgttcttggggaggaagatc

SEQ ID NO: 41821 - DNA, 20 bp, Artificial Sequence
  Description of Artificial Sequence: Synthetic oligonucleotide
  Target: ATXN1; (-) strand; PAM type: NRG; PAM sequence: AAG
ctcttctgttcttggggagg

SEQ ID NO: 41822 - DNA, 20 bp, Artificial Sequence
  Description of Artificial Sequence: Synthetic oligonucleotide
  Target: ATXN1; (-) strand; PAM type: NRG; PAM sequence: AGG
gccctcttctgttcttgggg

SEQ ID NO: 41823 - DNA, 20 bp, Artificial Sequence
  Description of Artificial Sequence: Synthetic oligonucleotide
  Target: ATXN1; (-) strand; PAM type: NRG; PAM sequence: GAG
agccctcttctgttcttggg

SEQ ID NO: 41824 - DNA, 20 bp, Artificial Sequence
  Description of Artificial Sequence: Synthetic oligonucleotide
  Target: ATXN1; (-) strand; PAM type: NRG; PAM sequence: GGG
acagccctcttctgttcttg

SEQ ID NO: 41825 - DNA, 20 bp, Artificial Sequence
  Description of Artificial Sequence: Synthetic oligonucleotide
  Target: ATXN1; (-) strand; PAM type: NRG; PAM sequence: GGG
tacagccctcttctgttctt

SEQ ID NO: 41826 - DNA, 20 bp, Artificial Sequence
  Description of Artificial Sequence: Synthetic oligonucleotide
  Target: ATXN1; (-) strand; PAM type: NRG; PAM sequence: TGG
ttacagccctcttctgttct

SEQ ID NO: 41827 - DNA, 20 bp, Artificial Sequence
  Description of Artificial Sequence: Synthetic oligonucleotide
  Target: ATXN1; (-) strand; PAM type: NRG; PAM sequence: CAG
ccactgcgcccagcccctta

SEQ ID NO: 41828 - DNA, 20 bp, Artificial Sequence
  Description of Artificial Sequence: Synthetic oligonucleotide
  Target: ATXN1; (-) strand; PAM type: NRG; PAM sequence: CAG
taggcgtgagccactgcgcc

SEQ ID NO: 41829 - DNA, 20 bp, Artificial Sequence
  Description of Artificial Sequence: Synthetic oligonucleotide
  Target: ATXN1; (-) strand; PAM type: NRG; PAM sequence: GAG
aaagctgggattgtaggcgt

SEQ ID NO: 41830 - DNA, 20 bp, Artificial Sequence
  Description of Artificial Sequence: Synthetic oligonucleotide
  Target: ATXN1; (-) strand; PAM type: NRG; PAM sequence: AGG
cctcctaaagctgggattgt

SEQ ID NO: 41831 - DNA, 20 bp, Artificial Sequence
  Description of Artificial Sequence: Synthetic oligonucleotide
  Target: ATXN1; (-) strand; PAM type: NRG; PAM sequence: TAG
gcctcctaaagctgggattg

SEQ ID NO: 41832 - DNA, 20 bp, Artificial Sequence
  Description of Artificial Sequence: Synthetic oligonucleotide
  Target: ATXN1; (-) strand; PAM type: NRG; PAM sequence: GGG
cgcctcagcctcctaaagct

SEQ ID NO: 41833 - DNA, 20 bp, Artificial Sequence
  Description of Artificial Sequence: Synthetic oligonucleotide
  Target: ATXN1; (-) strand; PAM type: NRG; PAM sequence: TGG
ccgcctcagcctcctaaagc

SEQ ID NO: 41834 - DNA, 20 bp, Artificial Sequence
  Description of Artificial Sequence: Synthetic oligonucleotide
  Target: ATXN1; (-) strand; PAM type: NRG; PAM sequence: AAG
tcacccgcctcagcctccta

SEQ ID NO: 41835 - DNA, 20 bp, Artificial Sequence
  Description of Artificial Sequence: Synthetic oligonucleotide
  Target: ATXN1; (-) strand; PAM type: NRG; PAM sequence: CAG
ctcaggtgattcacccgcct

SEQ ID NO: 41836 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgacctc

SEQ ID NO: 41837 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgacct

SEQ ID NO: 41838 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggc

SEQ ID NO: 41839 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccatgttggcc

SEQ ID NO: 41840 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccatgttggc

SEQ ID NO: 41841 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcaccatgt

SEQ ID NO: 41842 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagaca

SEQ ID NO: 41843 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagagac

SEQ ID NO: 41844 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 41845 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 41846 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 41847 - DNA, 20 bp, Artificial Sequence
  Description of Artificial Sequence: Synthetic oligonucleotide
  Target: ATXN1; (-) strand; PAM type: NRG; PAM sequence: TAG
cctgctaatttttgtatttt

SEQ ID NO: 41848 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagccgagactac

SEQ ID NO: 41849 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagccgagacta

SEQ ID NO: 41850 - DNA, 20 bp, Artificial Sequence
  Description of Artificial Sequence: Synthetic oligonucleotide
  Target: ATXN1; (-) strand; PAM type: NRG; PAM sequence: GAG
cctcagcctcccaagtagcc

SEQ ID NO: 41851 - DNA, 20 bp, Artificial Sequence
  Description of Artificial Sequence: Synthetic oligonucleotide
  Target: ATXN1; (-) strand; PAM type: NRG; PAM sequence: TAG
ttctgcctcagcctcccaag

SEQ ID NO: 41852 - DNA, 20 bp, Artificial Sequence
  Description of Artificial Sequence: Synthetic oligonucleotide
  Target: ATXN1; (-) strand; PAM type: NRG; PAM sequence: AAG
ttcttctgcctcagcctccc

SEQ ID NO: 41853 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattcttctgcct

SEQ ID NO: 41854 - DNA, 20 bp, Artificial Sequence
  Description of Artificial Sequence: Synthetic oligonucleotide
  Target: ATXN1; (-) strand; PAM type: NRG; PAM sequence: AAG
caacatctgcctcttggttc

SEQ ID NO: 41855 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacatctgcctct

SEQ ID NO: 41856 - DNA, 20 bp, Artificial Sequence
  Description of Artificial Sequence: Synthetic oligonucleotide
  Target: ATXN1; (-) strand; PAM type: NRG; PAM sequence: TGG
agagtgcagtggggtgatct

SEQ ID NO: 41857 - DNA, 20 bp, Artificial Sequence
  Description of Artificial Sequence: Synthetic oligonucleotide
  Target: ATXN1; (-) strand; PAM type: NRG; PAM sequence: GGG
ctggagtgcagagtgcagtg

SEQ ID NO: 41858 - DNA, 20 bp, Artificial Sequence
  Description of Artificial Sequence: Synthetic oligonucleotide
  Target: ATXN1; (-) strand; PAM type: NRG; PAM sequence: GGG
gctggagtgcagagtgcagt

SEQ ID NO: 41859 - DNA, 20 bp, Artificial Sequence
  Description of Artificial Sequence: Synthetic oligonucleotide
  Target: ATXN1; (-) strand; PAM type: NRG; PAM sequence: TGG
ggctggagtgcagagtgcag

SEQ ID NO: 41860 - DNA, 20 bp, Artificial Sequence
  Description of Artificial Sequence: Synthetic oligonucleotide
  Target: ATXN1; (-) strand; PAM type: NRG; PAM sequence: CAG
ccaggctggagtgcagagtg

SEQ ID NO: 41861 - DNA, 20 bp, Artificial Sequence
  Description of Artificial Sequence: Synthetic oligonucleotide
  Target: ATXN1; (-) strand; PAM type: NRG; PAM sequence: GAG
gtcacccaggctggagtgca

SEQ ID NO: 41862 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggagtg

SEQ ID NO: 41863 - DNA, 20 bp, Artificial Sequence
  Description of Artificial Sequence: Synthetic oligonucleotide
  Target: ATXN1; (-) strand; PAM type: NRG; PAM sequence: GAG
ttgctctgtcacccaggctg

SEQ ID NO: 41864 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgtcacccaggc

SEQ ID NO: 41865 - DNA, 20 bp, Artificial Sequence
  Description of Artificial Sequence: Synthetic oligonucleotide
  Target: ATXN1; (-) strand; PAM type: NRG; PAM sequence: AGG
agagtcttgctctgtcaccc

SEQ ID NO: 41866 - DNA, 20 bp, Artificial Sequence
  Description of Artificial Sequence: Synthetic oligonucleotide
  Target: ATXN1; (-) strand; PAM type: NRG; PAM sequence: CAG
cagagtcttgctctgtcacc

SEQ ID NO: 41867 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttggagaca

SEQ ID NO: 41868 - DNA, 20 bp, Artificial Sequence
  Description of Artificial Sequence: Synthetic oligonucleotide
  Target: ATXN1; (-) strand; PAM type: NRG; PAM sequence: CAG
tttttttttttttttggaga

SEQ ID NO: 41869 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttg

SEQ ID NO: 41870 - DNA, 20 bp, Artificial Sequence
  Description of Artificial Sequence: Synthetic oligonucleotide
  Target: ATXN1; (-) strand; PAM type: NRG; PAM sequence: TGG
tttttttttttttttttttt

SEQ ID NO: 41871 - DNA, 20 bp, Artificial Sequence
  Description of Artificial Sequence: Synthetic oligonucleotide
  Target: ATXN1; (-) strand; PAM type: NRG; PAM sequence: CAG
ctggcagcctctgcagaaac

SEQ ID NO: 41872 - DNA, 20 bp, Artificial Sequence
  Description of Artificial Sequence: Synthetic oligonucleotide
  Target: ATXN1; (-) strand; PAM type: NRG; PAM sequence: CAG
cccaggcctggcagcctctg

SEQ ID NO: 41873 - DNA, 20 bp, Artificial Sequence
  Description of Artificial Sequence: Synthetic oligonucleotide
  Target: ATXN1; (-) strand; PAM type: NRG; PAM sequence: CAG
gccacacttcccaggcctgg

SEQ ID NO: 41874 - DNA, 20 bp, Artificial Sequence
  Description of Artificial Sequence: Synthetic oligonucleotide
  Target: ATXN1; (-) strand; PAM type: NRG; PAM sequence: TGG
tgggccacacttcccaggcc

SEQ ID NO: 41875 - DNA, 20 bp, Artificial Sequence
  Description of Artificial Sequence: Synthetic oligonucleotide
  Target: ATXN1; (-) strand; PAM type: NRG; PAM sequence: AGG
agctgtgggccacacttccc

SEQ ID NO: 41876 - DNA, 20 bp, Artificial Sequence
  Description of Artificial Sequence: Synthetic oligonucleotide
  Target: ATXN1; (-) strand; PAM type: NRG; PAM sequence: CAG
cagctgtgggccacacttcc

SEQ ID NO: 41877 - DNA, 20 bp, Artificial Sequence
  Description of Artificial Sequence: Synthetic oligonucleotide
  Target: ATXN1; (-) strand; PAM type: NRG; PAM sequence: GGG
aaggcagccacttcagctgt

SEQ ID NO: 41878 - DNA, 20 bp, Artificial Sequence
  Description of Artificial Sequence: Synthetic oligonucleotide
  Target: ATXN1; (-) strand; PAM type: NRG; PAM sequence: TGG
gaaggcagccacttcagctg

SEQ ID NO: 41879 - DNA, 20 bp, Artificial Sequence
  Description of Artificial Sequence: Synthetic oligonucleotide
  Target: ATXN1; (-) strand; PAM type: NRG; PAM sequence: CAG
gagaatgaaggcagccactt

SEQ ID NO: 41880 - DNA, 20 bp, Artificial Sequence
  Description of Artificial Sequence: Synthetic oligonucleotide
  Target: ATXN1; (-) strand; PAM type: NRG; PAM sequence: CAG
cttcagcttgagaatgaagg

SEQ ID NO: 41881 - DNA, 20 bp, Artificial Sequence
  Description of Artificial Sequence: Synthetic oligonucleotide
  Target: ATXN1; (-) strand; PAM type: NRG; PAM sequence: AGG
caacttcagcttgagaatga

SEQ ID NO: 41882 - DNA, 20 bp, Artificial Sequence
  Description of Artificial Sequence: Synthetic oligonucleotide
  Target: ATXN1; (-) strand; PAM type: NRG; PAM sequence: AAG
tcaacttcagcttgagaatg

SEQ ID NO: 41883 - DNA, 20 bp, Artificial Sequence
  Description of Artificial Sequence: Synthetic oligonucleotide
  Target: ATXN1; (-) strand; PAM type: NRG; PAM sequence: GAG
gccagcatcaacttcagctt

SEQ ID NO: 41884 - DNA, 20 bp, Artificial Sequence
  Description of Artificial Sequence: Synthetic oligonucleotide
  Target: ATXN1; (-) strand; PAM type: NRG; PAM sequence: CAG
ttgccggccagcatcaactt

SEQ ID NO: 41885 - DNA, 20 bp, Artificial Sequence
  Description of Artificial Sequence: Synthetic oligonucleotide
  Target: ATXN1; (-) strand; PAM type: NRG; PAM sequence: CAG
gcgactggttccttgccggc

SEQ ID NO: 41886 - DNA, 20 bp, Artificial Sequence
  Description of Artificial Sequence: Synthetic oligonucleotide
  Target: ATXN1; (-) strand; PAM type: NRG; PAM sequence: CGG
aaatgcgactggttccttgc

SEQ ID NO: 41887 - DNA, 20 bp, Artificial Sequence
  Description of Artificial Sequence: Synthetic oligonucleotide
  Target: ATXN1; (-) strand; PAM type: NRG; PAM sequence: TGG
gttttgtttagaaatgcgac

SEQ ID NO: 41888 - DNA, 20 bp, Artificial Sequence
  Description of Artificial Sequence: Synthetic oligonucleotide
  Target: ATXN1; (-) strand; PAM type: NRG; PAM sequence: TAG
gtgtgaaaagaggttttgtt

SEQ ID NO: 41889 - DNA, 20 bp, Artificial Sequence
  Description of Artificial Sequence: Synthetic oligonucleotide
  Target: ATXN1; (-) strand; PAM type: NRG; PAM sequence: AGG
acagaggcaggtgtgaaaag

SEQ ID NO: 41890 - DNA, 20 bp, Artificial Sequence
  Description of Artificial Sequence: Synthetic oligonucleotide
  Target: ATXN1; (-) strand; PAM type: NRG; PAM sequence: GAG
aacagaggcaggtgtgaaaa

SEQ ID NO: 41891 - DNA, 20 bp, Artificial Sequence
  Description of Artificial Sequence: Synthetic oligonucleotide
  Target: ATXN1; (-) strand; PAM type: NRG; PAM sequence: AAG
tgaacagaggcaggtgtgaa

SEQ ID NO: 41892 - DNA, 20 bp, Artificial Sequence
  Description of Artificial Sequence: Synthetic oligonucleotide
  Target: ATXN1; (-) strand; PAM type: NRG; PAM sequence: AGG
acatttttgtgaacagaggc

SEQ ID NO: 41893 - DNA, 20 bp, Artificial Sequence
  Description of Artificial Sequence: Synthetic oligonucleotide
  Target: ATXN1; (-) strand; PAM type: NRG; PAM sequence: CAG
cacatttttgtgaacagagg

SEQ ID NO: 41894 - DNA, 20 bp, Artificial Sequence
  Description of Artificial Sequence: Synthetic oligonucleotide
  Target: ATXN1; (-) strand; PAM type: NRG; PAM sequence: AGG
taacacatttttgtgaacag

SEQ ID NO: 41895 - DNA, 20 bp, Artificial Sequence
  Description of Artificial Sequence: Synthetic oligonucleotide
  Target: ATXN1; (-) strand; PAM type: NRG; PAM sequence: GAG
ttaacacatttttgtgaaca

SEQ ID NO: 41896 - DNA, 20 bp, Artificial Sequence
  Description of Artificial Sequence: Synthetic oligonucleotide
  Target: ATXN1; (-) strand; PAM type: NRG; PAM sequence: CAG
ccttaacacatttttgtgaa

SEQ ID NO: 41897 - DNA, 20 bp, Artificial Sequence
  Description of Artificial Sequence: Synthetic oligonucleotide
  Target: ATXN1; (-) strand; PAM type: NRG; PAM sequence: TAG
tcattgcttttcatggtact

SEQ ID NO: 41898 - DNA, 20 bp, Artificial Sequence
  Description of Artificial Sequence: Synthetic oligonucleotide
  Target: ATXN1; (-) strand; PAM type: NRG; PAM sequence: TGG
tgaagagtcattgcttttca

SEQ ID NO: 41899 - DNA, 20 bp, Artificial Sequence
  Description of Artificial Sequence: Synthetic oligonucleotide
  Target: ATXN1; (-) strand; PAM type: NRG; PAM sequence: GAG
ggaaaataaacatgagtgaa

SEQ ID NO: 41900 - DNA, 20 bp, Artificial Sequence
  Description of Artificial Sequence: Synthetic oligonucleotide
  Target: ATXN1; (-) strand; PAM type: NRG; PAM sequence: AAG
atggaaaataaacatgagtg

SEQ ID NO: 41901 - DNA, 20 bp, Artificial Sequence
  Description of Artificial Sequence: Synthetic oligonucleotide
  Target: ATXN1; (-) strand; PAM type: NRG; PAM sequence: GAG
gacacatggaaaataaacat

SEQ ID NO: 41902 - DNA, 20 bp, Artificial Sequence
  Description of Artificial Sequence: Synthetic oligonucleotide
  Target: ATXN1; (-) strand; PAM type: NRG; PAM sequence: TGG
cacagaccccaggtgacaca

SEQ ID NO: 41903 - DNA, 20 bp, Artificial Sequence
  Description of Artificial Sequence: Synthetic oligonucleotide
  Target: ATXN1; (-) strand; PAM type: NRG; PAM sequence: AGG
gttgactcttcacagacccc

SEQ ID NO: 41904 - DNA, 20 bp, Artificial Sequence
  Description of Artificial Sequence: Synthetic oligonucleotide
  Target: ATXN1; (-) strand; PAM type: NRG; PAM sequence: CAG
agttgactcttcacagaccc

SEQ ID NO: 41905 - DNA, 20 bp, Artificial Sequence
  Description of Artificial Sequence: Synthetic oligonucleotide
  Target: ATXN1; (-) strand; PAM type: NRG; PAM sequence: CAG
tgagcaaagttgactcttca

SEQ ID NO: 41906 - DNA, 20 bp, Artificial Sequence
  Description of Artificial Sequence: Synthetic oligonucleotide
  Target: ATXN1; (-) strand; PAM type: NRG; PAM sequence: AAG
aaaatgaactaccttgagca

SEQ ID NO: 41907 - DNA, 20 bp, Artificial Sequence
  Description of Artificial Sequence: Synthetic oligonucleotide
  Target: ATXN1; (-) strand; PAM type: NRG; PAM sequence: GAG
gaaagaaaatgaactacctt

SEQ ID NO: 41908 - DNA, 20 bp, Artificial Sequence
  Description of Artificial Sequence: Synthetic oligonucleotide
  Target: ATXN1; (-) strand; PAM type: NRG; PAM sequence: AAG
taggggtgggtactaggaga

SEQ ID NO: 41909 - DNA, 20 bp, Artificial Sequence
  Description of Artificial Sequence: Synthetic oligonucleotide
  Target: ATXN1; (-) strand; PAM type: NRG; PAM sequence: GAG
gaattaggggtgggtactag

SEQ ID NO: 41910 - DNA, 20 bp, Artificial Sequence
  Description of Artificial Sequence: Synthetic oligonucleotide
  Target: ATXN1; (-) strand; PAM type: NRG; PAM sequence: AGG
atgaattaggggtgggtact

SEQ ID NO: 41911 - DNA, 20 bp, Artificial Sequence
  Description of Artificial Sequence: Synthetic oligonucleotide
  Target: ATXN1; (-) strand; PAM type: NRG; PAM sequence: TAG
catgaattaggggtgggtac

SEQ ID NO: 41912 - DNA, 20 bp, Artificial Sequence
  Description of Artificial Sequence: Synthetic oligonucleotide
  Target: ATXN1; (-) strand; PAM type: NRG; PAM sequence: GGG
ttcctgcatgaattaggggt

SEQ ID NO: 41913 - DNA, 20 bp, Artificial Sequence
  Description of Artificial Sequence: Synthetic oligonucleotide
  Target: ATXN1; (-) strand; PAM type: NRG; PAM sequence: TGG
cttcctgcatgaattagggg

SEQ ID NO: 41914 - DNA, 20 bp, Artificial Sequence
  Description of Artificial Sequence: Synthetic oligonucleotide
  Target: ATXN1; (-) strand; PAM type: NRG; PAM sequence: GGG
tcacttcctgcatgaattag

SEQ ID NO: 41915 - DNA, 20 bp, Artificial Sequence
  Description of Artificial Sequence: Synthetic oligonucleotide
  Target: ATXN1; (-) strand; PAM type: NRG; PAM sequence: GGG
ttcacttcctgcatgaatta

SEQ ID NO: 41916 - DNA, 20 bp, Artificial Sequence
  Description of Artificial Sequence: Synthetic oligonucleotide
  Target: ATXN1; (-) strand; PAM type: NRG; PAM sequence: AGG
gttcacttcctgcatgaatt

SEQ ID NO: 41917 - DNA, 20 bp, Artificial Sequence
  Description of Artificial Sequence: Synthetic oligonucleotide
  Target: ATXN1; (-) strand; PAM type: NRG; PAM sequence: TAG
tgttcacttcctgcatgaat

SEQ ID NO: 41918 - DNA, 20 bp, Artificial Sequence
  Description of Artificial Sequence: Synthetic oligonucleotide
  Target: ATXN1; (-) strand; PAM type: NRG; PAM sequence: TGG
agctcactacccctctgtag

SEQ ID NO: 41919 - DNA, 20 bp, Artificial Sequence
  Description of Artificial Sequence: Synthetic oligonucleotide
  Target: ATXN1; (-) strand; PAM type: NRG; PAM sequence: TAG
tacagctcactacccctctg

SEQ ID NO: 41920 - DNA, 20 bp, Artificial Sequence
  Description of Artificial Sequence: Synthetic oligonucleotide
  Target: ATXN1; (-) strand; PAM type: NRG; PAM sequence: CAG
aaataaatggcataataata

SEQ ID NO: 41921 - DNA, 20 bp, Artificial Sequence
  Description of Artificial Sequence: Synthetic oligonucleotide
  Target: ATXN1; (-) strand; PAM type: NRG; PAM sequence: TGG
atcaggatttttaaaataaa

SEQ ID NO: 41922 - DNA, 20 bp, Artificial Sequence
  Description of Artificial Sequence: Synthetic oligonucleotide
  Target: ATXN1; (-) strand; PAM type: NRG; PAM sequence: AGG
tttaaaaaaaaaagaaaatc

SEQ ID NO: 41923 - DNA, 20 bp, Artificial Sequence
  Description of Artificial Sequence: Synthetic oligonucleotide
  Target: ATXN1; (-) strand; PAM type: NRG; PAM sequence: CAG
atttaaaaaaaaaagaaaat

SEQ ID NO: 41924 - DNA, 20 bp, Artificial Sequence
  Description of Artificial Sequence: Synthetic oligonucleotide
  Target: ATXN1; (-) strand; PAM type: NRG; PAM sequence: AAG
aagatcttatttaaaaaaaa

SEQ ID NO: 41925 - DNA, 20 bp, Artificial Sequence
  Description of Artificial Sequence: Synthetic oligonucleotide
  Target: ATXN1; (-) strand; PAM type: NRG; PAM sequence: AAG
gcccaagaaagatttcccca

SEQ ID NO: 41926 - DNA, 20 bp, Artificial Sequence
  Description of Artificial Sequence: Synthetic oligonucleotide
  Target: ATXN1; (-) strand; PAM type: NRG; PAM sequence: AAG
gtctttggaagggcccaaga

SEQ ID NO: 41927 - DNA, 20 bp, Artificial Sequence
  Description of Artificial Sequence: Synthetic oligonucleotide
  Target: ATXN1; (-) strand; PAM type: NRG; PAM sequence: AAG
tacagtctttggaagggccc

SEQ ID NO: 41928 - DNA, 20 bp, Artificial Sequence
  Description of Artificial Sequence: Synthetic oligonucleotide
  Target: ATXN1; (-) strand; PAM type: NRG; PAM sequence: GGG
taggtttacagtctttggaa

SEQ ID NO: 41929 - DNA, 20 bp, Artificial Sequence
  Description of Artificial Sequence: Synthetic oligonucleotide
  Target: ATXN1; (-) strand; PAM type: NRG; PAM sequence: AGG
gtaggtttacagtctttgga

SEQ ID NO: 41930 - DNA, 20 bp, Artificial Sequence
  Description of Artificial Sequence: Synthetic oligonucleotide
  Target: ATXN1; (-) strand; PAM type: NRG; PAM sequence: AAG
tgtaggtttacagtctttgg

SEQ ID NO: 41931 - DNA, 20 bp, Artificial Sequence
  Description of Artificial Sequence: Synthetic oligonucleotide
  Target: ATXN1; (-) strand; PAM type: NRG; PAM sequence: TGG
cactgtaggtttacagtctt

SEQ ID NO: 41932 - DNA, 20 bp, Artificial Sequence
  Description of Artificial Sequence: Synthetic oligonucleotide
  Target: ATXN1; (-) strand; PAM type: NRG; PAM sequence: CAG
gagatgtcactgtaggttta

SEQ ID NO: 41933 - DNA, 20 bp, Artificial Sequence
  Description of Artificial Sequence: Synthetic oligonucleotide
  Target: ATXN1; (-) strand; PAM type: NRG; PAM sequence: AGG
gtattatgagatgtcactgt

SEQ ID NO: 41934 - DNA, 20 bp, Artificial Sequence
  Description of Artificial Sequence: Synthetic oligonucleotide
  Target: ATXN1; (-) strand; PAM type: NRG; PAM sequence: TAG
tgtattatgagatgtcactg

SEQ ID NO: 41935 - DNA, 20 bp, Artificial Sequence
  Description of Artificial Sequence: Synthetic oligonucleotide
  Target: ATXN1; (-) strand; PAM type: NRG; PAM sequence: GAG
aatacttttctttgtattat

SEQ ID NO: 41936 - DNA, 20 bp, Artificial Sequence
  Description of Artificial Sequence: Synthetic oligonucleotide
  Target: ATXN1; (-) strand; PAM type: NRG; PAM sequence: TAG
cctgcattgccgagagcttt

SEQ ID NO: 41937 - DNA, 20 bp, Artificial Sequence
  Description of Artificial Sequence: Synthetic oligonucleotide
  Target: ATXN1; (-) strand; PAM type: NRG; PAM sequence: GAG
ccggggccctgcattgccga

SEQ ID NO: 41938 - DNA, 20 bp, Artificial Sequence
  Description of Artificial Sequence: Synthetic oligonucleotide
  Target: ATXN1; (-) strand; PAM type: NRG; PAM sequence: GAG
agccggggccctgcattgcc

SEQ ID NO: 41939 - DNA, 20 bp, Artificial Sequence
  Description of Artificial Sequence: Synthetic oligonucleotide
  Target: ATXN1; (-) strand; PAM type: NRG; PAM sequence: GGG
tgggggcttgcacaaagccg

SEQ ID NO: 41940 - DNA, 20 bp, Artificial Sequence
  Description of Artificial Sequence: Synthetic oligonucleotide
  Target: ATXN1; (-) strand; PAM type: NRG; PAM sequence: GGG
atgggggcttgcacaaagcc

SEQ ID NO: 41941 - DNA, 20 bp, Artificial Sequence
  Description of Artificial Sequence: Synthetic oligonucleotide
  Target: ATXN1; (-) strand; PAM type: NRG; PAM sequence: CGG
tatgggggcttgcacaaagc

SEQ ID NO: 41942 - DNA, 20 bp, Artificial Sequence
  Description of Artificial Sequence: Synthetic oligonucleotide
  Target: ATXN1; (-) strand; PAM type: NRG; PAM sequence: AAG
tggatatgggggcttgcaca

SEQ ID NO: 41943 - DNA, 20 bp, Artificial Sequence
  Description of Artificial Sequence: Synthetic oligonucleotide
  Target: ATXN1; (-) strand; PAM type: NRG; PAM sequence: GGG
tcgtgaatgactggatatgg

SEQ ID NO: 41944 - DNA, 20 bp, Artificial Sequence
  Description of Artificial Sequence: Synthetic oligonucleotide
  Target: ATXN1; (-) strand; PAM type: NRG; PAM sequence: GGG
ctcgtgaatgactggatatg

SEQ ID NO: 41945 - DNA, 20 bp, Artificial Sequence
  Description of Artificial Sequence: Synthetic oligonucleotide
  Target: ATXN1; (-) strand; PAM type: NRG; PAM sequence: GGG
actcgtgaatgactggatat

SEQ ID NO: 41946 - DNA, 20 bp, Artificial Sequence
  Description of Artificial Sequence: Synthetic oligonucleotide
  Target: ATXN1; (-) strand; PAM type: NRG; PAM sequence: TGG
cactcgtgaatgactggata

SEQ ID NO: 41947 - DNA, 20 bp, Artificial Sequence
  Description of Artificial Sequence: Synthetic oligonucleotide
  Target: ATXN1; (-) strand; PAM type: NRG; PAM sequence: TGG
cagaaccactcgtgaatgac

SEQ ID NO: 41948 - DNA, 20 bp, Artificial Sequence
  Description of Artificial Sequence: Synthetic oligonucleotide
  Target: ATXN1; (-) strand; PAM type: NRG; PAM sequence: CAG
aaaggaccaaatcagttttc

SEQ ID NO: 41949 - DNA, 20 bp, Artificial Sequence
  Description of Artificial Sequence: Synthetic oligonucleotide
  Target: ATXN1; (-) strand; PAM type: NRG; PAM sequence: CAG
aagtgaggaaaggaccaaat

SEQ ID NO: 41950 - DNA, 20 bp, Artificial Sequence
  Description of Artificial Sequence: Synthetic oligonucleotide
  Target: ATXN1; (-) strand; PAM type: NRG; PAM sequence: AGG
ttaaatgcccaagtgaggaa

SEQ ID NO: 41951 - DNA, 20 bp, Artificial Sequence
  Description of Artificial Sequence: Synthetic oligonucleotide
  Target: ATXN1; (-) strand; PAM type: NRG; PAM sequence: AAG
cttaaatgcccaagtgagga

SEQ ID NO: 41952 - DNA, 20 bp, Artificial Sequence
  Description of Artificial Sequence: Synthetic oligonucleotide
  Target: ATXN1; (-) strand; PAM type: NRG; PAM sequence: AGG
atttcttaaatgcccaagtg

SEQ ID NO: 41953 - DNA, 20 bp, Artificial Sequence
  Description of Artificial Sequence: Synthetic oligonucleotide
  Target: ATXN1; (-) strand; PAM type: NRG; PAM sequence: GAG
catttcttaaatgcccaagt

SEQ ID NO: 41954 - DNA, 20 bp, Artificial Sequence
  Description of Artificial Sequence: Synthetic oligonucleotide
  Target: ATXN1; (-) strand; PAM type: NRG; PAM sequence: AAG
tgagcatttcttaaatgccc

SEQ ID NO: 41955 - DNA, 20 bp, Artificial Sequence
  Description of Artificial Sequence: Synthetic oligonucleotide
  Target: ATXN1; (-) strand; PAM type: NRG; PAM sequence: GAG
tccctatgtctggctttttt

SEQ ID NO: 41956 - DNA, 20 bp, Artificial Sequence
  Description of Artificial Sequence: Synthetic oligonucleotide
  Target: ATXN1; (-) strand; PAM type: NRG; PAM sequence: TGG
cagacacgagtccctatgtc

SEQ ID NO: 41957 - DNA, 20 bp, Artificial Sequence
  Description of Artificial Sequence: Synthetic oligonucleotide
  Target: ATXN1; (-) strand; PAM type: NRG; PAM sequence: GAG
agccctgagattacagacac

SEQ ID NO: 41958 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagccctgagatta

SEQ ID NO: 41959 - DNA, 20 bp, Artificial Sequence
  Description of Artificial Sequence: Synthetic oligonucleotide
  Target: ATXN1; (-) strand; PAM type: NRG; PAM sequence: GAG
cctcggcctcccaaagccct

SEQ ID NO: 41960 - DNA, 20 bp, Artificial Sequence
  Description of Artificial Sequence: Synthetic oligonucleotide
  Target: ATXN1; (-) strand; PAM type: NRG; PAM sequence: AAG
ccttccacctcggcctccca

SEQ ID NO: 41961 - DNA, 20 bp, Artificial Sequence
  Description of Artificial Sequence: Synthetic oligonucleotide
  Target: ATXN1; (-) strand; PAM type: NRG; PAM sequence: CGG
tccaagcagtccttccacct

SEQ ID NO: 41962 - DNA, 20 bp, Artificial Sequence
  Description of Artificial Sequence: Synthetic oligonucleotide
  Target: ATXN1; (-) strand; PAM type: NRG; PAM sequence: CAG
tcaaactcctgggctccaag

SEQ ID NO: 41963 - DNA, 20 bp, Artificial Sequence
  Description of Artificial Sequence: Synthetic oligonucleotide
  Target: ATXN1; (-) strand; PAM type: NRG; PAM sequence: AAG
gtctcaaactcctgggctcc

SEQ ID NO: 41964 - DNA, 20 bp, Artificial Sequence
  Description of Artificial Sequence: Synthetic oligonucleotide
  Target: ATXN1; (-) strand; PAM type: NRG; PAM sequence: GGG
taggctggtctcaaactcct

SEQ ID NO: 41965 - DNA, 20 bp, Artificial Sequence
  Description of Artificial Sequence: Synthetic oligonucleotide
  Target: ATXN1; (-) strand; PAM type: NRG; PAM sequence: TGG
ctaggctggtctcaaactcc

SEQ ID NO: 41966 - DNA, 20 bp, Artificial Sequence
  Description of Artificial Sequence: Synthetic oligonucleotide
  Target: ATXN1; (-) strand; PAM type: NRG; PAM sequence: TGG
tcttgctgtgttgcctaggc

SEQ ID NO: 41967 - DNA, 20 bp, Artificial Sequence
  Description of Artificial Sequence: Synthetic oligonucleotide
  Target: ATXN1; (-) strand; PAM type: NRG; PAM sequence: AGG
ggggtcttgctgtgttgcct

SEQ ID NO: 41968 - DNA, 20 bp, Artificial Sequence
  Description of Artificial Sequence: Synthetic oligonucleotide
  Target: ATXN1; (-) strand; PAM type: NRG; PAM sequence: TAG
tggggtcttgctgtgttgcc

SEQ ID NO: 41969 - DNA, 20 bp, Artificial Sequence
  Description of Artificial Sequence: Synthetic oligonucleotide
  Target: ATXN1; (-) strand; PAM type: NRG; PAM sequence: GGG
aaaacattttagtagagatg

SEQ ID NO: 41970 - DNA, 20 bp, Artificial Sequence
  Description of Artificial Sequence: Synthetic oligonucleotide
  Target: ATXN1; (-) strand; PAM type: NRG; PAM sequence: GGG
aaaaacattttagtagagat

SEQ ID NO: 41971 - DNA, 20 bp, Artificial Sequence
  Description of Artificial Sequence: Synthetic oligonucleotide
  Target: ATXN1; (-) strand; PAM type: NRG; PAM sequence: TGG
aaaaaacattttagtagaga

SEQ ID NO: 41972 - DNA, 20 bp, Artificial Sequence
  Description of Artificial Sequence: Synthetic oligonucleotide
  Target: ATXN1; (-) strand; PAM type: NRG; PAM sequence: GAG
aaataaaaaacattttagta

SEQ ID NO: 41973 - DNA, 20 bp, Artificial Sequence
  Description of Artificial Sequence: Synthetic oligonucleotide
  Target: ATXN1; (-) strand; PAM type: NRG; PAM sequence: TAG
aaaaataaaaaacattttag

SEQ ID NO: 41974 - DNA, 20 bp, Artificial Sequence
  Description of Artificial Sequence: Synthetic oligonucleotide
  Target: ATXN1; (-) strand; PAM type: NRG; PAM sequence: TAG
tttaaaaataaaaaacattt

SEQ ID NO: 41975 - DNA, 20 bp, Artificial Sequence
  Description of Artificial Sequence: Synthetic oligonucleotide
  Target: ATXN1; (-) strand; PAM type: NRG; PAM sequence: CAG
caggtgcataccaccatgcc

SEQ ID NO: 41976 - DNA, 20 bp, Artificial Sequence
  Description of Artificial Sequence: Synthetic oligonucleotide
  Target: ATXN1; (-) strand; PAM type: NRG; PAM sequence: AGG
tccctagtagctaggaccac

SEQ ID NO: 41977 - DNA, 20 bp, Artificial Sequence
  Description of Artificial Sequence: Synthetic oligonucleotide
  Target: ATXN1; (-) strand; PAM type: NRG; PAM sequence: CAG
ctccctagtagctaggacca

SEQ ID NO: 41978 - DNA, 20 bp, Artificial Sequence
  Description of Artificial Sequence: Synthetic oligonucleotide
  Target: ATXN1; (-) strand; PAM type: NRG; PAM sequence: AGG
ccccaacctccctagtagct

SEQ ID NO: 41979 - DNA, 20 bp, Artificial Sequence
  Description of Artificial Sequence: Synthetic oligonucleotide
  Target: ATXN1; (-) strand; PAM type: NRG; PAM sequence: TAG
accccaacctccctagtagc

SEQ ID NO: 41980 - DNA, 20 bp, Artificial Sequence
  Description of Artificial Sequence: Synthetic oligonucleotide
  Target: ATXN1; (-) strand; PAM type: NRG; PAM sequence: TAG
tcccaccccaacctccctag

SEQ ID NO: 41981 - DNA, 20 bp, Artificial Sequence
  Description of Artificial Sequence: Synthetic oligonucleotide
  Target: ATXN1; (-) strand; PAM type: NRG; PAM sequence: TAG
tcctcccaccccaacctccc

SEQ ID NO: 41982 - DNA, 20 bp, Artificial Sequence
  Description of Artificial Sequence: Synthetic oligonucleotide
  Target: ATXN1; (-) strand; PAM type: NRG; PAM sequence: CAG
ggccttgacctcctaggctc

SEQ ID NO: 41983 - DNA, 20 bp, Artificial Sequence
  Description of Artificial Sequence: Synthetic oligonucleotide
  Target: ATXN1; (-) strand; PAM type: NRG; PAM sequence: AGG
cactgtggccttgacctcct

SEQ ID NO: 41984 - DNA, 20 bp, Artificial Sequence
  Description of Artificial Sequence: Synthetic oligonucleotide
  Target: ATXN1; (-) strand; PAM type: NRG; PAM sequence: TAG
tcactgtggccttgacctcc

SEQ ID NO: 41985 - DNA, 20 bp, Artificial Sequence
  Description of Artificial Sequence: Synthetic oligonucleotide
  Target: ATXN1; (-) strand; PAM type: NRG; PAM sequence: TGG
ggtgcaatcatagctcactg

SEQ ID NO: 41986 - DNA, 20 bp, Artificial Sequence
  Description of Artificial Sequence: Synthetic oligonucleotide
  Target: ATXN1; (-) strand; PAM type: NRG; PAM sequence: TAG
ggaatgcagtggtgcaatca

SEQ ID NO: 41987 - DNA, 20 bp, Artificial Sequence
  Description of Artificial Sequence: Synthetic oligonucleotide
  Target: ATXN1; (-) strand; PAM type: NRG; PAM sequence: TGG
tctcctaggctggaatgcag

SEQ ID NO: 41988 - DNA, 20 bp, Artificial Sequence
  Description of Artificial Sequence: Synthetic oligonucleotide
  Target: ATXN1; (-) strand; PAM type: NRG; PAM sequence: CAG
ttgtctcctaggctggaatg

SEQ ID NO: 41989 - DNA, 20 bp, Artificial Sequence
  Description of Artificial Sequence: Synthetic oligonucleotide
  Target: ATXN1; (-) strand; PAM type: NRG; PAM sequence: TGG
gtgtttcttgtctcctaggc

SEQ ID NO: 41990 - DNA, 20 bp, Artificial Sequence
  Description of Artificial Sequence: Synthetic oligonucleotide
  Target: ATXN1; (-) strand; PAM type: NRG; PAM sequence: AGG
gacagtgtttcttgtctcct

SEQ ID NO: 41991 - DNA, 20 bp, Artificial Sequence
  Description of Artificial Sequence: Synthetic oligonucleotide
  Target: ATXN1; (-) strand; PAM type: NRG; PAM sequence: TAG
agacagtgtttcttgtctcc

SEQ ID NO: 41992 - DNA, 20 bp, Artificial Sequence
  Description of Artificial Sequence: Synthetic oligonucleotide
  Target: ATXN1; (-) strand; PAM type: NRG; PAM sequence: CAG
tttttttttcatttttgaga

SEQ ID NO: 41993 - DNA, 20 bp, Artificial Sequence
  Description of Artificial Sequence: Synthetic oligonucleotide
  Target: ATXN1; (-) strand; PAM type: NRG; PAM sequence: GAG
catttttttttttcattttt

SEQ ID NO: 41994 - DNA, 20 bp, Artificial Sequence
  Description of Artificial Sequence: Synthetic oligonucleotide
  Target: ATXN1; (-) strand; PAM type: NRG; PAM sequence: GGG
ttaatggtttgaattgtttt

SEQ ID NO: 41995 - DNA, 20 bp, Artificial Sequence
  Description of Artificial Sequence: Synthetic oligonucleotide
  Target: ATXN1; (-) strand; PAM type: NRG; PAM sequence: TGG
attaatggtttgaattgttt

SEQ ID NO: 41996 - DNA, 20 bp, Artificial Sequence
  Description of Artificial Sequence: Synthetic oligonucleotide
  Target: ATXN1; (-) strand; PAM type: NRG; PAM sequence: TGG
aaaaaagataaactaattaa

SEQ ID NO: 41997 - DNA, 20 bp, Artificial Sequence
  Description of Artificial Sequence: Synthetic oligonucleotide
  Target: ATXN1; (-) strand; PAM type: NRG; PAM sequence: AAG
taaaataaaacaagaaaaaa

SEQ ID NO: 41998 - DNA, 20 bp, Artificial Sequence
  Description of Artificial Sequence: Synthetic oligonucleotide
  Target: ATXN1; (-) strand; PAM type: NRG; PAM sequence: AAG
acattcagataaaataaaac

SEQ ID NO: 41999 - DNA, 20 bp, Artificial Sequence
  Description of Artificial Sequence: Synthetic oligonucleotide
  Target: ATXN1; (-) strand; PAM type: NRG; PAM sequence: CAG
tagctgctatttgggacatt

SEQ ID NO: 42000 - DNA, 20 bp, Artificial Sequence
  Description of Artificial Sequence: Synthetic oligonucleotide
  Target: ATXN1; (-) strand; PAM type: NRG; PAM sequence: GGG
tcatgaaatagctgctattt

SEQ ID NO: 42001 - DNA, 20 bp, Artificial Sequence
  Description of Artificial Sequence: Synthetic oligonucleotide
  Target: ATXN1; (-) strand; PAM type: NRG; PAM sequence: TGG
gtcatgaaatagctgctatt

SEQ ID NO: 42002 - DNA, 20 bp, Artificial Sequence
  Description of Artificial Sequence: Synthetic oligonucleotide
  Target: ATXN1; (-) strand; PAM type: NRG; PAM sequence: TAG
agttgaaaatagtcatgaaa

SEQ ID NO: 42003 - DNA, 20 bp, Artificial Sequence
  Description of Artificial Sequence: Synthetic oligonucleotide
  Target: ATXN1; (-) strand; PAM type: NRG; PAM sequence: TAG
cttccagcttgagttgaaaa

SEQ ID NO: 42004 - DNA, 20 bp, Artificial Sequence
  Description of Artificial Sequence: Synthetic oligonucleotide
  Target: ATXN1; (-) strand; PAM type: NRG; PAM sequence: GAG
acagagcctccttccagctt

SEQ ID NO: 42005 - DNA, 20 bp, Artificial Sequence
  Description of Artificial Sequence: Synthetic oligonucleotide
  Target: ATXN1; (-) strand; PAM type: NRG; PAM sequence: CAG
aatgggacagagcctccttc

SEQ ID NO: 42006 - DNA, 20 bp, Artificial Sequence
  Description of Artificial Sequence: Synthetic oligonucleotide
  Target: ATXN1; (-) strand; PAM type: NRG; PAM sequence: GAG
gaaaacattcaaatgggaca

SEQ ID NO: 42007 - DNA, 20 bp, Artificial Sequence
  Description of Artificial Sequence: Synthetic oligonucleotide
  Target: ATXN1; (-) strand; PAM type: NRG; PAM sequence: CAG
ttgaaaacattcaaatggga

SEQ ID NO: 42008 - DNA, 20 bp, Artificial Sequence
  Description of Artificial Sequence: Synthetic oligonucleotide
  Target: ATXN1; (-) strand; PAM type: NRG; PAM sequence: GGG
ggatttgaaaacattcaaat

SEQ ID NO: 42009 - DNA, 20 bp, Artificial Sequence
  Description of Artificial Sequence: Synthetic oligonucleotide
  Target: ATXN1; (-) strand; PAM type: NRG; PAM sequence: TGG
aggatttgaaaacattcaaa

SEQ ID NO: 42010 - DNA, 20 bp, Artificial Sequence
  Description of Artificial Sequence: Synthetic oligonucleotide
  Target: ATXN1; (-) strand; PAM type: NRG; PAM sequence: AGG
ttctacaagtgtttccatct

SEQ ID NO: 42011 - DNA, 20 bp, Artificial Sequence
  Description of Artificial Sequence: Synthetic oligonucleotide
  Target: ATXN1; (-) strand; PAM type: NRG; PAM sequence: TAG
tttctacaagtgtttccatc

SEQ ID NO: 42012 - DNA, 20 bp, Artificial Sequence
  Description of Artificial Sequence: Synthetic oligonucleotide
  Target: ATXN1; (-) strand; PAM type: NRG; PAM sequence: AAG
ctatcgagcgtactttctac

SEQ ID NO: 42013 - DNA, 20 bp, Artificial Sequence
  Description of Artificial Sequence: Synthetic oligonucleotide
  Target: ATXN1; (-) strand; PAM type: NRG; PAM sequence: GAG
tgagagctttcctggctatc

SEQ ID NO: 42014 - DNA, 20 bp, Artificial Sequence
  Description of Artificial Sequence: Synthetic oligonucleotide
  Target: ATXN1; (-) strand; PAM type: NRG; PAM sequence: TGG
cctgcagctgagagctttcc

SEQ ID NO: 42015 - DNA, 20 bp, Artificial Sequence
  Description of Artificial Sequence: Synthetic oligonucleotide
  Target: ATXN1; (-) strand; PAM type: NRG; PAM sequence: GAG
caggttcagcctgcagctga

SEQ ID NO: 42016 - DNA, 20 bp, Artificial Sequence
  Description of Artificial Sequence: Synthetic oligonucleotide
  Target: ATXN1; (-) strand; PAM type: NRG; PAM sequence: GAG
agcaggttcagcctgcagct

SEQ ID NO: 42017 - DNA, 20 bp, Artificial Sequence
  Description of Artificial Sequence: Synthetic oligonucleotide
  Target: ATXN1; (-) strand; PAM type: NRG; PAM sequence: CAG
agtccagcaggttcagcctg

SEQ ID NO: 42018 - DNA, 20 bp, Artificial Sequence
  Description of Artificial Sequence: Synthetic oligonucleotide
  Target: ATXN1; (-) strand; PAM type: NRG; PAM sequence: CAG
tgctgggagtccagcaggtt

SEQ ID NO: 42019 - DNA, 20 bp, Artificial Sequence
  Description of Artificial Sequence: Synthetic oligonucleotide
  Target: ATXN1; (-) strand; PAM type: NRG; PAM sequence: AGG
caagttgctgggagtccagc

SEQ ID NO: 42020 - DNA, 20 bp, Artificial Sequence
  Description of Artificial Sequence: Synthetic oligonucleotide
  Target: ATXN1; (-) strand; PAM type: NRG; PAM sequence: CAG
ccaagttgctgggagtccag

SEQ ID NO: 42021 - DNA, 20 bp, Artificial Sequence
  Description of Artificial Sequence: Synthetic oligonucleotide
  Target: ATXN1; (-) strand; PAM type: NRG; PAM sequence: CAG
tgcccaagttgctgggagtc

SEQ ID NO: 42022 - DNA, 20 bp, Artificial Sequence
  Description of Artificial Sequence: Synthetic oligonucleotide
  Target: ATXN1; (-) strand; PAM type: NRG; PAM sequence: GAG
ttcactgcccaagttgctgg

SEQ ID NO: 42023 - DNA, 20 bp, Artificial Sequence
  Description of Artificial Sequence: Synthetic oligonucleotide
  Target: ATXN1; (-) strand; PAM type: NRG; PAM sequence: GGG
ctttcactgcccaagttgct

SEQ ID NO: 42024 - DNA, 20 bp, Artificial Sequence
  Description of Artificial Sequence: Synthetic oligonucleotide
  Target: ATXN1; (-) strand; PAM type: NRG; PAM sequence: TGG
tctttcactgcccaagttgc

SEQ ID NO: 42025 - DNA, 20 bp, Artificial Sequence
  Description of Artificial Sequence: Synthetic oligonucleotide
  Target: ATXN1; (-) strand; PAM type: NRG; PAM sequence: AAG
gcccatttctttcactgccc

SEQ ID NO: 42026 - DNA, 20 bp, Artificial Sequence
  Description of Artificial Sequence: Synthetic oligonucleotide
  Target: ATXN1; (-) strand; PAM type: NRG; PAM sequence: CAG
gattacatgcatttattcca

SEQ ID NO: 42027 - DNA, 20 bp, Artificial Sequence
  Description of Artificial Sequence: Synthetic oligonucleotide
  Target: ATXN1; (-) strand; PAM type: NRG; PAM sequence: TAG
tctacccttttccaggttct

SEQ ID NO: 42028 - DNA, 20 bp, Artificial Sequence
  Description of Artificial Sequence: Synthetic oligonucleotide
  Target: ATXN1; (-) strand; PAM type: NRG; PAM sequence: AGG
ccttcaatctacccttttcc

SEQ ID NO: 42029 - DNA, 20 bp, Artificial Sequence
  Description of Artificial Sequence: Synthetic oligonucleotide
  Target: ATXN1; (-) strand; PAM type: NRG; PAM sequence: CAG
tccttcaatctacccttttc

SEQ ID NO: 42030 - DNA, 20 bp, Artificial Sequence
  Description of Artificial Sequence: Synthetic oligonucleotide
  Target: ATXN1; (-) strand; PAM type: NRG; PAM sequence: AGG
ttaacgctcttaatttccac

SEQ ID NO: 42031 - DNA, 20 bp, Artificial Sequence
  Description of Artificial Sequence: Synthetic oligonucleotide
  Target: ATXN1; (-) strand; PAM type: NRG; PAM sequence: CAG
gttaacgctcttaatttcca

SEQ ID NO: 42032 - DNA, 20 bp, Artificial Sequence
  Description of Artificial Sequence: Synthetic oligonucleotide
  Target: ATXN1; (-) strand; PAM type: NRG; PAM sequence: TGG
aagatgagtcactggaagta

SEQ ID NO: 42033 - DNA, 20 bp, Artificial Sequence
  Description of Artificial Sequence: Synthetic oligonucleotide
  Target: ATXN1; (-) strand; PAM type: NRG; PAM sequence: AAG
tagccaagatgagtcactgg

SEQ ID NO: 42034 - DNA, 20 bp, Artificial Sequence
  Description of Artificial Sequence: Synthetic oligonucleotide
  Target: ATXN1; (-) strand; PAM type: NRG; PAM sequence: TGG
ctgtagccaagatgagtcac

SEQ ID NO: 42035 - DNA, 20 bp, Artificial Sequence
  Description of Artificial Sequence: Synthetic oligonucleotide
  Target: ATXN1; (-) strand; PAM type: NRG; PAM sequence: GAG
aagtcagctgtagccaagat

SEQ ID NO: 42036 - DNA, 20 bp, Artificial Sequence
  Description of Artificial Sequence: Synthetic oligonucleotide
  Target: ATXN1; (-) strand; PAM type: NRG; PAM sequence: AAG
gggtaaagtcagctgtagcc

SEQ ID NO: 42037 - DNA, 20 bp, Artificial Sequence
  Description of Artificial Sequence: Synthetic oligonucleotide
  Target: ATXN1; (-) strand; PAM type: NRG; PAM sequence: TAG
gcttggggtaaagtcagctg

SEQ ID NO: 42038 - DNA, 20 bp, Artificial Sequence
  Description of Artificial Sequence: Synthetic oligonucleotide
  Target: ATXN1; (-) strand; PAM type: NRG; PAM sequence: CAG
tgctgggcttggggtaaagt

SEQ ID NO: 42039 - DNA, 20 bp, Artificial Sequence
  Description of Artificial Sequence: Synthetic oligonucleotide
  Target: ATXN1; (-) strand; PAM type: NRG; PAM sequence: AAG
gacctgctgggcttggggta

SEQ ID NO: 42040 - DNA, 20 bp, Artificial Sequence
  Description of Artificial Sequence: Synthetic oligonucleotide
  Target: ATXN1; (-) strand; PAM type: NRG; PAM sequence: GGG
caggtgacctgctgggcttg

SEQ ID NO: 42041 - DNA, 20 bp, Artificial Sequence
  Description of Artificial Sequence: Synthetic oligonucleotide
  Target: ATXN1; (-) strand; PAM type: NRG; PAM sequence: GGG
ccaggtgacctgctgggctt

SEQ ID NO: 42042 - DNA, 20 bp, Artificial Sequence
  Description of Artificial Sequence: Synthetic oligonucleotide
  Target: ATXN1; (-) strand; PAM type: NRG; PAM sequence: TGG
cccaggtgacctgctgggct

SEQ ID NO: 42043 - DNA, 20 bp, Artificial Sequence
  Description of Artificial Sequence: Synthetic oligonucleotide
  Target: ATXN1; (-) strand; PAM type: NRG; PAM sequence: GGG
gctgtcccaggtgacctgct

SEQ ID NO: 42044 - DNA, 20 bp, Artificial Sequence
  Description of Artificial Sequence: Synthetic oligonucleotide
  Target: ATXN1; (-) strand; PAM type: NRG; PAM sequence: TGG
ggctgtcccaggtgacctgc

SEQ ID NO: 42045 - DNA, 20 bp, Artificial Sequence
  Description of Artificial Sequence: Synthetic oligonucleotide
  Target: ATXN1; (-) strand; PAM type: NRG; PAM sequence: AGG
tgagaagtcagggctgtccc

SEQ ID NO: 42046 - DNA, 20 bp, Artificial Sequence
  Description of Artificial Sequence: Synthetic oligonucleotide
  Target: ATXN1; (-) strand; PAM type: NRG; PAM sequence: CAG
ctgagaagtcagggctgtcc

SEQ ID NO: 42047 - DNA, 20 bp, Artificial Sequence
  Description of Artificial Sequence: Synthetic oligonucleotide
  Target: ATXN1; (-) strand; PAM type: NRG; PAM sequence: GGG
taatacaatctgagaagtca

SEQ ID NO: 42048 - DNA, 20 bp, Artificial Sequence
  Description of Artificial Sequence: Synthetic oligonucleotide
  Target: ATXN1; (-) strand; PAM type: NRG; PAM sequence: AGG
ttaatacaatctgagaagtc

SEQ ID NO: 42049 - DNA, 20 bp, Artificial Sequence
  Description of Artificial Sequence: Synthetic oligonucleotide
  Target: ATXN1; (-) strand; PAM type: NRG; PAM sequence: CAG
gttaatacaatctgagaagt

SEQ ID NO: 42050 - DNA, 20 bp, Artificial Sequence
  Description of Artificial Sequence: Synthetic oligonucleotide
  Target: ATXN1; (-) strand; PAM type: NRG; PAM sequence: AAG
cgtggttaatacaatctgag

SEQ ID NO: 42051 - DNA, 20 bp, Artificial Sequence
  Description of Artificial Sequence: Synthetic oligonucleotide
  Target: ATXN1; (-) strand; PAM type: NRG; PAM sequence: GAG
aagcgtggttaatacaatct

SEQ ID NO: 42052 - DNA, 20 bp, Artificial Sequence
  Description of Artificial Sequence: Synthetic oligonucleotide
  Target: ATXN1; (-) strand; PAM type: NRG; PAM sequence: TGG
agcatcagaaaataaaagcg

SEQ ID NO: 42053 - DNA, 20 bp, Artificial Sequence
  Description of Artificial Sequence: Synthetic oligonucleotide
  Target: ATXN1; (-) strand; PAM type: NRG; PAM sequence: AAG
atcaaagcatcagaaaataa

SEQ ID NO: 42054 - DNA, 20 bp, Artificial Sequence
  Description of Artificial Sequence: Synthetic oligonucleotide
  Target: ATXN1; (-) strand; PAM type: NRG; PAM sequence: CAG
acactaaaatatcaaagcat

SEQ ID NO: 42055 - DNA, 20 bp, Artificial Sequence
  Description of Artificial Sequence: Synthetic oligonucleotide
  Target: ATXN1; (-) strand; PAM type: NRG; PAM sequence: AAG
cacaagacactaaaatatca

SEQ ID NO: 42056 - DNA, 20 bp, Artificial Sequence
  Description of Artificial Sequence: Synthetic oligonucleotide
  Target: ATXN1; (-) strand; PAM type: NRG; PAM sequence: AAG
actatacctctgggatccac

SEQ ID NO: 42057 - DNA, 20 bp, Artificial Sequence
  Description of Artificial Sequence: Synthetic oligonucleotide
  Target: ATXN1; (-) strand; PAM type: NRG; PAM sequence: GGG
ctaggagagactatacctct

SEQ ID NO: 42058 - DNA, 20 bp, Artificial Sequence
  Description of Artificial Sequence: Synthetic oligonucleotide
  Target: ATXN1; (-) strand; PAM type: NRG; PAM sequence: TGG
cctaggagagactatacctc

SEQ ID NO: 42059 - DNA, 20 bp, Artificial Sequence
  Description of Artificial Sequence: Synthetic oligonucleotide
  Target: ATXN1; (-) strand; PAM type: NRG; PAM sequence: GAG
ggaattagctaatcctagga

SEQ ID NO: 42060 - DNA, 20 bp, Artificial Sequence
  Description of Artificial Sequence: Synthetic oligonucleotide
  Target: ATXN1; (-) strand; PAM type: NRG; PAM sequence: GAG
taggaattagctaatcctag

SEQ ID NO: 42061 - DNA, 20 bp, Artificial Sequence
  Description of Artificial Sequence: Synthetic oligonucleotide
  Target: ATXN1; (-) strand; PAM type: NRG; PAM sequence: AGG
tctaggaattagctaatcct

SEQ ID NO: 42062 - DNA, 20 bp, Artificial Sequence
  Description of Artificial Sequence: Synthetic oligonucleotide
  Target: ATXN1; (-) strand; PAM type: NRG; PAM sequence: TAG
ctctaggaattagctaatcc

SEQ ID NO: 42063 - DNA, 20 bp, Artificial Sequence
  Description of Artificial Sequence: Synthetic oligonucleotide
  Target: ATXN1; (-) strand; PAM type: NRG; PAM sequence: TAG
aaagtcaggcctctaggaat

SEQ ID NO: 42064 - DNA, 20 bp, Artificial Sequence
  Description of Artificial Sequence: Synthetic oligonucleotide
  Target: ATXN1; (-) strand; PAM type: NRG; PAM sequence: AGG
catataaaagtcaggcctct

SEQ ID NO: 42065 - DNA, 20 bp, Artificial Sequence
  Description of Artificial Sequence: Synthetic oligonucleotide
  Target: ATXN1; (-) strand; PAM type: NRG; PAM sequence: TAG
gcatataaaagtcaggcctc

SEQ ID NO: 42066 - DNA, 20 bp, Artificial Sequence
  Description of Artificial Sequence: Synthetic oligonucleotide
  Target: ATXN1; (-) strand; PAM type: NRG; PAM sequence: AGG
ttggtttgcatataaaagtc

SEQ ID NO: 42067 - DNA, 20 bp, Artificial Sequence
  Description of Artificial Sequence: Synthetic oligonucleotide
  Target: ATXN1; (-) strand; PAM type: NRG; PAM sequence: CAG
gttggtttgcatataaaagt

SEQ ID NO: 42068 - DNA, 20 bp, Artificial Sequence
  Description of Artificial Sequence: Synthetic oligonucleotide
  Target: ATXN1; (-) strand; PAM type: NRG; PAM sequence: AAG
actggttggtttgcatataa

SEQ ID NO: 42069 - DNA, 20 bp, Artificial Sequence
  Description of Artificial Sequence: Synthetic oligonucleotide
  Target: ATXN1; (-) strand; PAM type: NRG; PAM sequence: TGG
ggaattagctctggactggt

SEQ ID NO: 42070 - DNA, 20 bp, Artificial Sequence
  Description of Artificial Sequence: Synthetic oligonucleotide
  Target: ATXN1; (-) strand; PAM type: NRG; PAM sequence: TGG
cctaggaattagctctggac

SEQ ID NO: 42071 - DNA, 20 bp, Artificial Sequence
  Description of Artificial Sequence: Synthetic oligonucleotide
  Target: ATXN1; (-) strand; PAM type: NRG; PAM sequence: TGG
aggctcctaggaattagctc

SEQ ID NO: 42072 - DNA, 20 bp, Artificial Sequence
  Description of Artificial Sequence: Synthetic oligonucleotide
  Target: ATXN1; (-) strand; PAM type: NRG; PAM sequence: TAG
aaagtcaggctcctaggaat

SEQ ID NO: 42073 - DNA, 20 bp, Artificial Sequence
  Description of Artificial Sequence: Synthetic oligonucleotide
  Target: ATXN1; (-) strand; PAM type: NRG; PAM sequence: AGG
catatgaaagtcaggctcct

SEQ ID NO: 42074 - DNA, 20 bp, Artificial Sequence
  Description of Artificial Sequence: Synthetic oligonucleotide
  Target: ATXN1; (-) strand; PAM type: NRG; PAM sequence: TAG
gcatatgaaagtcaggctcc

SEQ ID NO: 42075 - DNA, 20 bp, Artificial Sequence
  Description of Artificial Sequence: Synthetic oligonucleotide
  Target: ATXN1; (-) strand; PAM type: NRG; PAM sequence: AGG
ttagtttgcatatgaaagtc

SEQ ID NO: 42076 - DNA, 20 bp, Artificial Sequence
  Description of Artificial Sequence: Synthetic oligonucleotide
  Target: ATXN1; (-) strand; PAM type: NRG; PAM sequence: CAG
gttagtttgcatatgaaagt

SEQ ID NO: 42077 - DNA, 20 bp, Artificial Sequence
  Description of Artificial Sequence: Synthetic oligonucleotide
  Target: ATXN1; (-) strand; PAM type: NRG; PAM sequence: AAG
actggttagtttgcatatga

SEQ ID NO: 42078 - DNA, 20 bp, Artificial Sequence
  Description of Artificial Sequence: Synthetic oligonucleotide
  Target: ATXN1; (-) strand; PAM type: NRG; PAM sequence: TAG
ggagtgggctctggactggt

SEQ ID NO: 42079 - DNA, 20 bp, Artificial Sequence
  Description of Artificial Sequence: Synthetic oligonucleotide
  Target: ATXN1; (-) strand; PAM type: NRG; PAM sequence: TGG
ctggggagtgggctctggac

SEQ ID NO: 42080 - DNA, 20 bp, Artificial Sequence
  Description of Artificial Sequence: Synthetic oligonucleotide
  Target: ATXN1; (-) strand; PAM type: NRG; PAM sequence: TGG
ggctgctggggagtgggctc

SEQ ID NO: 42081 - DNA, 20 bp, Artificial Sequence
  Description of Artificial Sequence: Synthetic oligonucleotide
  Target: ATXN1; (-) strand; PAM type: NRG; PAM sequence: GGG
ataggaggctgctggggagt

SEQ ID NO: 42082 - DNA, 20 bp, Artificial Sequence
  Description of Artificial Sequence: Synthetic oligonucleotide
  Target: ATXN1; (-) strand; PAM type: NRG; PAM sequence: TGG
tataggaggctgctggggag

SEQ ID NO: 42083 - DNA, 20 bp, Artificial Sequence
  Description of Artificial Sequence: Synthetic oligonucleotide
  Target: ATXN1; (-) strand; PAM type: NRG; PAM sequence: GAG
caatataggaggctgctggg

SEQ ID NO: 42084 - DNA, 20 bp, Artificial Sequence
  Description of Artificial Sequence: Synthetic oligonucleotide
  Target: ATXN1; (-) strand; PAM type: NRG; PAM sequence: GGG
accaatataggaggctgctg

SEQ ID NO: 42085 - DNA, 20 bp, Artificial Sequence
  Description of Artificial Sequence: Synthetic oligonucleotide
  Target: ATXN1; (-) strand; PAM type: NRG; PAM sequence: GGG
gaccaatataggaggctgct

SEQ ID NO: 42086 - DNA, 20 bp, Artificial Sequence
  Description of Artificial Sequence: Synthetic oligonucleotide
  Target: ATXN1; (-) strand; PAM type: NRG; PAM sequence: TGG
ggaccaatataggaggctgc

SEQ ID NO: 42087 - DNA, 20 bp, Artificial Sequence
  Description of Artificial Sequence: Synthetic oligonucleotide
  Target: ATXN1; (-) strand; PAM type: NRG; PAM sequence: AGG
gtgtgatggaccaatatagg

SEQ ID NO: 42088 - DNA, 20 bp, Artificial Sequence
  Description of Artificial Sequence: Synthetic oligonucleotide
  Target: ATXN1; (-) strand; PAM type: NRG; PAM sequence: GAG
agtgtgatggaccaatatag

SEQ ID NO: 42089 - DNA, 20 bp, Artificial Sequence
  Description of Artificial Sequence: Synthetic oligonucleotide
  Target: ATXN1; (-) strand; PAM type: NRG; PAM sequence: AGG
taagtgtgatggaccaatat

SEQ ID NO: 42090 - DNA, 20 bp, Artificial Sequence
  Description of Artificial Sequence: Synthetic oligonucleotide
  Target: ATXN1; (-) strand; PAM type: NRG; PAM sequence: TAG
ctaagtgtgatggaccaata

SEQ ID NO: 42091 - DNA, 20 bp, Artificial Sequence
  Description of Artificial Sequence: Synthetic oligonucleotide
  Target: ATXN1; (-) strand; PAM type: NRG; PAM sequence: TGG
gaaggcagccctaagtgtga

SEQ ID NO: 42092 - DNA, 20 bp, Artificial Sequence
  Description of Artificial Sequence: Synthetic oligonucleotide
  Target: ATXN1; (-) strand; PAM type: NRG; PAM sequence: AAG
aacagatggaaggcagccct

SEQ ID NO: 42093 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaacagatggaagg

SEQ ID NO: 42094 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaaaacagatgga

SEQ ID NO: 42095 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaacagatgg

SEQ ID NO: 42096 - DNA, 20 bp, Artificial Sequence
  Description of Artificial Sequence: Synthetic oligonucleotide
  Target: ATXN1; (-) strand; PAM type: NRG; PAM sequence: TGG
gacaaaaaaaaaaaaacaga

SEQ ID NO: 42097 - DNA, 20 bp, Artificial Sequence
  Description of Artificial Sequence: Synthetic oligonucleotide
  Target: ATXN1; (-) strand; PAM type: NRG; PAM sequence: CAG
ctcagacaaaaaaaaaaaaa

SEQ ID NO: 42098 - DNA, 20 bp, Artificial Sequence
  Description of Artificial Sequence: Synthetic oligonucleotide
  Target: ATXN1; (-) strand; PAM type: NRG; PAM sequence: CAG
cacacagcaagactctgtct

SEQ ID NO: 42099 - DNA, 20 bp, Artificial Sequence
  Description of Artificial Sequence: Synthetic oligonucleotide
  Target: ATXN1; (-) strand; PAM type: NRG; PAM sequence: AAG
tccagccttggacacacagc

SEQ ID NO: 42100 - DNA, 20 bp, Artificial Sequence
  Description of Artificial Sequence: Synthetic oligonucleotide
  Target: ATXN1; (-) strand; PAM type: NRG; PAM sequence: CAG
gcactccagccttggacaca

SEQ ID NO: 42101 - DNA, 20 bp, Artificial Sequence
  Description of Artificial Sequence: Synthetic oligonucleotide
  Target: ATXN1; (-) strand; PAM type: NRG; PAM sequence: TGG
aggccactgcactccagcct

SEQ ID NO: 42102 - DNA, 20 bp, Artificial Sequence
  Description of Artificial Sequence: Synthetic oligonucleotide
  Target: ATXN1; (-) strand; PAM type: NRG; PAM sequence: CAG
gagatcaggccactgcactc

SEQ ID NO: 42103 - DNA, 20 bp, Artificial Sequence
  Description of Artificial Sequence: Synthetic oligonucleotide
  Target: ATXN1; (-) strand; PAM type: NRG; PAM sequence: AGG
gattgcagtgagccgagatc

SEQ ID NO: 42104 - DNA, 20 bp, Artificial Sequence
  Description of Artificial Sequence: Synthetic oligonucleotide
  Target: ATXN1; (-) strand; PAM type: NRG; PAM sequence: CAG
ggattgcagtgagccgagat

SEQ ID NO: 42105 - DNA, 20 bp, Artificial Sequence
  Description of Artificial Sequence: Synthetic oligonucleotide
  Target: ATXN1; (-) strand; PAM type: NRG; PAM sequence: GAG
ggtggggattgcagtgagcc

SEQ ID NO: 42106 - DNA, 20 bp, Artificial Sequence
  Description of Artificial Sequence: Synthetic oligonucleotide
  Target: ATXN1; (-) strand; PAM type: NRG; PAM sequence: GAG
cgggaggtggggattgcagt

SEQ ID NO: 42107 - DNA, 20 bp, Artificial Sequence
  Description of Artificial Sequence: Synthetic oligonucleotide
  Target: ATXN1; (-) strand; PAM type: NRG; PAM sequence: CAG
aacccgggaggtggggattg

SEQ ID NO: 42108 - DNA, 20 bp, Artificial Sequence
  Description of Artificial Sequence: Synthetic oligonucleotide
  Target: ATXN1; (-) strand; PAM type: NRG; PAM sequence: GGG
ttgcatgaacccgggaggtg

SEQ ID NO: 42109 - DNA, 20 bp, Artificial Sequence
  Description of Artificial Sequence: Synthetic oligonucleotide
  Target: ATXN1; (-) strand; PAM type: NRG; PAM sequence: GGG
attgcatgaacccgggaggt

SEQ ID NO: 42110 - DNA, 20 bp, Artificial Sequence
  Description of Artificial Sequence: Synthetic oligonucleotide
  Target: ATXN1; (-) strand; PAM type: NRG; PAM sequence: TGG
aattgcatgaacccgggagg

SEQ ID NO: 42111 - DNA, 20 bp, Artificial Sequence
  Description of Artificial Sequence: Synthetic oligonucleotide
  Target: ATXN1; (-) strand; PAM type: NRG; PAM sequence: AGG
gagaattgcatgaacccggg

SEQ ID NO: 42112 - DNA, 20 bp, Artificial Sequence
  Description of Artificial Sequence: Synthetic oligonucleotide
  Target: ATXN1; (-) strand; PAM type: NRG; PAM sequence: GAG
ggagaattgcatgaacccgg

SEQ ID NO: 42113 - DNA, 20 bp, Artificial Sequence
  Description of Artificial Sequence: Synthetic oligonucleotide
  Target: ATXN1; (-) strand; PAM type: NRG; PAM sequence: GGG
taggagaattgcatgaaccc

SEQ ID NO: 42114 - DNA, 20 bp, Artificial Sequence
  Description of Artificial Sequence: Synthetic oligonucleotide
  Target: ATXN1; (-) strand; PAM type: NRG; PAM sequence: CGG
gtaggagaattgcatgaacc

SEQ ID NO: 42115 - DNA, 20 bp, Artificial Sequence
  Description of Artificial Sequence: Synthetic oligonucleotide
  Target: ATXN1; (-) strand; PAM type: NRG; PAM sequence: GAG
tactccagaggctgaggtag

SEQ ID NO: 42116 - DNA, 20 bp, Artificial Sequence
  Description of Artificial Sequence: Synthetic oligonucleotide
  Target: ATXN1; (-) strand; PAM type: NRG; PAM sequence: AGG
gctactccagaggctgaggt

SEQ ID NO: 42117 - DNA, 20 bp, Artificial Sequence
  Description of Artificial Sequence: Synthetic oligonucleotide
  Target: ATXN1; (-) strand; PAM type: NRG; PAM sequence: TAG
agctactccagaggctgagg

SEQ ID NO: 42118 - DNA, 20 bp, Artificial Sequence
  Description of Artificial Sequence: Synthetic oligonucleotide
  Target: ATXN1; (-) strand; PAM type: NRG; PAM sequence: AGG
cccagctactccagaggctg

SEQ ID NO: 42119 - DNA, 20 bp, Artificial Sequence
  Description of Artificial Sequence: Synthetic oligonucleotide
  Target: ATXN1; (-) strand; PAM type: NRG; PAM sequence: GAG
tcccagctactccagaggct

SEQ ID NO: 42120 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctactccag

SEQ ID NO: 42121 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctactcca

SEQ ID NO: 42122 - DNA, 20 bp, Artificial Sequence
  Description of Artificial Sequence: Synthetic oligonucleotide
  Target: ATXN1; (-) strand; PAM type: NRG; PAM sequence: CAG
gcctgtaatcccagctactc

SEQ ID NO: 42123 - DNA, 20 bp, Artificial Sequence
  Description of Artificial Sequence: Synthetic oligonucleotide
  Target: ATXN1; (-) strand; PAM type: NRG; PAM sequence: CAG
gtggtgtgtgcctgtaatcc

SEQ ID NO: 42124 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccgggcatgg

SEQ ID NO: 42125 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagccgggca

SEQ ID NO: 42126 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaattagcc

SEQ ID NO: 42127 - DNA, 20 bp, Artificial Sequence
  Description of Artificial Sequence: Synthetic oligonucleotide
  Target: ATXN1; (-) strand; PAM type: NRG; PAM sequence: CGG
ctaaaaatacaaaaattagc

SEQ ID NO: 42128 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatacaaaaat

SEQ ID NO: 42129 - DNA, 20 bp, Artificial Sequence
  Description of Artificial Sequence: Synthetic oligonucleotide
  Target: ATXN1; (-) strand; PAM type: NRG; PAM sequence: TGG
cgagaccggcctggccaaca

SEQ ID NO: 42130 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgagaccggcc

SEQ ID NO: 42131 - DNA, 20 bp, Artificial Sequence
  Description of Artificial Sequence: Synthetic oligonucleotide
  Target: ATXN1; (-) strand; PAM type: NRG; PAM sequence: CGG
agaggtcaggagttcgagac

SEQ ID NO: 42132 - DNA, 20 bp, Artificial Sequence
  Description of Artificial Sequence: Synthetic oligonucleotide
  Target: ATXN1; (-) strand; PAM type: NRG; PAM sequence: GAG
tcaccagaggtcaggagttc

SEQ ID NO: 42133 - DNA, 20 bp, Artificial Sequence
  Description of Artificial Sequence: Synthetic oligonucleotide
  Target: ATXN1; (-) strand; PAM type: NRG; PAM sequence: GAG
ggtggatcaccagaggtcag

SEQ ID NO: 42134 - DNA, 20 bp, Artificial Sequence
  Description of Artificial Sequence: Synthetic oligonucleotide
  Target: ATXN1; (-) strand; PAM type: NRG; PAM sequence: AGG
cgggtggatcaccagaggtc

SEQ ID NO: 42135 - DNA, 20 bp, Artificial Sequence
  Description of Artificial Sequence: Synthetic oligonucleotide
  Target: ATXN1; (-) strand; PAM type: NRG; PAM sequence: CAG
gcgggtggatcaccagaggt

SEQ ID NO: 42136 - DNA, 20 bp, Artificial Sequence
  Description of Artificial Sequence: Synthetic oligonucleotide
  Target: ATXN1; (-) strand; PAM type: NRG; PAM sequence: AGG
tgaggcgggtggatcaccag

SEQ ID NO: 42137 - DNA, 20 bp, Artificial Sequence
  Description of Artificial Sequence: Synthetic oligonucleotide
  Target: ATXN1; (-) strand; PAM type: NRG; PAM sequence: GAG
ctgaggcgggtggatcacca

SEQ ID NO: 42138 - DNA, 20 bp, Artificial Sequence
  Description of Artificial Sequence: Synthetic oligonucleotide
  Target: ATXN1; (-) strand; PAM type: NRG; PAM sequence: CAG
ggctgaggcgggtggatcac

SEQ ID NO: 42139 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggctgaggcggg

SEQ ID NO: 42140 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggctgaggc

SEQ ID NO: 42141 - DNA, 20 bp, Artificial Sequence
  Description of Artificial Sequence: Synthetic oligonucleotide
  Target: ATXN1; (-) strand; PAM type: NRG; PAM sequence: CGG
agcactttgggaggctgagg

SEQ ID NO: 42142 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggctg

SEQ ID NO: 42143 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggct

SEQ ID NO: 42144 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 42145 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 42146 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagcacttt

SEQ ID NO: 42147 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagcactt

SEQ ID NO: 42148 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatcc

SEQ ID NO: 42149 - DNA, 20 bp, Artificial Sequence
  Description of Artificial Sequence: Synthetic oligonucleotide
  Target: ATXN1; (-) strand; PAM type: NRG; PAM sequence: TGG
ggtggaagggctgggcacag

SEQ ID NO: 42150 - DNA, 20 bp, Artificial Sequence
  Description of Artificial Sequence: Synthetic oligonucleotide
  Target: ATXN1; (-) strand; PAM type: NRG; PAM sequence: CAG
acaggtggaagggctgggca

SEQ ID NO: 42151 - DNA, 20 bp, Artificial Sequence
  Description of Artificial Sequence: Synthetic oligonucleotide
  Target: ATXN1; (-) strand; PAM type: NRG; PAM sequence: GGG
tcaatacaggtggaagggct

SEQ ID NO: 42152 - DNA, 20 bp, Artificial Sequence
  Description of Artificial Sequence: Synthetic oligonucleotide
  Target: ATXN1; (-) strand; PAM type: NRG; PAM sequence: TGG
atcaatacaggtggaagggc

SEQ ID NO: 42153 - DNA, 20 bp, Artificial Sequence
  Description of Artificial Sequence: Synthetic oligonucleotide
  Target: ATXN1; (-) strand; PAM type: NRG; PAM sequence: GGG
ggtgatcaatacaggtggaa

SEQ ID NO: 42154 - DNA, 20 bp, Artificial Sequence
  Description of Artificial Sequence: Synthetic oligonucleotide
  Target: ATXN1; (-) strand; PAM type: NRG; PAM sequence: AGG
gggtgatcaatacaggtgga

SEQ ID NO: 42155 - DNA, 20 bp, Artificial Sequence
  Description of Artificial Sequence: Synthetic oligonucleotide
  Target: ATXN1; (-) strand; PAM type: NRG; PAM sequence: AAG
ggggtgatcaatacaggtgg

SEQ ID NO: 42156 - DNA, 20 bp, Artificial Sequence
  Description of Artificial Sequence: Synthetic oligonucleotide
  Target: ATXN1; (-) strand; PAM type: NRG; PAM sequence: TGG
gctggggtgatcaatacagg

SEQ ID NO: 42157 - DNA, 20 bp, Artificial Sequence
  Description of Artificial Sequence: Synthetic oligonucleotide
  Target: ATXN1; (-) strand; PAM type: NRG; PAM sequence: AGG
ggtgctggggtgatcaatac

SEQ ID NO: 42158 - DNA, 20 bp, Artificial Sequence
  Description of Artificial Sequence: Synthetic oligonucleotide
  Target: ATXN1; (-) strand; PAM type: NRG; PAM sequence: CAG
tggtgctggggtgatcaata

SEQ ID NO: 42159 - DNA, 20 bp, Artificial Sequence
  Description of Artificial Sequence: Synthetic oligonucleotide
  Target: ATXN1; (-) strand; PAM type: NRG; PAM sequence: GGG
ttgtctggctgctggtgctg

SEQ ID NO: 42160 - DNA, 20 bp, Artificial Sequence
  Description of Artificial Sequence: Synthetic oligonucleotide
  Target: ATXN1; (-) strand; PAM type: NRG; PAM sequence: GGG
gttgtctggctgctggtgct

SEQ ID NO: 42161 - DNA, 20 bp, Artificial Sequence
  Description of Artificial Sequence: Synthetic oligonucleotide
  Target: ATXN1; (-) strand; PAM type: NRG; PAM sequence: TGG
agttgtctggctgctggtgc

SEQ ID NO: 42162 - DNA, 20 bp, Artificial Sequence
  Description of Artificial Sequence: Synthetic oligonucleotide
  Target: ATXN1; (-) strand; PAM type: NRG; PAM sequence: TGG
gtccttagttgtctggctgc

SEQ ID NO: 42163 - DNA, 20 bp, Artificial Sequence
  Description of Artificial Sequence: Synthetic oligonucleotide
  Target: ATXN1; (-) strand; PAM type: NRG; PAM sequence: TGG
aggggctgtccttagttgtc

SEQ ID NO: 42164 - DNA, 20 bp, Artificial Sequence
  Description of Artificial Sequence: Synthetic oligonucleotide
  Target: ATXN1; (-) strand; PAM type: NRG; PAM sequence: TAG
tggggtgtaggggctgtcct

SEQ ID NO: 42165 - DNA, 20 bp, Artificial Sequence
  Description of Artificial Sequence: Synthetic oligonucleotide
  Target: ATXN1; (-) strand; PAM type: NRG; PAM sequence: GGG
cagtgtgctctggggtgtag

SEQ ID NO: 42166 - DNA, 20 bp, Artificial Sequence
  Description of Artificial Sequence: Synthetic oligonucleotide
  Target: ATXN1; (-) strand; PAM type: NRG; PAM sequence: GGG
ccagtgtgctctggggtgta

SEQ ID NO: 42167 - DNA, 20 bp, Artificial Sequence
  Description of Artificial Sequence: Synthetic oligonucleotide
  Target: ATXN1; (-) strand; PAM type: NRG; PAM sequence: AGG
tccagtgtgctctggggtgt

SEQ ID NO: 42168 - DNA, 20 bp, Artificial Sequence
  Description of Artificial Sequence: Synthetic oligonucleotide
  Target: ATXN1; (-) strand; PAM type: NRG; PAM sequence: TAG
ttccagtgtgctctggggtg

SEQ ID NO: 42169 - DNA, 20 bp, Artificial Sequence
  Description of Artificial Sequence: Synthetic oligonucleotide
  Target: ATXN1; (-) strand; PAM type: NRG; PAM sequence: GGG
gataattccagtgtgctctg

SEQ ID NO: 42170 - DNA, 20 bp, Artificial Sequence
  Description of Artificial Sequence: Synthetic oligonucleotide
  Target: ATXN1; (-) strand; PAM type: NRG; PAM sequence: GGG
ggataattccagtgtgctct

SEQ ID NO: 42171 - DNA, 20 bp, Artificial Sequence
  Description of Artificial Sequence: Synthetic oligonucleotide
  Target: ATXN1; (-) strand; PAM type: NRG; PAM sequence: TGG
tggataattccagtgtgctc

SEQ ID NO: 42172 - DNA, 20 bp, Artificial Sequence
  Description of Artificial Sequence: Synthetic oligonucleotide
  Target: ATXN1; (-) strand; PAM type: NRG; PAM sequence: CAG
ttggttagagtggataattc

SEQ ID NO: 42173 - DNA, 20 bp, Artificial Sequence
  Description of Artificial Sequence: Synthetic oligonucleotide
  Target: ATXN1; (-) strand; PAM type: NRG; PAM sequence: TGG
gggtttaggattggttagag

SEQ ID NO: 42174 - DNA, 20 bp, Artificial Sequence
  Description of Artificial Sequence: Synthetic oligonucleotide
  Target: ATXN1; (-) strand; PAM type: NRG; PAM sequence: GAG
aacgggtttaggattggtta

SEQ ID NO: 42175 - DNA, 20 bp, Artificial Sequence
  Description of Artificial Sequence: Synthetic oligonucleotide
  Target: ATXN1; (-) strand; PAM type: NRG; PAM sequence: TAG
taaacgggtttaggattggt

SEQ ID NO: 42176 - DNA, 20 bp, Artificial Sequence
  Description of Artificial Sequence: Synthetic oligonucleotide
  Target: ATXN1; (-) strand; PAM type: NRG; PAM sequence: TGG
agggtaaacgggtttaggat

SEQ ID NO: 42177 - DNA, 20 bp, Artificial Sequence
  Description of Artificial Sequence: Synthetic oligonucleotide
  Target: ATXN1; (-) strand; PAM type: NRG; PAM sequence: AGG
gaggcagggtaaacgggttt

SEQ ID NO: 42178 - DNA, 20 bp, Artificial Sequence
  Description of Artificial Sequence: Synthetic oligonucleotide
  Target: ATXN1; (-) strand; PAM type: NRG; PAM sequence: TAG
ggaggcagggtaaacgggtt

SEQ ID NO: 42179 - DNA, 20 bp, Artificial Sequence
  Description of Artificial Sequence: Synthetic oligonucleotide
  Target: ATXN1; (-) strand; PAM type: NRG; PAM sequence: GGG
tcatgggaggcagggtaaac

SEQ ID NO: 42180 - DNA, 20 bp, Artificial Sequence
  Description of Artificial Sequence: Synthetic oligonucleotide
  Target: ATXN1; (-) strand; PAM type: NRG; PAM sequence: CGG
ttcatgggaggcagggtaaa

SEQ ID NO: 42181 - DNA, 20 bp, Artificial Sequence
  Description of Artificial Sequence: Synthetic oligonucleotide
  Target: ATXN1; (-) strand; PAM type: NRG; PAM sequence: GGG
ttgtggtttcatgggaggca

SEQ ID NO: 42182 - DNA, 20 bp, Artificial Sequence
  Description of Artificial Sequence: Synthetic oligonucleotide
  Target: ATXN1; (-) strand; PAM type: NRG; PAM sequence: AGG
attgtggtttcatgggaggc

SEQ ID NO: 42183 - DNA, 20 bp, Artificial Sequence
  Description of Artificial Sequence: Synthetic oligonucleotide
  Target: ATXN1; (-) strand; PAM type: NRG; PAM sequence: CAG
tattgtggtttcatgggagg

SEQ ID NO: 42184 - DNA, 20 bp, Artificial Sequence
  Description of Artificial Sequence: Synthetic oligonucleotide
  Target: ATXN1; (-) strand; PAM type: NRG; PAM sequence: AGG
ctttattgtggtttcatggg

SEQ ID NO: 42185 - DNA, 20 bp, Artificial Sequence
  Description of Artificial Sequence: Synthetic oligonucleotide
  Target: ATXN1; (-) strand; PAM type: NRG; PAM sequence: GAG
cctttattgtggtttcatgg

SEQ ID NO: 42186 - DNA, 20 bp, Artificial Sequence
  Description of Artificial Sequence: Synthetic oligonucleotide
  Target: ATXN1; (-) strand; PAM type: NRG; PAM sequence: GGG
agcctttattgtggtttcat

SEQ ID NO: 42187 - DNA, 20 bp, Artificial Sequence
  Description of Artificial Sequence: Synthetic oligonucleotide
  Target: ATXN1; (-) strand; PAM type: NRG; PAM sequence: TGG
cagcctttattgtggtttca

SEQ ID NO: 42188 - DNA, 20 bp, Artificial Sequence
  Description of Artificial Sequence: Synthetic oligonucleotide
  Target: ATXN1; (-) strand; PAM type: NRG; PAM sequence: TGG
gcaaacaacagcctttattg

SEQ ID NO: 42189 - DNA, 20 bp, Artificial Sequence
  Description of Artificial Sequence: Synthetic oligonucleotide
  Target: ATXN1; (-) strand; PAM type: NRG; PAM sequence: CAG
aggggaaatgtggcaaacaa

SEQ ID NO: 42190 - DNA, 20 bp, Artificial Sequence
  Description of Artificial Sequence: Synthetic oligonucleotide
  Target: ATXN1; (-) strand; PAM type: NRG; PAM sequence: TGG
ggagggagtgaggggaaatg

SEQ ID NO: 42191 - DNA, 20 bp, Artificial Sequence
  Description of Artificial Sequence: Synthetic oligonucleotide
  Target: ATXN1; (-) strand; PAM type: NRG; PAM sequence: GGG
caggaggtggagggagtgag

SEQ ID NO: 42192 - DNA, 20 bp, Artificial Sequence
  Description of Artificial Sequence: Synthetic oligonucleotide
  Target: ATXN1; (-) strand; PAM type: NRG; PAM sequence: GGG
tcaggaggtggagggagtga

SEQ ID NO: 42193 - DNA, 20 bp, Artificial Sequence
  Description of Artificial Sequence: Synthetic oligonucleotide
  Target: ATXN1; (-) strand; PAM type: NRG; PAM sequence: AGG
gtcaggaggtggagggagtg

SEQ ID NO: 42194 - DNA, 20 bp, Artificial Sequence
  Description of Artificial Sequence: Synthetic oligonucleotide
  Target: ATXN1; (-) strand; PAM type: NRG; PAM sequence: GAG
ggtcaggaggtggagggagt

SEQ ID NO: 42195 - DNA, 20 bp, Artificial Sequence
  Description of Artificial Sequence: Synthetic oligonucleotide
  Target: ATXN1; (-) strand; PAM type: NRG; PAM sequence: GAG
ggtgggtcaggaggtggagg

SEQ ID NO: 42196 - DNA, 20 bp, Artificial Sequence
  Description of Artificial Sequence: Synthetic oligonucleotide
  Target: ATXN1; (-) strand; PAM type: NRG; PAM sequence: GGG
caggtgggtcaggaggtgga

SEQ ID NO: 42197 - DNA, 20 bp, Artificial Sequence
  Description of Artificial Sequence: Synthetic oligonucleotide
  Target: ATXN1; (-) strand; PAM type: NRG; PAM sequence: AGG
ccaggtgggtcaggaggtgg

SEQ ID NO: 42198 - DNA, 20 bp, Artificial Sequence
  Description of Artificial Sequence: Synthetic oligonucleotide
  Target: ATXN1; (-) strand; PAM type: NRG; PAM sequence: GAG
cccaggtgggtcaggaggtg

SEQ ID NO: 42199 - DNA, 20 bp, Artificial Sequence
  Description of Artificial Sequence: Synthetic oligonucleotide
  Target: ATXN1; (-) strand; PAM type: NRG; PAM sequence: TGG
gccccaggtgggtcaggagg

SEQ ID NO: 42200 - DNA, 20 bp, Artificial Sequence
  Description of Artificial Sequence: Synthetic oligonucleotide
  Target: ATXN1; (-) strand; PAM type: NRG; PAM sequence: AGG
gaagccccaggtgggtcagg

SEQ ID NO: 42201 - DNA, 20 bp, Artificial Sequence
  Description of Artificial Sequence: Synthetic oligonucleotide
  Target: ATXN1; (-) strand; PAM type: NRG; PAM sequence: GAG
ggaagccccaggtgggtcag

SEQ ID NO: 42202 - DNA, 20 bp, Artificial Sequence
  Description of Artificial Sequence: Synthetic oligonucleotide
  Target: ATXN1; (-) strand; PAM type: NRG; PAM sequence: AGG
ggggaagccccaggtgggtc

SEQ ID NO: 42203 - DNA, 20 bp, Artificial Sequence
  Description of Artificial Sequence: Synthetic oligonucleotide
  Target: ATXN1; (-) strand; PAM type: NRG; PAM sequence: CAG
tggggaagccccaggtgggt

SEQ ID NO: 42204 - DNA, 20 bp, Artificial Sequence
  Description of Artificial Sequence: Synthetic oligonucleotide
  Target: ATXN1; (-) strand; PAM type: NRG; PAM sequence: GGG
cacctggggaagccccaggt

SEQ ID NO: 42205 - DNA, 20 bp, Artificial Sequence
  Description of Artificial Sequence: Synthetic oligonucleotide
  Target: ATXN1; (-) strand; PAM type: NRG; PAM sequence: TGG
gcacctggggaagccccagg

SEQ ID NO: 42206 - DNA, 20 bp, Artificial Sequence
  Description of Artificial Sequence: Synthetic oligonucleotide
  Target: ATXN1; (-) strand; PAM type: NRG; PAM sequence: AGG
ggggcacctggggaagcccc

SEQ ID NO: 42207 - DNA, 20 bp, Artificial Sequence
  Description of Artificial Sequence: Synthetic oligonucleotide
  Target: ATXN1; (-) strand; PAM type: NRG; PAM sequence: CAG
gggggcacctggggaagccc

SEQ ID NO: 42208 - DNA, 20 bp, Artificial Sequence
  Description of Artificial Sequence: Synthetic oligonucleotide
  Target: ATXN1; (-) strand; PAM type: NRG; PAM sequence: AAG
aaagtggggggcacctgggg

SEQ ID NO: 42209 - DNA, 20 bp, Artificial Sequence
  Description of Artificial Sequence: Synthetic oligonucleotide
  Target: ATXN1; (-) strand; PAM type: NRG; PAM sequence: GGG
cgtaaagtggggggcacctg

SEQ ID NO: 42210 - DNA, 20 bp, Artificial Sequence
  Description of Artificial Sequence: Synthetic oligonucleotide
  Target: ATXN1; (-) strand; PAM type: NRG; PAM sequence: GGG
ccgtaaagtggggggcacct

SEQ ID NO: 42211 - DNA, 20 bp, Artificial Sequence
  Description of Artificial Sequence: Synthetic oligonucleotide
  Target: ATXN1; (-) strand; PAM type: NRG; PAM sequence: TGG
accgtaaagtggggggcacc

SEQ ID NO: 42212 - DNA, 20 bp, Artificial Sequence
  Description of Artificial Sequence: Synthetic oligonucleotide
  Target: ATXN1; (-) strand; PAM type: NRG; PAM sequence: GGG
gtagaacaccgtaaagtggg

SEQ ID NO: 42213 - DNA, 20 bp, Artificial Sequence
  Description of Artificial Sequence: Synthetic oligonucleotide
  Target: ATXN1; (-) strand; PAM type: NRG; PAM sequence: GGG
tgtagaacaccgtaaagtgg

SEQ ID NO: 42214 - DNA, 20 bp, Artificial Sequence
  Description of Artificial Sequence: Synthetic oligonucleotide
  Target: ATXN1; (-) strand; PAM type: NRG; PAM sequence: GGG
gtgtagaacaccgtaaagtg

SEQ ID NO: 42215 - DNA, 20 bp, Artificial Sequence
  Description of Artificial Sequence: Synthetic oligonucleotide
  Target: ATXN1; (-) strand; PAM type: NRG; PAM sequence: GGG
ggtgtagaacaccgtaaagt

SEQ ID NO: 42216 - DNA, 20 bp, Artificial Sequence
  Description of Artificial Sequence: Synthetic oligonucleotide
  Target: ATXN1; (-) strand; PAM type: NRG; PAM sequence: TGG
aggtgtagaacaccgtaaag

SEQ ID NO: 42217 - DNA, 20 bp, Artificial Sequence
  Description of Artificial Sequence: Synthetic oligonucleotide
  Target: ATXN1; (-) strand; PAM type: NRG; PAM sequence: AAG
aagaggtgtagaacaccgta

SEQ ID NO: 42218 - DNA, 20 bp, Artificial Sequence
  Description of Artificial Sequence: Synthetic oligonucleotide
  Target: ATXN1; (-) strand; PAM type: NRG; PAM sequence: TAG
gcactctacaccaagaggtg

SEQ ID NO: 42219 - DNA, 20 bp, Artificial Sequence
  Description of Artificial Sequence: Synthetic oligonucleotide
  Target: ATXN1; (-) strand; PAM type: NRG; PAM sequence: AGG
aaagggcactctacaccaag

SEQ ID NO: 42220 - DNA, 20 bp, Artificial Sequence
  Description of Artificial Sequence: Synthetic oligonucleotide
  Target: ATXN1; (-) strand; PAM type: NRG; PAM sequence: GAG
gaaagggcactctacaccaa

SEQ ID NO: 42221 - DNA, 20 bp, Artificial Sequence
  Description of Artificial Sequence: Synthetic oligonucleotide
  Target: ATXN1; (-) strand; PAM type: NRG; PAM sequence: AAG
aggaaagggcactctacacc

SEQ ID NO: 42222 - DNA, 20 bp, Artificial Sequence
  Description of Artificial Sequence: Synthetic oligonucleotide
  Target: ATXN1; (-) strand; PAM type: NRG; PAM sequence: GGG
tctctgatcccaagaggaaa

SEQ ID NO: 42223 - DNA, 20 bp, Artificial Sequence
  Description of Artificial Sequence: Synthetic oligonucleotide
  Target: ATXN1; (-) strand; PAM type: NRG; PAM sequence: AGG
ctctctgatcccaagaggaa

SEQ ID NO: 42224 - DNA, 20 bp, Artificial Sequence
  Description of Artificial Sequence: Synthetic oligonucleotide
  Target: ATXN1; (-) strand; PAM type: NRG; PAM sequence: AAG
actctctgatcccaagagga

SEQ ID NO: 42225 - DNA, 20 bp, Artificial Sequence
  Description of Artificial Sequence: Synthetic oligonucleotide
  Target: ATXN1; (-) strand; PAM type: NRG; PAM sequence: AGG
ttatactctctgatcccaag

SEQ ID NO: 42226 - DNA, 20 bp, Artificial Sequence
  Description of Artificial Sequence: Synthetic oligonucleotide
  Target: ATXN1; (-) strand; PAM type: NRG; PAM sequence: GAG
tttatactctctgatcccaa

SEQ ID NO: 42227 - DNA, 20 bp, Artificial Sequence
  Description of Artificial Sequence: Synthetic oligonucleotide
  Target: ATXN1; (-) strand; PAM type: NRG; PAM sequence: AAG
tttttatactctctgatccc

SEQ ID NO: 42228 - DNA, 20 bp, Artificial Sequence
  Description of Artificial Sequence: Synthetic oligonucleotide
  Target: ATXN1; (-) strand; PAM type: NRG; PAM sequence: GAG
agcagacaactctctttgac

SEQ ID NO: 42229 - DNA, 20 bp, Artificial Sequence
  Description of Artificial Sequence: Synthetic oligonucleotide
  Target: ATXN1; (-) strand; PAM type: NRG; PAM sequence: CAG
aaggccaacagatagatcag

SEQ ID NO: 42230 - DNA, 20 bp, Artificial Sequence
  Description of Artificial Sequence: Synthetic oligonucleotide
  Target: ATXN1; (-) strand; PAM type: NRG; PAM sequence: CAG
gataaggccaacagatagat

SEQ ID NO: 42231 - DNA, 20 bp, Artificial Sequence
  Description of Artificial Sequence: Synthetic oligonucleotide
  Target: ATXN1; (-) strand; PAM type: NRG; PAM sequence: TAG
ggtatgataaggccaacaga

SEQ ID NO: 42232 - DNA, 20 bp, Artificial Sequence
  Description of Artificial Sequence: Synthetic oligonucleotide
  Target: ATXN1; (-) strand; PAM type: NRG; PAM sequence: CAG
tttaggtatgataaggccaa

SEQ ID NO: 42233 - DNA, 20 bp, Artificial Sequence
  Description of Artificial Sequence: Synthetic oligonucleotide
  Target: ATXN1; (-) strand; PAM type: NRG; PAM sequence: AGG
cttattatttaggtatgata

SEQ ID NO: 42234 - DNA, 20 bp, Artificial Sequence
  Description of Artificial Sequence: Synthetic oligonucleotide
  Target: ATXN1; (-) strand; PAM type: NRG; PAM sequence: AAG
tcttattatttaggtatgat

SEQ ID NO: 42235 - DNA, 20 bp, Artificial Sequence
  Description of Artificial Sequence: Synthetic oligonucleotide
  Target: ATXN1; (-) strand; PAM type: NRG; PAM sequence: AGG
tatataatgtcttattattt

SEQ ID NO: 42236 - DNA, 20 bp, Artificial Sequence
  Description of Artificial Sequence: Synthetic oligonucleotide
  Target: ATXN1; (-) strand; PAM type: NRG; PAM sequence: TAG
atatataatgtcttattatt

SEQ ID NO: 42237 - DNA, 20 bp, Artificial Sequence
  Description of Artificial Sequence: Synthetic oligonucleotide
  Target: ATXN1; (-) strand; PAM type: NRG; PAM sequence: CGG
ctgggcaacatagcaaggcc

SEQ ID NO: 42238 - DNA, 20 bp, Artificial Sequence
  Description of Artificial Sequence: Synthetic oligonucleotide
  Target: ATXN1; (-) strand; PAM type: NRG; PAM sequence: AGG
caagcctgggcaacatagca

SEQ ID NO: 42239 - DNA, 20 bp, Artificial Sequence
  Description of Artificial Sequence: Synthetic oligonucleotide
  Target: ATXN1; (-) strand; PAM type: NRG; PAM sequence: AAG
tcaagcctgggcaacatagc

SEQ ID NO: 42240 - DNA, 20 bp, Artificial Sequence
  Description of Artificial Sequence: Synthetic oligonucleotide
  Target: ATXN1; (-) strand; PAM type: NRG; PAM sequence: TAG
gcactcaagcctgggcaaca

SEQ ID NO: 42241 - DNA, 20 bp, Artificial Sequence
  Description of Artificial Sequence: Synthetic oligonucleotide
  Target: ATXN1; (-) strand; PAM type: NRG; PAM sequence: GGG
ctatcactgcactcaagcct

SEQ ID NO: 42242 - DNA, 20 bp, Artificial Sequence
  Description of Artificial Sequence: Synthetic oligonucleotide
  Target: ATXN1; (-) strand; PAM type: NRG; PAM sequence: TGG
actatcactgcactcaagcc

SEQ ID NO: 42243 - DNA, 20 bp, Artificial Sequence
  Description of Artificial Sequence: Synthetic oligonucleotide
  Target: ATXN1; (-) strand; PAM type: NRG; PAM sequence: AAG
ctgtgactatcactgcactc

SEQ ID NO: 42244 - DNA, 20 bp, Artificial Sequence
  Description of Artificial Sequence: Synthetic oligonucleotide
  Target: ATXN1; (-) strand; PAM type: NRG; PAM sequence: TGG
ttcgaggctgtagtgagcta

SEQ ID NO: 42245 - DNA, 20 bp, Artificial Sequence
  Description of Artificial Sequence: Synthetic oligonucleotide
  Target: ATXN1; (-) strand; PAM type: NRG; PAM sequence: GAG
caggagttcgaggctgtagt

SEQ ID NO: 42246 - DNA, 20 bp, Artificial Sequence
  Description of Artificial Sequence: Synthetic oligonucleotide
  Target: ATXN1; (-) strand; PAM type: NRG; PAM sequence: TAG
agcccaggagttcgaggctg

SEQ ID NO: 42247 - DNA, 20 bp, Artificial Sequence
  Description of Artificial Sequence: Synthetic oligonucleotide
  Target: ATXN1; (-) strand; PAM type: NRG; PAM sequence: AGG
cacttgagcccaggagttcg

SEQ ID NO: 42248 - DNA, 20 bp, Artificial Sequence
  Description of Artificial Sequence: Synthetic oligonucleotide
  Target: ATXN1; (-) strand; PAM type: NRG; PAM sequence: GAG
tcacttgagcccaggagttc

SEQ ID NO: 42249 - DNA, 20 bp, Artificial Sequence
  Description of Artificial Sequence: Synthetic oligonucleotide
  Target: ATXN1; (-) strand; PAM type: NRG; PAM sequence: GAG
ggaggatcacttgagcccag

SEQ ID NO: 42250 - DNA, 20 bp, Artificial Sequence
  Description of Artificial Sequence: Synthetic oligonucleotide
  Target: ATXN1; (-) strand; PAM type: NRG; PAM sequence: AGG
caggaggatcacttgagccc

SEQ ID NO: 42251 - DNA, 20 bp, Artificial Sequence
  Description of Artificial Sequence: Synthetic oligonucleotide
  Target: ATXN1; (-) strand; PAM type: NRG; PAM sequence: CAG
gcaggaggatcacttgagcc

SEQ ID NO: 42252 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggaggatcactt

SEQ ID NO: 42253 - DNA, 20 bp, Artificial Sequence
  Description of Artificial Sequence: Synthetic oligonucleotide
  Target: ATXN1; (-) strand; PAM type: NRG; PAM sequence: AGG
actccagagactgaggcagg

SEQ ID NO: 42254 - DNA, 20 bp, Artificial Sequence
  Description of Artificial Sequence: Synthetic oligonucleotide
  Target: ATXN1; (-) strand; PAM type: NRG; PAM sequence: GAG
tactccagagactgaggcag

SEQ ID NO: 42255 - DNA, 20 bp, Artificial Sequence
  Description of Artificial Sequence: Synthetic oligonucleotide
  Target: ATXN1; (-) strand; PAM type: NRG; PAM sequence: AGG
gctactccagagactgaggc

SEQ ID NO: 42256 - DNA, 20 bp, Artificial Sequence
  Description of Artificial Sequence: Synthetic oligonucleotide
  Target: ATXN1; (-) strand; PAM type: NRG; PAM sequence: CAG
agctactccagagactgagg

SEQ ID NO: 42257 - DNA, 20 bp, Artificial Sequence
  Description of Artificial Sequence: Synthetic oligonucleotide
  Target: ATXN1; (-) strand; PAM type: NRG; PAM sequence: AGG
cccagctactccagagactg

SEQ ID NO: 42258 - DNA, 20 bp, Artificial Sequence
  Description of Artificial Sequence: Synthetic oligonucleotide
  Target: ATXN1; (-) strand; PAM type: NRG; PAM sequence: GAG
tcccagctactccagagact

SEQ ID NO: 42259 - DNA, 20 bp, Artificial Sequence
  Description of Artificial Sequence: Synthetic oligonucleotide
  Target: ATXN1; (-) strand; PAM type: NRG; PAM sequence: GAG
cttcggtcccagctactcca

SEQ ID NO: 42260 - DNA, 20 bp, Artificial Sequence
  Description of Artificial Sequence: Synthetic oligonucleotide
  Target: ATXN1; (-) strand; PAM type: NRG; PAM sequence: CAG
gccttcggtcccagctactc

SEQ ID NO: 42261 - DNA, 20 bp, Artificial Sequence
  Description of Artificial Sequence: Synthetic oligonucleotide
  Target: ATXN1; (-) strand; PAM type: NRG; PAM sequence: CAG
gtggtatatgccttcggtcc

SEQ ID NO: 42262 - DNA, 20 bp, Artificial Sequence
  Description of Artificial Sequence: Synthetic oligonucleotide
  Target: ATXN1; (-) strand; PAM type: NRG; PAM sequence: CGG
ggtacagtggtatatgcctt

SEQ ID NO: 42263 - DNA, 20 bp, Artificial Sequence
  Description of Artificial Sequence: Synthetic oligonucleotide
  Target: ATXN1; (-) strand; PAM type: NRG; PAM sequence: TGG
gtcttattagctgggtacag

SEQ ID NO: 42264 - DNA, 20 bp, Artificial Sequence
  Description of Artificial Sequence: Synthetic oligonucleotide
  Target: ATXN1; (-) strand; PAM type: NRG; PAM sequence: CAG
tatgtcttattagctgggta

SEQ ID NO: 42265 - DNA, 20 bp, Artificial Sequence
  Description of Artificial Sequence: Synthetic oligonucleotide
  Target: ATXN1; (-) strand; PAM type: NRG; PAM sequence: GGG
taaaatatgtcttattagct

SEQ ID NO: 42266 - DNA, 20 bp, Artificial Sequence
  Description of Artificial Sequence: Synthetic oligonucleotide
  Target: ATXN1; (-) strand; PAM type: NRG; PAM sequence: TGG
ttaaaatatgtcttattagc

SEQ ID NO: 42267 - DNA, 20 bp, Artificial Sequence
  Description of Artificial Sequence: Synthetic oligonucleotide
  Target: ATXN1; (-) strand; PAM type: NRG; PAM sequence: TAG
tgttttaaaatatgtcttat

SEQ ID NO: 42268 - DNA, 20 bp, Artificial Sequence
  Description of Artificial Sequence: Synthetic oligonucleotide
  Target: ATXN1; (-) strand; PAM type: NRG; PAM sequence: AAG
agtgaggggattagatgcta

SEQ ID NO: 42269 - DNA, 20 bp, Artificial Sequence
  Description of Artificial Sequence: Synthetic oligonucleotide
  Target: ATXN1; (-) strand; PAM type: NRG; PAM sequence: TAG
tgccgttggagtgaggggat

SEQ ID NO: 42270 - DNA, 20 bp, Artificial Sequence
  Description of Artificial Sequence: Synthetic oligonucleotide
  Target: ATXN1; (-) strand; PAM type: NRG; PAM sequence: GGG
gaggatgccgttggagtgag

SEQ ID NO: 42271 - DNA, 20 bp, Artificial Sequence
  Description of Artificial Sequence: Synthetic oligonucleotide
  Target: ATXN1; (-) strand; PAM type: NRG; PAM sequence: GGG
agaggatgccgttggagtga

SEQ ID NO: 42272 - DNA, 20 bp, Artificial Sequence
  Description of Artificial Sequence: Synthetic oligonucleotide
  Target: ATXN1; (-) strand; PAM type: NRG; PAM sequence: AGG
cagaggatgccgttggagtg

SEQ ID NO: 42273 - DNA, 20 bp, Artificial Sequence
  Description of Artificial Sequence: Synthetic oligonucleotide
  Target: ATXN1; (-) strand; PAM type: NRG; PAM sequence: GAG
acagaggatgccgttggagt

SEQ ID NO: 42274 - DNA, 20 bp, Artificial Sequence
  Description of Artificial Sequence: Synthetic oligonucleotide
  Target: ATXN1; (-) strand; PAM type: NRG; PAM sequence: GAG
aaagacagaggatgccgttg

SEQ ID NO: 42275 - DNA, 20 bp, Artificial Sequence
  Description of Artificial Sequence: Synthetic oligonucleotide
  Target: ATXN1; (-) strand; PAM type: NRG; PAM sequence: TGG
gaaaagacagaggatgccgt

SEQ ID NO: 42276 - DNA, 20 bp, Artificial Sequence
  Description of Artificial Sequence: Synthetic oligonucleotide
  Target: ATXN1; (-) strand; PAM type: NRG; PAM sequence: AGG
ttcttaccaggaaaagacag

SEQ ID NO: 42277 - DNA, 20 bp, Artificial Sequence
  Description of Artificial Sequence: Synthetic oligonucleotide
  Target: ATXN1; (-) strand; PAM type: NRG; PAM sequence: GAG
tttcttaccaggaaaagaca

SEQ ID NO: 42278 - DNA, 20 bp, Artificial Sequence
  Description of Artificial Sequence: Synthetic oligonucleotide
  Target: ATXN1; (-) strand; PAM type: NRG; PAM sequence: CAG
tttttcttaccaggaaaaga

SEQ ID NO: 42279 - DNA, 20 bp, Artificial Sequence
  Description of Artificial Sequence: Synthetic oligonucleotide
  Target: ATXN1; (-) strand; PAM type: NRG; PAM sequence: AAG
gcactttttcttaccaggaa

SEQ ID NO: 42280 - DNA, 20 bp, Artificial Sequence
  Description of Artificial Sequence: Synthetic oligonucleotide
  Target: ATXN1; (-) strand; PAM type: NRG; PAM sequence: AGG
attcggcactttttcttacc

SEQ ID NO: 42281 - DNA, 20 bp, Artificial Sequence
  Description of Artificial Sequence: Synthetic oligonucleotide
  Target: ATXN1; (-) strand; PAM type: NRG; PAM sequence: CAG
cattcggcactttttcttac

SEQ ID NO: 42282 - DNA, 20 bp, Artificial Sequence
  Description of Artificial Sequence: Synthetic oligonucleotide
  Target: ATXN1; (-) strand; PAM type: NRG; PAM sequence: CGG
aggtccttctagtggtcatt

SEQ ID NO: 42283 - DNA, 20 bp, Artificial Sequence
  Description of Artificial Sequence: Synthetic oligonucleotide
  Target: ATXN1; (-) strand; PAM type: NRG; PAM sequence: TGG
tggacttcaggtccttctag

SEQ ID NO: 42284 - DNA, 20 bp, Artificial Sequence
  Description of Artificial Sequence: Synthetic oligonucleotide
  Target: ATXN1; (-) strand; PAM type: NRG; PAM sequence: TAG
tgctggacttcaggtccttc

SEQ ID NO: 42285 - DNA, 20 bp, Artificial Sequence
  Description of Artificial Sequence: Synthetic oligonucleotide
  Target: ATXN1; (-) strand; PAM type: NRG; PAM sequence: AGG
aggaaacgctgctggacttc

SEQ ID NO: 42286 - DNA, 20 bp, Artificial Sequence
  Description of Artificial Sequence: Synthetic oligonucleotide
  Target: ATXN1; (-) strand; PAM type: NRG; PAM sequence: CAG
taggaaacgctgctggactt

SEQ ID NO: 42287 - DNA, 20 bp, Artificial Sequence
  Description of Artificial Sequence: Synthetic oligonucleotide
  Target: ATXN1; (-) strand; PAM type: NRG; PAM sequence: TGG
ccctgattaggaaacgctgc

SEQ ID NO: 42288 - DNA, 20 bp, Artificial Sequence
  Description of Artificial Sequence: Synthetic oligonucleotide
  Target: ATXN1; (-) strand; PAM type: NRG; PAM sequence: AGG
taagatgaggaaccctgatt

SEQ ID NO: 42289 - DNA, 20 bp, Artificial Sequence
  Description of Artificial Sequence: Synthetic oligonucleotide
  Target: ATXN1; (-) strand; PAM type: NRG; PAM sequence: TAG
ttaagatgaggaaccctgat

SEQ ID NO: 42290 - DNA, 20 bp, Artificial Sequence
  Description of Artificial Sequence: Synthetic oligonucleotide
  Target: ATXN1; (-) strand; PAM type: NRG; PAM sequence: AGG
tgaattctgtgattaagatg

SEQ ID NO: 42291 - DNA, 20 bp, Artificial Sequence
  Description of Artificial Sequence: Synthetic oligonucleotide
  Target: ATXN1; (-) strand; PAM type: NRG; PAM sequence: GAG
ttgaattctgtgattaagat

SEQ ID NO: 42292 - DNA, 20 bp, Artificial Sequence
  Description of Artificial Sequence: Synthetic oligonucleotide
  Target: ATXN1; (-) strand; PAM type: NRG; PAM sequence: AAG
attttttgaattctgtgatt

SEQ ID NO: 42293 - DNA, 20 bp, Artificial Sequence
  Description of Artificial Sequence: Synthetic oligonucleotide
  Target: ATXN1; (-) strand; PAM type: NRG; PAM sequence: TAG
aatccagaaactcaccactc

SEQ ID NO: 42294 - DNA, 20 bp, Artificial Sequence
  Description of Artificial Sequence: Synthetic oligonucleotide
  Target: ATXN1; (-) strand; PAM type: NRG; PAM sequence: CAG
atggagtccttgagacaatc

SEQ ID NO: 42295 - DNA, 20 bp, Artificial Sequence
  Description of Artificial Sequence: Synthetic oligonucleotide
  Target: ATXN1; (-) strand; PAM type: NRG; PAM sequence: GAG
gggctagttatggagtcctt

SEQ ID NO: 42296 - DNA, 20 bp, Artificial Sequence
  Description of Artificial Sequence: Synthetic oligonucleotide
  Target: ATXN1; (-) strand; PAM type: NRG; PAM sequence: GAG
ggagagtggggctagttatg

SEQ ID NO: 42297 - DNA, 20 bp, Artificial Sequence
  Description of Artificial Sequence: Synthetic oligonucleotide
  Target: ATXN1; (-) strand; PAM type: NRG; PAM sequence: TGG
atggagagtggggctagtta

SEQ ID NO: 42298 - DNA, 20 bp, Artificial Sequence
  Description of Artificial Sequence: Synthetic oligonucleotide
  Target: ATXN1; (-) strand; PAM type: NRG; PAM sequence: TAG
ccatgcatggagagtggggc

SEQ ID NO: 42299 - DNA, 20 bp, Artificial Sequence
  Description of Artificial Sequence: Synthetic oligonucleotide
  Target: ATXN1; (-) strand; PAM type: NRG; PAM sequence: GGG
acctccatgcatggagagtg

SEQ ID NO: 42300 - DNA, 20 bp, Artificial Sequence
  Description of Artificial Sequence: Synthetic oligonucleotide
  Target: ATXN1; (-) strand; PAM type: NRG; PAM sequence: GGG
aacctccatgcatggagagt

SEQ ID NO: 42301 - DNA, 20 bp, Artificial Sequence
  Description of Artificial Sequence: Synthetic oligonucleotide
  Target: ATXN1; (-) strand; PAM type: NRG; PAM sequence: TGG
taacctccatgcatggagag

SEQ ID NO: 42302 - DNA, 20 bp, Artificial Sequence
  Description of Artificial Sequence: Synthetic oligonucleotide
  Target: ATXN1; (-) strand; PAM type: NRG; PAM sequence: GAG
aattaacctccatgcatgga

SEQ ID NO: 42303 - DNA, 20 bp, Artificial Sequence
  Description of Artificial Sequence: Synthetic oligonucleotide
  Target: ATXN1; (-) strand; PAM type: NRG; PAM sequence: GAG
tgaattaacctccatgcatg

SEQ ID NO: 42304 - DNA, 20 bp, Artificial Sequence
  Description of Artificial Sequence: Synthetic oligonucleotide
  Target: ATXN1; (-) strand; PAM type: NRG; PAM sequence: TGG
aatgaattaacctccatgca

SEQ ID NO: 42305 - DNA, 20 bp, Artificial Sequence
  Description of Artificial Sequence: Synthetic oligonucleotide
  Target: ATXN1; (-) strand; PAM type: NRG; PAM sequence: AAG
ctgcgttctctagaaaaaat

SEQ ID NO: 42306 - DNA, 20 bp, Artificial Sequence
  Description of Artificial Sequence: Synthetic oligonucleotide
  Target: ATXN1; (-) strand; PAM type: NRG; PAM sequence: TAG
cctttcccaactgcgttctc

SEQ ID NO: 42307 - DNA, 20 bp, Artificial Sequence
  Description of Artificial Sequence: Synthetic oligonucleotide
  Target: ATXN1; (-) strand; PAM type: NRG; PAM sequence: CGG
gtacacctagaccttagact

SEQ ID NO: 42308 - DNA, 20 bp, Artificial Sequence
  Description of Artificial Sequence: Synthetic oligonucleotide
  Target: ATXN1; (-) strand; PAM type: NRG; PAM sequence: TAG
tctcgggtacacctagacct

SEQ ID NO: 42309 - DNA, 20 bp, Artificial Sequence
  Description of Artificial Sequence: Synthetic oligonucleotide
  Target: ATXN1; (-) strand; PAM type: NRG; PAM sequence: TAG
taagggttctcgggtacacc

SEQ ID NO: 42310 - DNA, 20 bp, Artificial Sequence
  Description of Artificial Sequence: Synthetic oligonucleotide
  Target: ATXN1; (-) strand; PAM type: NRG; PAM sequence: GGG
aggcaggattaagggttctc

SEQ ID NO: 42311 - DNA, 20 bp, Artificial Sequence
  Description of Artificial Sequence: Synthetic oligonucleotide
  Target: ATXN1; (-) strand; PAM type: NRG; PAM sequence: CGG
gaggcaggattaagggttct

SEQ ID NO: 42312 - DNA, 20 bp, Artificial Sequence
  Description of Artificial Sequence: Synthetic oligonucleotide
  Target: ATXN1; (-) strand; PAM type: NRG; PAM sequence: GGG
cttctatgaggcaggattaa

SEQ ID NO: 42313 - DNA, 20 bp, Artificial Sequence
  Description of Artificial Sequence: Synthetic oligonucleotide
  Target: ATXN1; (-) strand; PAM type: NRG; PAM sequence: AGG
gcttctatgaggcaggatta

SEQ ID NO: 42314 - DNA, 20 bp, Artificial Sequence
  Description of Artificial Sequence: Synthetic oligonucleotide
  Target: ATXN1; (-) strand; PAM type: NRG; PAM sequence: AAG
tgcttctatgaggcaggatt

SEQ ID NO: 42315 - DNA, 20 bp, Artificial Sequence
  Description of Artificial Sequence: Synthetic oligonucleotide
  Target: ATXN1; (-) strand; PAM type: NRG; PAM sequence: AGG
acgaattgcttctatgaggc

SEQ ID NO: 42316 - DNA, 20 bp, Artificial Sequence
  Description of Artificial Sequence: Synthetic oligonucleotide
  Target: ATXN1; (-) strand; PAM type: NRG; PAM sequence: CAG
gacgaattgcttctatgagg

SEQ ID NO: 42317 - DNA, 20 bp, Artificial Sequence
  Description of Artificial Sequence: Synthetic oligonucleotide
  Target: ATXN1; (-) strand; PAM type: NRG; PAM sequence: AGG
caagacgaattgcttctatg

SEQ ID NO: 42318 - DNA, 20 bp, Artificial Sequence
  Description of Artificial Sequence: Synthetic oligonucleotide
  Target: ATXN1; (-) strand; PAM type: NRG; PAM sequence: GAG
gcaagacgaattgcttctat

SEQ ID NO: 42319 - DNA, 20 bp, Artificial Sequence
  Description of Artificial Sequence: Synthetic oligonucleotide
  Target: ATXN1; (-) strand; PAM type: NRG; PAM sequence: AAG
tgccatcatcatctcctggc

SEQ ID NO: 42320 - DNA, 20 bp, Artificial Sequence
  Description of Artificial Sequence: Synthetic oligonucleotide
  Target: ATXN1; (-) strand; PAM type: NRG; PAM sequence: TGG
gtgatgccatcatcatctcc

SEQ ID NO: 42321 - DNA, 20 bp, Artificial Sequence
  Description of Artificial Sequence: Synthetic oligonucleotide
  Target: ATXN1; (-) strand; PAM type: NRG; PAM sequence: GGG
agccagggtggcacagggat

SEQ ID NO: 42322 - DNA, 20 bp, Artificial Sequence
  Description of Artificial Sequence: Synthetic oligonucleotide
  Target: ATXN1; (-) strand; PAM type: NRG; PAM sequence: TGG
tagccagggtggcacaggga

SEQ ID NO: 42323 - DNA, 20 bp, Artificial Sequence
  Description of Artificial Sequence: Synthetic oligonucleotide
  Target: ATXN1; (-) strand; PAM type: NRG; PAM sequence: GGG
acgttagccagggtggcaca

SEQ ID NO: 42324 - DNA, 20 bp, Artificial Sequence
  Description of Artificial Sequence: Synthetic oligonucleotide
  Target: ATXN1; (-) strand; PAM type: NRG; PAM sequence: AGG
aacgttagccagggtggcac

SEQ ID NO: 42325 - DNA, 20 bp, Artificial Sequence
  Description of Artificial Sequence: Synthetic oligonucleotide
  Target: ATXN1; (-) strand; PAM type: NRG; PAM sequence: CAG
taacgttagccagggtggca

SEQ ID NO: 42326 - DNA, 20 bp, Artificial Sequence
  Description of Artificial Sequence: Synthetic oligonucleotide
  Target: ATXN1; (-) strand; PAM type: NRG; PAM sequence: TGG
ccaggtaacgttagccaggg

SEQ ID NO: 42327 - DNA, 20 bp, Artificial Sequence
  Description of Artificial Sequence: Synthetic oligonucleotide
  Target: ATXN1; (-) strand; PAM type: NRG; PAM sequence: GGG
agcccaggtaacgttagcca

SEQ ID NO: 42328 - DNA, 20 bp, Artificial Sequence
  Description of Artificial Sequence: Synthetic oligonucleotide
  Target: ATXN1; (-) strand; PAM type: NRG; PAM sequence: AGG
gagcccaggtaacgttagcc

SEQ ID NO: 42329 - DNA, 20 bp, Artificial Sequence
  Description of Artificial Sequence: Synthetic oligonucleotide
  Target: ATXN1; (-) strand; PAM type: NRG; PAM sequence: CAG
cgagcccaggtaacgttagc

SEQ ID NO: 42330 - DNA, 20 bp, Artificial Sequence
  Description of Artificial Sequence: Synthetic oligonucleotide
  Target: ATXN1; (-) strand; PAM type: NRG; PAM sequence: TAG
gcaccgagcccaggtaacgt

SEQ ID NO: 42331 - DNA, 20 bp, Artificial Sequence
  Description of Artificial Sequence: Synthetic oligonucleotide
  Target: ATXN1; (-) strand; PAM type: NRG; PAM sequence: AGG
cgtcggggagcaccgagccc

SEQ ID NO: 42332 - DNA, 20 bp, Artificial Sequence
  Description of Artificial Sequence: Synthetic oligonucleotide
  Target: ATXN1; (-) strand; PAM type: NRG; PAM sequence: CAG
ccgtcggggagcaccgagcc

SEQ ID NO: 42333 - DNA, 20 bp, Artificial Sequence
  Description of Artificial Sequence: Synthetic oligonucleotide
  Target: ATXN1; (-) strand; PAM type: NRG; PAM sequence: GAG
gttcgccgtcggggagcacc

SEQ ID NO: 42334 - DNA, 20 bp, Artificial Sequence
  Description of Artificial Sequence: Synthetic oligonucleotide
  Target: ATXN1; (-) strand; PAM type: NRG; PAM sequence: GAG
tgatacagttcgccgtcggg

SEQ ID NO: 42335 - DNA, 20 bp, Artificial Sequence
  Description of Artificial Sequence: Synthetic oligonucleotide
  Target: ATXN1; (-) strand; PAM type: NRG; PAM sequence: GGG
cgtgatacagttcgccgtcg

SEQ ID NO: 42336 - DNA, 20 bp, Artificial Sequence
  Description of Artificial Sequence: Synthetic oligonucleotide
  Target: ATXN1; (-) strand; PAM type: NRG; PAM sequence: GGG
ccgtgatacagttcgccgtc

SEQ ID NO: 42337 - DNA, 20 bp, Artificial Sequence
  Description of Artificial Sequence: Synthetic oligonucleotide
  Target: ATXN1; (-) strand; PAM type: NRG; PAM sequence: CGG
gccgtgatacagttcgccgt

SEQ ID NO: 42338 - DNA, 20 bp, Artificial Sequence
  Description of Artificial Sequence: Synthetic oligonucleotide
  Target: ATXN1; (-) strand; PAM type: NRG; PAM sequence: CAG
gcccgggcgtggccgtgata

SEQ ID NO: 42339 - DNA, 20 bp, Artificial Sequence
  Description of Artificial Sequence: Synthetic oligonucleotide
  Target: ATXN1; (-) strand; PAM type: NRG; PAM sequence: TGG
agacagccatagcccgggcg

SEQ ID NO: 42340 - DNA, 20 bp, Artificial Sequence
  Description of Artificial Sequence: Synthetic oligonucleotide
  Target: ATXN1; (-) strand; PAM type: NRG; PAM sequence: GGG
attgaagacagccatagccc

SEQ ID NO: 42341 - DNA, 20 bp, Artificial Sequence
  Description of Artificial Sequence: Synthetic oligonucleotide
  Target: ATXN1; (-) strand; PAM type: NRG; PAM sequence: CGG
gattgaagacagccatagcc

SEQ ID NO: 42342 - DNA, 20 bp, Artificial Sequence
  Description of Artificial Sequence: Synthetic oligonucleotide
  Target: ATXN1; (-) strand; PAM type: NRG; PAM sequence: TAG
gagaggattgaagacagcca

SEQ ID NO: 42343 - DNA, 20 bp, Artificial Sequence
  Description of Artificial Sequence: Synthetic oligonucleotide
  Target: ATXN1; (-) strand; PAM type: NRG; PAM sequence: CAG
accgtagagaggattgaaga

SEQ ID NO: 42344 - DNA, 20 bp, Artificial Sequence
  Description of Artificial Sequence: Synthetic oligonucleotide
  Target: ATXN1; (-) strand; PAM type: NRG; PAM sequence: AAG
cagcaccgtagagaggattg

SEQ ID NO: 42345 - DNA, 20 bp, Artificial Sequence
  Description of Artificial Sequence: Synthetic oligonucleotide
  Target: ATXN1; (-) strand; PAM type: NRG; PAM sequence: AGG
tcgactccagcaccgtagag

SEQ ID NO: 42346 - DNA, 20 bp, Artificial Sequence
  Description of Artificial Sequence: Synthetic oligonucleotide
  Target: ATXN1; (-) strand; PAM type: NRG; PAM sequence: GAG
atcgactccagcaccgtaga

SEQ ID NO: 42347 - DNA, 20 bp, Artificial Sequence
  Description of Artificial Sequence: Synthetic oligonucleotide
  Target: ATXN1; (-) strand; PAM type: NRG; PAM sequence: GAG
agatcgactccagcaccgta

SEQ ID NO: 42348 - DNA, 20 bp, Artificial Sequence
  Description of Artificial Sequence: Synthetic oligonucleotide
  Target: ATXN1; (-) strand; PAM type: NRG; PAM sequence: TAG
gaagatcgactccagcaccg

SEQ ID NO: 42349 - DNA, 20 bp, Artificial Sequence
  Description of Artificial Sequence: Synthetic oligonucleotide
  Target: ATXN1; (-) strand; PAM type: NRG; PAM sequence: CAG
aacgacctgaagatcgactc

SEQ ID NO: 42350 - DNA, 20 bp, Artificial Sequence
  Description of Artificial Sequence: Synthetic oligonucleotide
  Target: ATXN1; (-) strand; PAM type: NRG; PAM sequence: AAG
cagagataagcaacgacctg

SEQ ID NO: 42351 - DNA, 20 bp, Artificial Sequence
  Description of Artificial Sequence: Synthetic oligonucleotide
  Target: ATXN1; (-) strand; PAM type: NRG; PAM sequence: AAG
ttcatccagagtgcagagat

SEQ ID NO: 42352 - DNA, 20 bp, Artificial Sequence
  Description of Artificial Sequence: Synthetic oligonucleotide
  Target: ATXN1; (-) strand; PAM type: NRG; PAM sequence: GAG
aagatttcatccagagtgca

SEQ ID NO: 42353 - DNA, 20 bp, Artificial Sequence
  Description of Artificial Sequence: Synthetic oligonucleotide
  Target: ATXN1; (-) strand; PAM type: NRG; PAM sequence: CAG
agaagatttcatccagagtg

SEQ ID NO: 42354 - DNA, 20 bp, Artificial Sequence
  Description of Artificial Sequence: Synthetic oligonucleotide
  Target: ATXN1; (-) strand; PAM type: NRG; PAM sequence: GAG
aaaacagaagatttcatcca

SEQ ID NO: 42355 - DNA, 20 bp, Artificial Sequence
  Description of Artificial Sequence: Synthetic oligonucleotide
  Target: ATXN1; (-) strand; PAM type: NRG; PAM sequence: CAG
taaaaacagaagatttcatc

SEQ ID NO: 42356 - DNA, 20 bp, Artificial Sequence
  Description of Artificial Sequence: Synthetic oligonucleotide
  Target: ATXN1; (-) strand; PAM type: NRG; PAM sequence: AAG
ggtggaagacttaaaaacag

SEQ ID NO: 42357 - DNA, 20 bp, Artificial Sequence
  Description of Artificial Sequence: Synthetic oligonucleotide
  Target: ATXN1; (-) strand; PAM type: NRG; PAM sequence: CAG
gaaggtggaagacttaaaaa

SEQ ID NO: 42358 - DNA, 20 bp, Artificial Sequence
  Description of Artificial Sequence: Synthetic oligonucleotide
  Target: ATXN1; (-) strand; PAM type: NRG; PAM sequence: AAG
cggggagctaaagaaggtgg

SEQ ID NO: 42359 - DNA, 20 bp, Artificial Sequence
  Description of Artificial Sequence: Synthetic oligonucleotide
  Target: ATXN1; (-) strand; PAM type: NRG; PAM sequence: TGG
caacggggagctaaagaagg

SEQ ID NO: 42360 - DNA, 20 bp, Artificial Sequence
  Description of Artificial Sequence: Synthetic oligonucleotide
  Target: ATXN1; (-) strand; PAM type: NRG; PAM sequence: AGG
ggccaacggggagctaaaga

SEQ ID NO: 42361 - DNA, 20 bp, Artificial Sequence
  Description of Artificial Sequence: Synthetic oligonucleotide
  Target: ATXN1; (-) strand; PAM type: NRG; PAM sequence: AAG
tggccaacggggagctaaag

SEQ ID NO: 42362 - DNA, 20 bp, Artificial Sequence
  Description of Artificial Sequence: Synthetic oligonucleotide
  Target: ATXN1; (-) strand; PAM type: NRG; PAM sequence: AAG
agttggccaacggggagcta

SEQ ID NO: 42363 - DNA, 20 bp, Artificial Sequence
  Description of Artificial Sequence: Synthetic oligonucleotide
  Target: ATXN1; (-) strand; PAM type: NRG; PAM sequence: GAG
tcatccagttggccaacggg

SEQ ID NO: 42364 - DNA, 20 bp, Artificial Sequence
  Description of Artificial Sequence: Synthetic oligonucleotide
  Target: ATXN1; (-) strand; PAM type: NRG; PAM sequence: GGG
catcatccagttggccaacg

SEQ ID NO: 42365 - DNA, 20 bp, Artificial Sequence
  Description of Artificial Sequence: Synthetic oligonucleotide
  Target: ATXN1; (-) strand; PAM type: NRG; PAM sequence: GGG
ccatcatccagttggccaac

SEQ ID NO: 42366 - DNA, 20 bp, Artificial Sequence
  Description of Artificial Sequence: Synthetic oligonucleotide
  Target: ATXN1; (-) strand; PAM type: NRG; PAM sequence: CGG
tccatcatccagttggccaa

SEQ ID NO: 42367 - DNA, 20 bp, Artificial Sequence
  Description of Artificial Sequence: Synthetic oligonucleotide
  Target: ATXN1; (-) strand; PAM type: NRG; PAM sequence: TGG
gaaaggctccatcatccagt

SEQ ID NO: 42368 - DNA, 20 bp, Artificial Sequence
  Description of Artificial Sequence: Synthetic oligonucleotide
  Target: ATXN1; (-) strand; PAM type: NRG; PAM sequence: CAG
tcatgaaaggctccatcatc

SEQ ID NO: 42369 - DNA, 20 bp, Artificial Sequence
  Description of Artificial Sequence: Synthetic oligonucleotide
  Target: ATXN1; (-) strand; PAM type: NRG; PAM sequence: AGG
ctgcctccctacttcatgaa

SEQ ID NO: 42370 - DNA, 20 bp, Artificial Sequence
  Description of Artificial Sequence: Synthetic oligonucleotide
  Target: ATXN1; (-) strand; PAM type: NRG; PAM sequence: AAG
gctgcctccctacttcatga

SEQ ID NO: 42371 - DNA, 20 bp, Artificial Sequence
  Description of Artificial Sequence: Synthetic oligonucleotide
  Target: ATXN1; (-) strand; PAM type: NRG; PAM sequence: CGG
gtccgtggcctccccggcgg

SEQ ID NO: 42372 - DNA, 20 bp, Artificial Sequence
  Description of Artificial Sequence: Synthetic oligonucleotide
  Target: ATXN1; (-) strand; PAM type: NRG; PAM sequence: CGG
gcagtccgtggcctccccgg

SEQ ID NO: 42373 - DNA, 20 bp, Artificial Sequence
  Description of Artificial Sequence: Synthetic oligonucleotide
  Target: ATXN1; (-) strand; PAM type: NRG; PAM sequence: CGG
ggtgcagtccgtggcctccc

SEQ ID NO: 42374 - DNA, 20 bp, Artificial Sequence
  Description of Artificial Sequence: Synthetic oligonucleotide
  Target: ATXN1; (-) strand; PAM type: NRG; PAM sequence: TGG
cctgcctgtggtgcagtccg

SEQ ID NO: 42375 - DNA, 20 bp, Artificial Sequence
  Description of Artificial Sequence: Synthetic oligonucleotide
  Target: ATXN1; (-) strand; PAM type: NRG; PAM sequence: CAG
agatccacctgcctgtggtg

SEQ ID NO: 42376 - DNA, 20 bp, Artificial Sequence
  Description of Artificial Sequence: Synthetic oligonucleotide
  Target: ATXN1; (-) strand; PAM type: NRG; PAM sequence: TGG
ggcccagatccacctgcctg

SEQ ID NO: 42377 - DNA, 20 bp, Artificial Sequence
  Description of Artificial Sequence: Synthetic oligonucleotide
  Target: ATXN1; (-) strand; PAM type: NRG; PAM sequence: CAG
acccagccatggtgcaggcc

SEQ ID NO: 42378 - DNA, 20 bp, Artificial Sequence
  Description of Artificial Sequence: Synthetic oligonucleotide
  Target: ATXN1; (-) strand; PAM type: NRG; PAM sequence: AGG
cgcctacccagccatggtgc

SEQ ID NO: 42379 - DNA, 20 bp, Artificial Sequence
  Description of Artificial Sequence: Synthetic oligonucleotide
  Target: ATXN1; (-) strand; PAM type: NRG; PAM sequence: CAG
ccgcctacccagccatggtg

SEQ ID NO: 42380 - DNA, 20 bp, Artificial Sequence
  Description of Artificial Sequence: Synthetic oligonucleotide
  Target: ATXN1; (-) strand; PAM type: NRG; PAM sequence: TGG
ccaggccgcctacccagcca

SEQ ID NO: 42381 - DNA, 20 bp, Artificial Sequence
  Description of Artificial Sequence: Synthetic oligonucleotide
  Target: ATXN1; (-) strand; PAM type: NRG; PAM sequence: CAG
ggtcacccaggccgcctacc

SEQ ID NO: 42382 - DNA, 20 bp, Artificial Sequence
  Description of Artificial Sequence: Synthetic oligonucleotide
  Target: ATXN1; (-) strand; PAM type: NRG; PAM sequence: AGG
ccctgaggccctggtcaccc

SEQ ID NO: 42383 - DNA, 20 bp, Artificial Sequence
  Description of Artificial Sequence: Synthetic oligonucleotide
  Target: ATXN1; (-) strand; PAM type: NRG; PAM sequence: CAG
accctgaggccctggtcacc

SEQ ID NO: 42384 - DNA, 20 bp, Artificial Sequence
  Description of Artificial Sequence: Synthetic oligonucleotide
  Target: ATXN1; (-) strand; PAM type: NRG; PAM sequence: TGG
gaacttcaaccctgaggccc

SEQ ID NO: 42385 - DNA, 20 bp, Artificial Sequence
  Description of Artificial Sequence: Synthetic oligonucleotide
  Target: ATXN1; (-) strand; PAM type: NRG; PAM sequence: AGG
gagcgagaacttcaaccctg

SEQ ID NO: 42386 - DNA, 20 bp, Artificial Sequence
  Description of Artificial Sequence: Synthetic oligonucleotide
  Target: ATXN1; (-) strand; PAM type: NRG; PAM sequence: GAG
agagcgagaacttcaaccct

SEQ ID NO: 42387 - DNA, 20 bp, Artificial Sequence
  Description of Artificial Sequence: Synthetic oligonucleotide
  Target: ATXN1; (-) strand; PAM type: NRG; PAM sequence: GAG
ccaccgcccttcccaagagc

SEQ ID NO: 42388 - DNA, 20 bp, Artificial Sequence
  Description of Artificial Sequence: Synthetic oligonucleotide
  Target: ATXN1; (-) strand; PAM type: NRG; PAM sequence: GAG
gtcaccaccgcccttcccaa

SEQ ID NO: 42389 - DNA, 20 bp, Artificial Sequence
  Description of Artificial Sequence: Synthetic oligonucleotide
  Target: ATXN1; (-) strand; PAM type: NRG; PAM sequence: AAG
tcgtcaccaccgcccttccc

SEQ ID NO: 42390 - DNA, 20 bp, Artificial Sequence
  Description of Artificial Sequence: Synthetic oligonucleotide
  Target: ATXN1; (-) strand; PAM type: NRG; PAM sequence: CAG
gtcatccccccagtttgctg

SEQ ID NO: 42391 - DNA, 20 bp, Artificial Sequence
  Description of Artificial Sequence: Synthetic oligonucleotide
  Target: ATXN1; (-) strand; PAM type: NRG; PAM sequence: CAG
ccatagtcacgtcatccccc

SEQ ID NO: 42392 - DNA, 20 bp, Artificial Sequence
  Description of Artificial Sequence: Synthetic oligonucleotide
  Target: ATXN1; (-) strand; PAM type: NRG; PAM sequence: TAG
gtcgggggcagccccggcca

SEQ ID NO: 42393 - DNA, 20 bp, Artificial Sequence
  Description of Artificial Sequence: Synthetic oligonucleotide
  Target: ATXN1; (-) strand; PAM type: NRG; PAM sequence: CGG
ggaagcgtcgggggcagccc

SEQ ID NO: 42394 - DNA, 20 bp, Artificial Sequence
  Description of Artificial Sequence: Synthetic oligonucleotide
  Target: ATXN1; (-) strand; PAM type: NRG; PAM sequence: CAG
tgacatggaagcgtcggggg

SEQ ID NO: 42395 - DNA, 20 bp, Artificial Sequence
  Description of Artificial Sequence: Synthetic oligonucleotide
  Target: ATXN1; (-) strand; PAM type: NRG; PAM sequence: GGG
cactgacatggaagcgtcgg

SEQ ID NO: 42396 - DNA, 20 bp, Artificial Sequence
  Description of Artificial Sequence: Synthetic oligonucleotide
  Target: ATXN1; (-) strand; PAM type: NRG; PAM sequence: GGG
gcactgacatggaagcgtcg

SEQ ID NO: 42397 - DNA, 20 bp, Artificial Sequence
  Description of Artificial Sequence: Synthetic oligonucleotide
  Target: ATXN1; (-) strand; PAM type: NRG; PAM sequence: GGG
agcactgacatggaagcgtc

SEQ ID NO: 42398 - DNA, 20 bp, Artificial Sequence
  Description of Artificial Sequence: Synthetic oligonucleotide
  Target: ATXN1; (-) strand; PAM type: NRG; PAM sequence: CGG
cagcactgacatggaagcgt

SEQ ID NO: 42399 - DNA, 20 bp, Artificial Sequence
  Description of Artificial Sequence: Synthetic oligonucleotide
  Target: ATXN1; (-) strand; PAM type: NRG; PAM sequence: AAG
ggtcggcagcactgacatgg

SEQ ID NO: 42400 - DNA, 20 bp, Artificial Sequence
  Description of Artificial Sequence: Synthetic oligonucleotide
  Target: ATXN1; (-) strand; PAM type: NRG; PAM sequence: TGG
cccggtcggcagcactgaca

SEQ ID NO: 42401 - DNA, 20 bp, Artificial Sequence
  Description of Artificial Sequence: Synthetic oligonucleotide
  Target: ATXN1; (-) strand; PAM type: NRG; PAM sequence: CAG
cccctgctcatcccggtcgg

SEQ ID NO: 42402 - DNA, 20 bp, Artificial Sequence
  Description of Artificial Sequence: Synthetic oligonucleotide
  Target: ATXN1; (-) strand; PAM type: NRG; PAM sequence: CGG
cagcccctgctcatcccggt

SEQ ID NO: 42403 - DNA, 20 bp, Artificial Sequence
  Description of Artificial Sequence: Synthetic oligonucleotide
  Target: ATXN1; (-) strand; PAM type: NRG; PAM sequence: CGG
cacacagcccctgctcatcc

SEQ ID NO: 42404 - DNA, 20 bp, Artificial Sequence
  Description of Artificial Sequence: Synthetic oligonucleotide
  Target: ATXN1; (-) strand; PAM type: NRG; PAM sequence: CAG
acctggtgatccccggcaca

SEQ ID NO: 42405 - DNA, 20 bp, Artificial Sequence
  Description of Artificial Sequence: Synthetic oligonucleotide
  Target: ATXN1; (-) strand; PAM type: NRG; PAM sequence: CGG
ccccagcacctggtgatccc

SEQ ID NO: 42406 - DNA, 20 bp, Artificial Sequence
  Description of Artificial Sequence: Synthetic oligonucleotide
  Target: ATXN1; (-) strand; PAM type: NRG; PAM sequence: TGG
cggcagcctgccccagcacc

SEQ ID NO: 42407 - DNA, 20 bp, Artificial Sequence
  Description of Artificial Sequence: Synthetic oligonucleotide
  Target: ATXN1; (-) strand; PAM type: NRG; PAM sequence: CAG
cctacgccggcagcctgccc

SEQ ID NO: 42408 - DNA, 20 bp, Artificial Sequence
  Description of Artificial Sequence: Synthetic oligonucleotide
  Target: ATXN1; (-) strand; PAM type: NRG; PAM sequence: CAG
caagcaatcacctacgccgg

SEQ ID NO: 42409 - DNA, 20 bp, Artificial Sequence
  Description of Artificial Sequence: Synthetic oligonucleotide
  Target: ATXN1; (-) strand; PAM type: NRG; PAM sequence: CGG
cagcaagcaatcacctacgc

SEQ ID NO: 42410 - DNA, 20 bp, Artificial Sequence
  Description of Artificial Sequence: Synthetic oligonucleotide
  Target: ATXN1; (-) strand; PAM type: NRG; PAM sequence: AAG
ctacctgagcggccagcagc

SEQ ID NO: 42411 - DNA, 20 bp, Artificial Sequence
  Description of Artificial Sequence: Synthetic oligonucleotide
  Target: ATXN1; (-) strand; PAM type: NRG; PAM sequence: CAG
tcggctacctgagcggccag

SEQ ID NO: 42412 - DNA, 20 bp, Artificial Sequence
  Description of Artificial Sequence: Synthetic oligonucleotide
  Target: ATXN1; (-) strand; PAM type: NRG; PAM sequence: CAG
tcatcggctacctgagcggc

SEQ ID NO: 42413 - DNA, 20 bp, Artificial Sequence
  Description of Artificial Sequence: Synthetic oligonucleotide
  Target: ATXN1; (-) strand; PAM type: NRG; PAM sequence: CGG
cctgtcatcggctacctgag

SEQ ID NO: 42414 - DNA, 20 bp, Artificial Sequence
  Description of Artificial Sequence: Synthetic oligonucleotide
  Target: ATXN1; (-) strand; PAM type: NRG; PAM sequence: GAG
ccccctgtcatcggctacct

SEQ ID NO: 42415 - DNA, 20 bp, Artificial Sequence
  Description of Artificial Sequence: Synthetic oligonucleotide
  Target: ATXN1; (-) strand; PAM type: NRG; PAM sequence: CGG
gggactcaaccccctgtcat

SEQ ID NO: 42416 - DNA, 20 bp, Artificial Sequence
  Description of Artificial Sequence: Synthetic oligonucleotide
  Target: ATXN1; (-) strand; PAM type: NRG; PAM sequence: GGG
cagccacggccttctacgca

SEQ ID NO: 42417 - DNA, 20 bp, Artificial Sequence
  Description of Artificial Sequence: Synthetic oligonucleotide
  Target: ATXN1; (-) strand; PAM type: NRG; PAM sequence: AGG
ccagccacggccttctacgc

SEQ ID NO: 42418 - DNA, 20 bp, Artificial Sequence
  Description of Artificial Sequence: Synthetic oligonucleotide
  Target: ATXN1; (-) strand; PAM type: NRG; PAM sequence: CAG
gccagccacggccttctacg

SEQ ID NO: 42419 - DNA, 20 bp, Artificial Sequence
  Description of Artificial Sequence: Synthetic oligonucleotide
  Target: ATXN1; (-) strand; PAM type: NRG; PAM sequence: CGG
cccggtgggactgccagcca

SEQ ID NO: 42420 - DNA, 20 bp, Artificial Sequence
  Description of Artificial Sequence: Synthetic oligonucleotide
  Target: ATXN1; (-) strand; PAM type: NRG; PAM sequence: CAG
gccactcccggtgggactgc

SEQ ID NO: 42421 - DNA, 20 bp, Artificial Sequence
  Description of Artificial Sequence: Synthetic oligonucleotide
  Target: ATXN1; (-) strand; PAM type: NRG; PAM sequence: GGG
gcttcagagccactcccggt

SEQ ID NO: 42422 - DNA, 20 bp, Artificial Sequence
  Description of Artificial Sequence: Synthetic oligonucleotide
  Target: ATXN1; (-) strand; PAM type: NRG; PAM sequence: TGG
tgcttcagagccactcccgg

SEQ ID NO: 42423 - DNA, 20 bp, Artificial Sequence
  Description of Artificial Sequence: Synthetic oligonucleotide
  Target: ATXN1; (-) strand; PAM type: NRG; PAM sequence: CGG
cagtgcttcagagccactcc

SEQ ID NO: 42424 - DNA, 20 bp, Artificial Sequence
  Description of Artificial Sequence: Synthetic oligonucleotide
  Target: ATXN1; (-) strand; PAM type: NRG; PAM sequence: GAG
agaccacacacagtgcttca

SEQ ID NO: 42425 - DNA, 20 bp, Artificial Sequence
  Description of Artificial Sequence: Synthetic oligonucleotide
  Target: ATXN1; (-) strand; PAM type: NRG; PAM sequence: CAG
tcagaccacacacagtgctt

SEQ ID NO: 42426 - DNA, 20 bp, Artificial Sequence
  Description of Artificial Sequence: Synthetic oligonucleotide
  Target: ATXN1; (-) strand; PAM type: NRG; PAM sequence: CAG
acggtcattcagaccacaca

SEQ ID NO: 42427 - DNA, 20 bp, Artificial Sequence
  Description of Artificial Sequence: Synthetic oligonucleotide
  Target: ATXN1; (-) strand; PAM type: NRG; PAM sequence: CAG
tctcaccccacacggtcatt

SEQ ID NO: 42428 - DNA, 20 bp, Artificial Sequence
  Description of Artificial Sequence: Synthetic oligonucleotide
  Target: ATXN1; (-) strand; PAM type: NRG; PAM sequence: CGG
ctacgcgctctcaccccaca

SEQ ID NO: 42429 - DNA, 20 bp, Artificial Sequence
  Description of Artificial Sequence: Synthetic oligonucleotide
  Target: ATXN1; (-) strand; PAM type: NRG; PAM sequence: CGG
atttagggaagcctggccac

SEQ ID NO: 42430 - DNA, 20 bp, Artificial Sequence
  Description of Artificial Sequence: Synthetic oligonucleotide
  Target: ATXN1; (-) strand; PAM type: NRG; PAM sequence: TGG
ggcctgcatttagggaagcc

SEQ ID NO: 42431 - DNA, 20 bp, Artificial Sequence
  Description of Artificial Sequence: Synthetic oligonucleotide
  Target: ATXN1; (-) strand; PAM type: NRG; PAM sequence: AAG
aaagtggcctgcatttaggg

SEQ ID NO: 42432 - DNA, 20 bp, Artificial Sequence
  Description of Artificial Sequence: Synthetic oligonucleotide
  Target: ATXN1; (-) strand; PAM type: NRG; PAM sequence: GGG
acaaaagtggcctgcattta

SEQ ID NO: 42433 - DNA, 20 bp, Artificial Sequence
  Description of Artificial Sequence: Synthetic oligonucleotide
  Target: ATXN1; (-) strand; PAM type: NRG; PAM sequence: AGG
gacaaaagtggcctgcattt

SEQ ID NO: 42434 - DNA, 20 bp, Artificial Sequence
  Description of Artificial Sequence: Synthetic oligonucleotide
  Target: ATXN1; (-) strand; PAM type: NRG; PAM sequence: TAG
cgacaaaagtggcctgcatt

SEQ ID NO: 42435 - DNA, 20 bp, Artificial Sequence
  Description of Artificial Sequence: Synthetic oligonucleotide
  Target: ATXN1; (-) strand; PAM type: NRG; PAM sequence: TGG
tctaccctcaacgacaaaag

SEQ ID NO: 42436 - DNA, 20 bp, Artificial Sequence
  Description of Artificial Sequence: Synthetic oligonucleotide
  Target: ATXN1; (-) strand; PAM type: NRG; PAM sequence: AAG
ccttctaccctcaacgacaa

SEQ ID NO: 42437 - DNA, 20 bp, Artificial Sequence
  Description of Artificial Sequence: Synthetic oligonucleotide
  Target: ATXN1; (-) strand; PAM type: NRG; PAM sequence: AAG
gcaacaggccactcatcgtg

SEQ ID NO: 42438 - DNA, 20 bp, Artificial Sequence
  Description of Artificial Sequence: Synthetic oligonucleotide
  Target: ATXN1; (-) strand; PAM type: NRG; PAM sequence: AGG
agctgacctggaggtgcaac

SEQ ID NO: 42439 - DNA, 20 bp, Artificial Sequence
  Description of Artificial Sequence: Synthetic oligonucleotide
  Target: ATXN1; (-) strand; PAM type: NRG; PAM sequence: CAG
cagctgacctggaggtgcaa

SEQ ID NO: 42440 - DNA, 20 bp, Artificial Sequence
  Description of Artificial Sequence: Synthetic oligonucleotide
  Target: ATXN1; (-) strand; PAM type: NRG; PAM sequence: AGG
cacgcccgcagctgacctgg

SEQ ID NO: 42441 - DNA, 20 bp, Artificial Sequence
  Description of Artificial Sequence: Synthetic oligonucleotide
  Target: ATXN1; (-) strand; PAM type: NRG; PAM sequence: GAG
acacgcccgcagctgacctg

SEQ ID NO: 42442 - DNA, 20 bp, Artificial Sequence
  Description of Artificial Sequence: Synthetic oligonucleotide
  Target: ATXN1; (-) strand; PAM type: NRG; PAM sequence: TGG
caacacgcccgcagctgacc

SEQ ID NO: 42443 - DNA, 20 bp, Artificial Sequence
  Description of Artificial Sequence: Synthetic oligonucleotide
  Target: ATXN1; (-) strand; PAM type: NRG; PAM sequence: CAG
gcccaacagcaacacgcccg

SEQ ID NO: 42444 - DNA, 20 bp, Artificial Sequence
  Description of Artificial Sequence: Synthetic oligonucleotide
  Target: ATXN1; (-) strand; PAM type: NRG; PAM sequence: CAG
tctgtgatggtcctgcccaa

SEQ ID NO: 42445 - DNA, 20 bp, Artificial Sequence
  Description of Artificial Sequence: Synthetic oligonucleotide
  Target: ATXN1; (-) strand; PAM type: NRG; PAM sequence: TGG
gggggtccgggcctctgtga

SEQ ID NO: 42446 - DNA, 20 bp, Artificial Sequence
  Description of Artificial Sequence: Synthetic oligonucleotide
  Target: ATXN1; (-) strand; PAM type: NRG; PAM sequence: GGG
tcgtgatccttcgggggtcc

SEQ ID NO: 42447 - DNA, 20 bp, Artificial Sequence
  Description of Artificial Sequence: Synthetic oligonucleotide
  Target: ATXN1; (-) strand; PAM type: NRG; PAM sequence: CGG
gtcgtgatccttcgggggtc

SEQ ID NO: 42448 - DNA, 20 bp, Artificial Sequence
  Description of Artificial Sequence: Synthetic oligonucleotide
  Target: ATXN1; (-) strand; PAM type: NRG; PAM sequence: GGG
cagcagtcgtgatccttcgg

SEQ ID NO: 42449 - DNA, 20 bp, Artificial Sequence
  Description of Artificial Sequence: Synthetic oligonucleotide
  Target: ATXN1; (-) strand; PAM type: NRG; PAM sequence: GGG
acagcagtcgtgatccttcg

SEQ ID NO: 42450 - DNA, 20 bp, Artificial Sequence
  Description of Artificial Sequence: Synthetic oligonucleotide
  Target: ATXN1; (-) strand; PAM type: NRG; PAM sequence: GGG
tacagcagtcgtgatccttc

SEQ ID NO: 42451 - DNA, 20 bp, Artificial Sequence
  Description of Artificial Sequence: Synthetic oligonucleotide
  Target: ATXN1; (-) strand; PAM type: NRG; PAM sequence: CGG
ctacagcagtcgtgatcctt

SEQ ID NO: 42452 - DNA, 20 bp, Artificial Sequence
  Description of Artificial Sequence: Synthetic oligonucleotide
  Target: ATXN1; (-) strand; PAM type: NRG; PAM sequence: CAG
ccgagcccctcagactacag

SEQ ID NO: 42453 - DNA, 20 bp, Artificial Sequence
  Description of Artificial Sequence: Synthetic oligonucleotide
  Target: ATXN1; (-) strand; PAM type: NRG; PAM sequence: CAG
cacccgagcccctcagacta

SEQ ID NO: 42454 - DNA, 20 bp, Artificial Sequence
  Description of Artificial Sequence: Synthetic oligonucleotide
  Target: ATXN1; (-) strand; PAM type: NRG; PAM sequence: CAG
ggtggtccacccgagcccct

SEQ ID NO: 42455 - DNA, 20 bp, Artificial Sequence
  Description of Artificial Sequence: Synthetic oligonucleotide
  Target: ATXN1; (-) strand; PAM type: NRG; PAM sequence: GAG
aggcacgtggtggtccaccc

SEQ ID NO: 42456 - DNA, 20 bp, Artificial Sequence
  Description of Artificial Sequence: Synthetic oligonucleotide
  Target: ATXN1; (-) strand; PAM type: NRG; PAM sequence: TGG
gtacgagtccaggcacgtgg

SEQ ID NO: 42457 - DNA, 20 bp, Artificial Sequence
  Description of Artificial Sequence: Synthetic oligonucleotide
  Target: ATXN1; (-) strand; PAM type: NRG; PAM sequence: TGG
cccgtacgagtccaggcacg

SEQ ID NO: 42458 - DNA, 20 bp, Artificial Sequence
  Description of Artificial Sequence: Synthetic oligonucleotide
  Target: ATXN1; (-) strand; PAM type: NRG; PAM sequence: AGG
ttcctcacccgtacgagtcc

SEQ ID NO: 42459 - DNA, 20 bp, Artificial Sequence
  Description of Artificial Sequence: Synthetic oligonucleotide
  Target: ATXN1; (-) strand; PAM type: NRG; PAM sequence: CAG
gttcctcacccgtacgagtc

SEQ ID NO: 42460 - DNA, 20 bp, Artificial Sequence
  Description of Artificial Sequence: Synthetic oligonucleotide
  Target: ATXN1; (-) strand; PAM type: NRG; PAM sequence: GAG
agtcggttcctcacccgtac

SEQ ID NO: 42461 - DNA, 20 bp, Artificial Sequence
  Description of Artificial Sequence: Synthetic oligonucleotide
  Target: ATXN1; (-) strand; PAM type: NRG; PAM sequence: CGG
gggcaaggcaggcggcaagt

SEQ ID NO: 42462 - DNA, 20 bp, Artificial Sequence
  Description of Artificial Sequence: Synthetic oligonucleotide
  Target: ATXN1; (-) strand; PAM type: NRG; PAM sequence: AAG
gcctgggcaaggcaggcggc

SEQ ID NO: 42463 - DNA, 20 bp, Artificial Sequence
  Description of Artificial Sequence: Synthetic oligonucleotide
  Target: ATXN1; (-) strand; PAM type: NRG; PAM sequence: CGG
ctgggcctgggcaaggcagg

SEQ ID NO: 42464 - DNA, 20 bp, Artificial Sequence
  Description of Artificial Sequence: Synthetic oligonucleotide
  Target: ATXN1; (-) strand; PAM type: NRG; PAM sequence: AGG
gacctgggcctgggcaaggc

SEQ ID NO: 42465 - DNA, 20 bp, Artificial Sequence
  Description of Artificial Sequence: Synthetic oligonucleotide
  Target: ATXN1; (-) strand; PAM type: NRG; PAM sequence: CAG
cgacctgggcctgggcaagg

SEQ ID NO: 42466 - DNA, 20 bp, Artificial Sequence
  Description of Artificial Sequence: Synthetic oligonucleotide
  Target: ATXN1; (-) strand; PAM type: NRG; PAM sequence: AGG
agccgacctgggcctgggca

SEQ ID NO: 42467 - DNA, 20 bp, Artificial Sequence
  Description of Artificial Sequence: Synthetic oligonucleotide
  Target: ATXN1; (-) strand; PAM type: NRG; PAM sequence: AAG
cagccgacctgggcctgggc

SEQ ID NO: 42468 - DNA, 20 bp, Artificial Sequence
  Description of Artificial Sequence: Synthetic oligonucleotide
  Target: ATXN1; (-) strand; PAM type: NRG; PAM sequence: GGG
tcctcagccgacctgggcct

SEQ ID NO: 42469 - DNA, 20 bp, Artificial Sequence
  Description of Artificial Sequence: Synthetic oligonucleotide
  Target: ATXN1; (-) strand; PAM type: NRG; PAM sequence: TGG
gtcctcagccgacctgggcc

SEQ ID NO: 42470 - DNA, 20 bp, Artificial Sequence
  Description of Artificial Sequence: Synthetic oligonucleotide
  Target: ATXN1; (-) strand; PAM type: NRG; PAM sequence: GGG
gccccgtcctcagccgacct

SEQ ID NO: 42471 - DNA, 20 bp, Artificial Sequence
  Description of Artificial Sequence: Synthetic oligonucleotide
  Target: ATXN1; (-) strand; PAM type: NRG; PAM sequence: TGG
ggccccgtcctcagccgacc

SEQ ID NO: 42472 - DNA, 20 bp, Artificial Sequence
  Description of Artificial Sequence: Synthetic oligonucleotide
  Target: ATXN1; (-) strand; PAM type: NRG; PAM sequence: CAG
gcggtacggggccccgtcct

SEQ ID NO: 42473 - DNA, 20 bp, Artificial Sequence
  Description of Artificial Sequence: Synthetic oligonucleotide
  Target: ATXN1; (-) strand; PAM type: NRG; PAM sequence: GGG
ggagaagagccggcggtacg

SEQ ID NO: 42474 - DNA, 20 bp, Artificial Sequence
  Description of Artificial Sequence: Synthetic oligonucleotide
  Target: ATXN1; (-) strand; PAM type: NRG; PAM sequence: GGG
tggagaagagccggcggtac

SEQ ID NO: 42475 - DNA, 20 bp, Artificial Sequence
  Description of Artificial Sequence: Synthetic oligonucleotide
  Target: ATXN1; (-) strand; PAM type: NRG; PAM sequence: CGG
atggagaagagccggcggta

SEQ ID NO: 42476 - DNA, 20 bp, Artificial Sequence
  Description of Artificial Sequence: Synthetic oligonucleotide
  Target: ATXN1; (-) strand; PAM type: NRG; PAM sequence: CGG
gtgagatggagaagagccgg

SEQ ID NO: 42477 - DNA, 20 bp, Artificial Sequence
  Description of Artificial Sequence: Synthetic oligonucleotide
  Target: ATXN1; (-) strand; PAM type: NRG; PAM sequence: CGG
acggtgagatggagaagagc

SEQ ID NO: 42478 - DNA, 20 bp, Artificial Sequence
  Description of Artificial Sequence: Synthetic oligonucleotide
  Target: ATXN1; (-) strand; PAM type: NRG; PAM sequence: GAG
ctgaacggtgagatggagaa

SEQ ID NO: 42479 - DNA, 20 bp, Artificial Sequence
  Description of Artificial Sequence: Synthetic oligonucleotide
  Target: ATXN1; (-) strand; PAM type: NRG; PAM sequence: AAG
tcctgaacggtgagatggag

SEQ ID NO: 42480 - DNA, 20 bp, Artificial Sequence
  Description of Artificial Sequence: Synthetic oligonucleotide
  Target: ATXN1; (-) strand; PAM type: NRG; PAM sequence: GAG
aggtcctgaacggtgagatg

SEQ ID NO: 42481 - DNA, 20 bp, Artificial Sequence
  Description of Artificial Sequence: Synthetic oligonucleotide
  Target: ATXN1; (-) strand; PAM type: NRG; PAM sequence: TGG
ggaggtcctgaacggtgaga

SEQ ID NO: 42482 - DNA, 20 bp, Artificial Sequence
  Description of Artificial Sequence: Synthetic oligonucleotide
  Target: ATXN1; (-) strand; PAM type: NRG; PAM sequence: GAG
ccaaggaggtcctgaacggt

SEQ ID NO: 42483 - DNA, 20 bp, Artificial Sequence
  Description of Artificial Sequence: Synthetic oligonucleotide
  Target: ATXN1; (-) strand; PAM type: NRG; PAM sequence: CGG
caggccaaggaggtcctgaa

SEQ ID NO: 42484 - DNA, 20 bp, Artificial Sequence
  Description of Artificial Sequence: Synthetic oligonucleotide
  Target: ATXN1; (-) strand; PAM type: NRG; PAM sequence: AGG
gcaggccatccaggccaagg

SEQ ID NO: 42485 - DNA, 20 bp, Artificial Sequence
  Description of Artificial Sequence: Synthetic oligonucleotide
  Target: ATXN1; (-) strand; PAM type: NRG; PAM sequence: GAG
agcaggccatccaggccaag

SEQ ID NO: 42486 - DNA, 20 bp, Artificial Sequence
  Description of Artificial Sequence: Synthetic oligonucleotide
  Target: ATXN1; (-) strand; PAM type: NRG; PAM sequence: AGG
gcagcaggccatccaggcca

SEQ ID NO: 42487 - DNA, 20 bp, Artificial Sequence
  Description of Artificial Sequence: Synthetic oligonucleotide
  Target: ATXN1; (-) strand; PAM type: NRG; PAM sequence: AAG
tgcagcaggccatccaggcc

SEQ ID NO: 42488 - DNA, 20 bp, Artificial Sequence
  Description of Artificial Sequence: Synthetic oligonucleotide
  Target: ATXN1; (-) strand; PAM type: NRG; PAM sequence: AGG
ccggctgcagcaggccatcc

SEQ ID NO: 42489 - DNA, 20 bp, Artificial Sequence
  Description of Artificial Sequence: Synthetic oligonucleotide
  Target: ATXN1; (-) strand; PAM type: NRG; PAM sequence: CAG
gccggctgcagcaggccatc

SEQ ID NO: 42490 - DNA, 20 bp, Artificial Sequence
  Description of Artificial Sequence: Synthetic oligonucleotide
  Target: ATXN1; (-) strand; PAM type: NRG; PAM sequence: AGG
tgagagcagccggctgcagc

SEQ ID NO: 42491 - DNA, 20 bp, Artificial Sequence
  Description of Artificial Sequence: Synthetic oligonucleotide
  Target: ATXN1; (-) strand; PAM type: NRG; PAM sequence: CAG
ctgagagcagccggctgcag

SEQ ID NO: 42492 - DNA, 20 bp, Artificial Sequence
  Description of Artificial Sequence: Synthetic oligonucleotide
  Target: ATXN1; (-) strand; PAM type: NRG; PAM sequence: CAG
aagctgagagcagccggctg

SEQ ID NO: 42493 - DNA, 20 bp, Artificial Sequence
  Description of Artificial Sequence: Synthetic oligonucleotide
  Target: ATXN1; (-) strand; PAM type: NRG; PAM sequence: CGG
ccaagaaagctgagagcagc

SEQ ID NO: 42494 - DNA, 20 bp, Artificial Sequence
  Description of Artificial Sequence: Synthetic oligonucleotide
  Target: ATXN1; (-) strand; PAM type: NRG; PAM sequence: CAG
gccaccaagaaagctgagag

SEQ ID NO: 42495 - DNA, 20 bp, Artificial Sequence
  Description of Artificial Sequence: Synthetic oligonucleotide
  Target: ATXN1; (-) strand; PAM type: NRG; PAM sequence: GAG
gaggccaccaagaaagctga

SEQ ID NO: 42496 - DNA, 20 bp, Artificial Sequence
  Description of Artificial Sequence: Synthetic oligonucleotide
  Target: ATXN1; (-) strand; PAM type: NRG; PAM sequence: GAG
gggaggccaccaagaaagct

SEQ ID NO: 42497 - DNA, 20 bp, Artificial Sequence
  Description of Artificial Sequence: Synthetic oligonucleotide
  Target: ATXN1; (-) strand; PAM type: NRG; PAM sequence: AAG
ccctcgggaggccaccaaga

SEQ ID NO: 42498 - DNA, 20 bp, Artificial Sequence
  Description of Artificial Sequence: Synthetic oligonucleotide
  Target: ATXN1; (-) strand; PAM type: NRG; PAM sequence: AAG
ttgtccctcgggaggccacc

SEQ ID NO: 42499 - DNA, 20 bp, Artificial Sequence
  Description of Artificial Sequence: Synthetic oligonucleotide
  Target: ATXN1; (-) strand; PAM type: NRG; PAM sequence: AGG
cagccactttgtccctcggg

SEQ ID NO: 42500 - DNA, 20 bp, Artificial Sequence
  Description of Artificial Sequence: Synthetic oligonucleotide
  Target: ATXN1; (-) strand; PAM type: NRG; PAM sequence: GAG
gcagccactttgtccctcgg

SEQ ID NO: 42501 - DNA, 20 bp, Artificial Sequence
  Description of Artificial Sequence: Synthetic oligonucleotide
  Target: ATXN1; (-) strand; PAM type: NRG; PAM sequence: GGG
cggcagccactttgtccctc

SEQ ID NO: 42502 - DNA, 20 bp, Artificial Sequence
  Description of Artificial Sequence: Synthetic oligonucleotide
  Target: ATXN1; (-) strand; PAM type: NRG; PAM sequence: CGG
ccggcagccactttgtccct

SEQ ID NO: 42503 - DNA, 20 bp, Artificial Sequence
  Description of Artificial Sequence: Synthetic oligonucleotide
  Target: ATXN1; (-) strand; PAM type: NRG; PAM sequence: CAG
atgcaatacgccgactccgg

SEQ ID NO: 42504 - DNA, 20 bp, Artificial Sequence
  Description of Artificial Sequence: Synthetic oligonucleotide
  Target: ATXN1; (-) strand; PAM type: NRG; PAM sequence: CGG
gtcatgcaatacgccgactc

SEQ ID NO: 42505 - DNA, 20 bp, Artificial Sequence
  Description of Artificial Sequence: Synthetic oligonucleotide
  Target: ATXN1; (-) strand; PAM type: NRG; PAM sequence: AGG
caccctggggcccccctccc

SEQ ID NO: 42506 - DNA, 20 bp, Artificial Sequence
  Description of Artificial Sequence: Synthetic oligonucleotide
  Target: ATXN1; (-) strand; PAM type: NRG; PAM sequence: CAG
tcaccctggggcccccctcc

SEQ ID NO: 42507 - DNA, 20 bp, Artificial Sequence
  Description of Artificial Sequence: Synthetic oligonucleotide
  Target: ATXN1; (-) strand; PAM type: NRG; PAM sequence: GGG
tcccacacacgctcaccctg

SEQ ID NO: 42508 - DNA, 20 bp, Artificial Sequence
  Description of Artificial Sequence: Synthetic oligonucleotide
  Target: ATXN1; (-) strand; PAM type: NRG; PAM sequence: GGG
atcccacacacgctcaccct

SEQ ID NO: 42509 - DNA, 20 bp, Artificial Sequence
  Description of Artificial Sequence: Synthetic oligonucleotide
  Target: ATXN1; (-) strand; PAM type: NRG; PAM sequence: TGG
gatcccacacacgctcaccc

SEQ ID NO: 42510 - DNA, 20 bp, Artificial Sequence
  Description of Artificial Sequence: Synthetic oligonucleotide
  Target: ATXN1; (-) strand; PAM type: NRG; PAM sequence: CAG
ccgtccacctccacccccac

SEQ ID NO: 42511 - DNA, 20 bp, Artificial Sequence
  Description of Artificial Sequence: Synthetic oligonucleotide
  Target: ATXN1; (-) strand; PAM type: NRG; PAM sequence: CGG
cggccgcaccgcctctcctc

SEQ ID NO: 42512 - DNA, 20 bp, Artificial Sequence
  Description of Artificial Sequence: Synthetic oligonucleotide
  Target: ATXN1; (-) strand; PAM type: NRG; PAM sequence: CGG
tccagttctccgcagaacac

SEQ ID NO: 42513 - DNA, 20 bp, Artificial Sequence
  Description of Artificial Sequence: Synthetic oligonucleotide
  Target: ATXN1; (-) strand; PAM type: NRG; PAM sequence: CAG
tccacatttccagttctccg

SEQ ID NO: 42514 - DNA, 20 bp, Artificial Sequence
  Description of Artificial Sequence: Synthetic oligonucleotide
  Target: ATXN1; (-) strand; PAM type: NRG; PAM sequence: CAG
aaccagtacgtccacatttc

SEQ ID NO: 42515 - DNA, 20 bp, Artificial Sequence
  Description of Artificial Sequence: Synthetic oligonucleotide
  Target: ATXN1; (-) strand; PAM type: NRG; PAM sequence: CAG
ccccaccagcccagcagaac

SEQ ID NO: 42516 - DNA, 20 bp, Artificial Sequence
  Description of Artificial Sequence: Synthetic oligonucleotide
  Target: ATXN1; (-) strand; PAM type: NRG; PAM sequence: CAG
ggtcccccccaccagcccag

SEQ ID NO: 42517 - DNA, 20 bp, Artificial Sequence
  Description of Artificial Sequence: Synthetic oligonucleotide
  Target: ATXN1; (-) strand; PAM type: NRG; PAM sequence: CAG
cggggtcccccccaccagcc

SEQ ID NO: 42518 - DNA, 20 bp, Artificial Sequence
  Description of Artificial Sequence: Synthetic oligonucleotide
  Target: ATXN1; (-) strand; PAM type: NRG; PAM sequence: CAG
caccccggggtcccccccac

SEQ ID NO: 42519 - DNA, 20 bp, Artificial Sequence
  Description of Artificial Sequence: Synthetic oligonucleotide
  Target: ATXN1; (-) strand; PAM type: NRG; PAM sequence: GGG
ctccggggctcatcaccccg

SEQ ID NO: 42520 - DNA, 20 bp, Artificial Sequence
  Description of Artificial Sequence: Synthetic oligonucleotide
  Target: ATXN1; (-) strand; PAM type: NRG; PAM sequence: GGG
gctccggggctcatcacccc

SEQ ID NO: 42521 - DNA, 20 bp, Artificial Sequence
  Description of Artificial Sequence: Synthetic oligonucleotide
  Target: ATXN1; (-) strand; PAM type: NRG; PAM sequence: CGG
ggctccggggctcatcaccc

SEQ ID NO: 42522 - DNA, 20 bp, Artificial Sequence
  Description of Artificial Sequence: Synthetic oligonucleotide
  Target: ATXN1; (-) strand; PAM type: NRG; PAM sequence: GGG
agcacctcagcagggctccg

SEQ ID NO: 42523 - DNA, 20 bp, Artificial Sequence
  Description of Artificial Sequence: Synthetic oligonucleotide
  Target: ATXN1; (-) strand; PAM type: NRG; PAM sequence: GGG
cagcacctcagcagggctcc

SEQ ID NO: 42524 - DNA, 20 bp, Artificial Sequence
  Description of Artificial Sequence: Synthetic oligonucleotide
  Target: ATXN1; (-) strand; PAM type: NRG; PAM sequence: CGG
gcagcacctcagcagggctc

SEQ ID NO: 42525 - DNA, 20 bp, Artificial Sequence
  Description of Artificial Sequence: Synthetic oligonucleotide
  Target: ATXN1; (-) strand; PAM type: NRG; PAM sequence: GGG
gcagcagcagcacctcagca

SEQ ID NO: 42526 - DNA, 20 bp, Artificial Sequence
  Description of Artificial Sequence: Synthetic oligonucleotide
  Target: ATXN1; (-) strand; PAM type: NRG; PAM sequence: AGG
agcagcagcagcacctcagc

SEQ ID NO: 42527 - DNA, 20 bp, Artificial Sequence
  Description of Artificial Sequence: Synthetic oligonucleotide
  Target: ATXN1; (-) strand; PAM type: NRG; PAM sequence: CAG
cagcagcagcagcacctcag

SEQ ID NO: 42528 - DNA, 20 bp, Artificial Sequence
  Description of Artificial Sequence: Synthetic oligonucleotide
  Target: ATXN1; (-) strand; PAM type: NRG; PAM sequence: CAG
cagcagcagcagcagcacct

SEQ ID NO: 42529 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42530 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42531 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42532 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42533 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42534 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42535 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42536 - DNA, 20 bp, Artificial Sequence
  Description of Artificial Sequence: Synthetic oligonucleotide
  Target: ATXN1; (-) strand; PAM type: NRG; PAM sequence: CAG
atcagcagcagcagcagcag

SEQ ID NO: 42537 - DNA, 20 bp, Artificial Sequence
  Description of Artificial Sequence: Synthetic oligonucleotide
  Target: ATXN1; (-) strand; PAM type: NRG; PAM sequence: CAG
agcatcagcagcagcagcag

SEQ ID NO: 42538 - DNA, 20 bp, Artificial Sequence
  Description of Artificial Sequence: Synthetic oligonucleotide
  Target: ATXN1; (-) strand; PAM type: NRG; PAM sequence: CAG
atcagcatcagcagcagcag

SEQ ID NO: 42539 - DNA, 20 bp, Artificial Sequence
  Description of Artificial Sequence: Synthetic oligonucleotide
  Target: ATXN1; (-) strand; PAM type: NRG; PAM sequence: CAG
agcatcagcatcagcagcag

SEQ ID NO: 42540 - DNA, 20 bp, Artificial Sequence
  Description of Artificial Sequence: Synthetic oligonucleotide
  Target: ATXN1; (-) strand; PAM type: NRG; PAM sequence: CAG
agcagcatcagcatcagcag

SEQ ID NO: 42541 - DNA, 20 bp, Artificial Sequence
  Description of Artificial Sequence: Synthetic oligonucleotide
  Target: ATXN1; (-) strand; PAM type: NRG; PAM sequence: CAG
agcagcagcatcagcatcag

SEQ ID NO: 42542 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcatcagcat

SEQ ID NO: 42543 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcat

SEQ ID NO: 42544 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42545 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42546 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42547 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42548 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42549 - DNA, 20 bp, Artificial Sequence
  Description of Artificial Sequence: Synthetic oligonucleotide
  Target: ATXN1; (-) strand; PAM type: NRG; PAM sequence: CAG
agcagcagcagcagcagcag

SEQ ID NO: 42550 - DNA, 20 bp, Artificial Sequence
  Description of Artificial Sequence: Synthetic oligonucleotide
  Target: ATXN1; (-) strand; PAM type: NRG; PAM sequence: CAG
ctgagcagcagcagcagcag

SEQ ID NO: 42551 - DNA, 20 bp, Artificial Sequence
  Description of Artificial Sequence: Synthetic oligonucleotide
  Target: ATXN1; (-) strand; PAM type: NRG; PAM sequence: CAG
aggctgagcagcagcagcag

SEQ ID NO: 42552 - DNA, 20 bp, Artificial Sequence
  Description of Artificial Sequence: Synthetic oligonucleotide
  Target: ATXN1; (-) strand; PAM type: NRG; PAM sequence: CAG
acaaggctgagcagcagcag

SEQ ID NO: 42553 - DNA, 20 bp, Artificial Sequence
  Description of Artificial Sequence: Synthetic oligonucleotide
  Target: ATXN1; (-) strand; PAM type: NRG; PAM sequence: CAG
gacacaaggctgagcagcag

SEQ ID NO: 42554 - DNA, 20 bp, Artificial Sequence
  Description of Artificial Sequence: Synthetic oligonucleotide
  Target: ATXN1; (-) strand; PAM type: NRG; PAM sequence: CAG
cgggacacaaggctgagcag

SEQ ID NO: 42555 - DNA, 20 bp, Artificial Sequence
  Description of Artificial Sequence: Synthetic oligonucleotide
  Target: ATXN1; (-) strand; PAM type: NRG; PAM sequence: CAG
cgccgggacacaaggctgag

SEQ ID NO: 42556 - DNA, 20 bp, Artificial Sequence
  Description of Artificial Sequence: Synthetic oligonucleotide
  Target: ATXN1; (-) strand; PAM type: NRG; PAM sequence: GAG
agacgccgggacacaaggct

SEQ ID NO: 42557 - DNA, 20 bp, Artificial Sequence
  Description of Artificial Sequence: Synthetic oligonucleotide
  Target: ATXN1; (-) strand; PAM type: NRG; PAM sequence: AGG
gagccagacgccgggacaca

SEQ ID NO: 42558 - DNA, 20 bp, Artificial Sequence
  Description of Artificial Sequence: Synthetic oligonucleotide
  Target: ATXN1; (-) strand; PAM type: NRG; PAM sequence: AAG
tgagccagacgccgggacac

SEQ ID NO: 42559 - DNA, 20 bp, Artificial Sequence
  Description of Artificial Sequence: Synthetic oligonucleotide
  Target: ATXN1; (-) strand; PAM type: NRG; PAM sequence: GGG
ggcagtctgagccagacgcc

SEQ ID NO: 42560 - DNA, 20 bp, Artificial Sequence
  Description of Artificial Sequence: Synthetic oligonucleotide
  Target: ATXN1; (-) strand; PAM type: NRG; PAM sequence: CGG
gggcagtctgagccagacgc

SEQ ID NO: 42561 - DNA, 20 bp, Artificial Sequence
  Description of Artificial Sequence: Synthetic oligonucleotide
  Target: ATXN1; (-) strand; PAM type: NRG; PAM sequence: CAG
ccaacatgggcagtctgagc

SEQ ID NO: 42562 - DNA, 20 bp, Artificial Sequence
  Description of Artificial Sequence: Synthetic oligonucleotide
  Target: ATXN1; (-) strand; PAM type: NRG; PAM sequence: GAG
ctggccaacatgggcagtct

SEQ ID NO: 42563 - DNA, 20 bp, Artificial Sequence
  Description of Artificial Sequence: Synthetic oligonucleotide
  Target: ATXN1; (-) strand; PAM type: NRG; PAM sequence: CAG
actctgctggccaacatggg

SEQ ID NO: 42564 - DNA, 20 bp, Artificial Sequence
  Description of Artificial Sequence: Synthetic oligonucleotide
  Target: ATXN1; (-) strand; PAM type: NRG; PAM sequence: GGG
tccactctgctggccaacat

SEQ ID NO: 42565 - DNA, 20 bp, Artificial Sequence
  Description of Artificial Sequence: Synthetic oligonucleotide
  Target: ATXN1; (-) strand; PAM type: NRG; PAM sequence: TGG
ttccactctgctggccaaca

SEQ ID NO: 42566 - DNA, 20 bp, Artificial Sequence
  Description of Artificial Sequence: Synthetic oligonucleotide
  Target: ATXN1; (-) strand; PAM type: NRG; PAM sequence: TGG
ggaggcctattccactctgc

SEQ ID NO: 42567 - DNA, 20 bp, Artificial Sequence
  Description of Artificial Sequence: Synthetic oligonucleotide
  Target: ATXN1; (-) strand; PAM type: NRG; PAM sequence: AGG
atcccagcgctcccagctgg

SEQ ID NO: 42568 - DNA, 20 bp, Artificial Sequence
  Description of Artificial Sequence: Synthetic oligonucleotide
  Target: ATXN1; (-) strand; PAM type: NRG; PAM sequence: GAG
catcccagcgctcccagctg

SEQ ID NO: 42569 - DNA, 20 bp, Artificial Sequence
  Description of Artificial Sequence: Synthetic oligonucleotide
  Target: ATXN1; (-) strand; PAM type: NRG; PAM sequence: TGG
tccatcccagcgctcccagc

SEQ ID NO: 42570 - DNA, 20 bp, Artificial Sequence
  Description of Artificial Sequence: Synthetic oligonucleotide
  Target: ATXN1; (-) strand; PAM type: NRG; PAM sequence: CAG
ccactccatcccagcgctcc

SEQ ID NO: 42571 - DNA, 20 bp, Artificial Sequence
  Description of Artificial Sequence: Synthetic oligonucleotide
  Target: ATXN1; (-) strand; PAM type: NRG; PAM sequence: CAG
caggggccaccactccatcc

SEQ ID NO: 42572 - DNA, 20 bp, Artificial Sequence
  Description of Artificial Sequence: Synthetic oligonucleotide
  Target: ATXN1; (-) strand; PAM type: NRG; PAM sequence: GGG
tgcagtggcctcggccgcag

SEQ ID NO: 42573 - DNA, 20 bp, Artificial Sequence
  Description of Artificial Sequence: Synthetic oligonucleotide
  Target: ATXN1; (-) strand; PAM type: NRG; PAM sequence: GGG
gtgcagtggcctcggccgca

SEQ ID NO: 42574 - DNA, 20 bp, Artificial Sequence
  Description of Artificial Sequence: Synthetic oligonucleotide
  Target: ATXN1; (-) strand; PAM type: NRG; PAM sequence: AGG
agtgcagtggcctcggccgc

SEQ ID NO: 42575 - DNA, 20 bp, Artificial Sequence
  Description of Artificial Sequence: Synthetic oligonucleotide
  Target: ATXN1; (-) strand; PAM type: NRG; PAM sequence: CAG
cagtgcagtggcctcggccg

SEQ ID NO: 42576 - DNA, 20 bp, Artificial Sequence
  Description of Artificial Sequence: Synthetic oligonucleotide
  Target: ATXN1; (-) strand; PAM type: NRG; PAM sequence: CGG
cgtcaccagtgcagtggcct

SEQ ID NO: 42577 - DNA, 20 bp, Artificial Sequence
  Description of Artificial Sequence: Synthetic oligonucleotide
  Target: ATXN1; (-) strand; PAM type: NRG; PAM sequence: TGG
caaccccgtcaccagtgcag

SEQ ID NO: 42578 - DNA, 20 bp, Artificial Sequence
  Description of Artificial Sequence: Synthetic oligonucleotide
  Target: ATXN1; (-) strand; PAM type: NRG; PAM sequence: CAG
cgccaaccccgtcaccagtg

SEQ ID NO: 42579 - DNA, 20 bp, Artificial Sequence
  Description of Artificial Sequence: Synthetic oligonucleotide
  Target: ATXN1; (-) strand; PAM type: NRG; PAM sequence: CAG
ccaaccgccaaccccgtcac

SEQ ID NO: 42580 - DNA, 20 bp, Artificial Sequence
  Description of Artificial Sequence: Synthetic oligonucleotide
  Target: ATXN1; (-) strand; PAM type: NRG; PAM sequence: CAG
atgccagcttcatcccatca

SEQ ID NO: 42581 - DNA, 20 bp, Artificial Sequence
  Description of Artificial Sequence: Synthetic oligonucleotide
  Target: ATXN1; (-) strand; PAM type: NRG; PAM sequence: CAG
caatacagtggaacctatgc

SEQ ID NO: 42582 - DNA, 20 bp, Artificial Sequence
  Description of Artificial Sequence: Synthetic oligonucleotide
  Target: ATXN1; (-) strand; PAM type: NRG; PAM sequence: TGG
attgggtcctcccaatacag

SEQ ID NO: 42583 - DNA, 20 bp, Artificial Sequence
  Description of Artificial Sequence: Synthetic oligonucleotide
  Target: ATXN1; (-) strand; PAM type: NRG; PAM sequence: CAG
ttcattgggtcctcccaata

SEQ ID NO: 42584 - DNA, 20 bp, Artificial Sequence
  Description of Artificial Sequence: Synthetic oligonucleotide
  Target: ATXN1; (-) strand; PAM type: NRG; PAM sequence: GGG
cgcacaccttccagttcatt

SEQ ID NO: 42585 - DNA, 20 bp, Artificial Sequence
  Description of Artificial Sequence: Synthetic oligonucleotide
  Target: ATXN1; (-) strand; PAM type: NRG; PAM sequence: TGG
ccgcacaccttccagttcat

SEQ ID NO: 42586 - DNA, 20 bp, Artificial Sequence
  Description of Artificial Sequence: Synthetic oligonucleotide
  Target: ATXN1; (-) strand; PAM type: NRG; PAM sequence: CAG
ctcacctgccgcacaccttc

SEQ ID NO: 42587 - DNA, 20 bp, Artificial Sequence
  Description of Artificial Sequence: Synthetic oligonucleotide
  Target: ATXN1; (-) strand; PAM type: NRG; PAM sequence: CAG
ggaccccggtgtcccccgtg

SEQ ID NO: 42588 - DNA, 20 bp, Artificial Sequence
  Description of Artificial Sequence: Synthetic oligonucleotide
  Target: ATXN1; (-) strand; PAM type: NRG; PAM sequence: CGG
caccccgcagccagggaccc

SEQ ID NO: 42589 - DNA, 20 bp, Artificial Sequence
  Description of Artificial Sequence: Synthetic oligonucleotide
  Target: ATXN1; (-) strand; PAM type: NRG; PAM sequence: GGG
cgtacgccaccccgcagcca

SEQ ID NO: 42590 - DNA, 20 bp, Artificial Sequence
  Description of Artificial Sequence: Synthetic oligonucleotide
  Target: ATXN1; (-) strand; PAM type: NRG; PAM sequence: AGG
gcgtacgccaccccgcagcc

SEQ ID NO: 42591 - DNA, 20 bp, Artificial Sequence
  Description of Artificial Sequence: Synthetic oligonucleotide
  Target: ATXN1; (-) strand; PAM type: NRG; PAM sequence: CAG
cgcgtacgccaccccgcagc

SEQ ID NO: 42592 - DNA, 20 bp, Artificial Sequence
  Description of Artificial Sequence: Synthetic oligonucleotide
  Target: ATXN1; (-) strand; PAM type: NRG; PAM sequence: CAG
ctgccgcgtacgccaccccg

SEQ ID NO: 42593 - DNA, 20 bp, Artificial Sequence
  Description of Artificial Sequence: Synthetic oligonucleotide
  Target: ATXN1; (-) strand; PAM type: NRG; PAM sequence: TGG
cgctcccaggtctgtccccg

SEQ ID NO: 42594 - DNA, 20 bp, Artificial Sequence
  Description of Artificial Sequence: Synthetic oligonucleotide
  Target: ATXN1; (-) strand; PAM type: NRG; PAM sequence: AGG
actccccgcccagcgctccc

SEQ ID NO: 42595 - DNA, 20 bp, Artificial Sequence
  Description of Artificial Sequence: Synthetic oligonucleotide
  Target: ATXN1; (-) strand; PAM type: NRG; PAM sequence: CAG
tactccccgcccagcgctcc

SEQ ID NO: 42596 - DNA, 20 bp, Artificial Sequence
  Description of Artificial Sequence: Synthetic oligonucleotide
  Target: ATXN1; (-) strand; PAM type: NRG; PAM sequence: CAG
gggctggactactccccgcc

SEQ ID NO: 42597 - DNA, 20 bp, Artificial Sequence
  Description of Artificial Sequence: Synthetic oligonucleotide
  Target: ATXN1; (-) strand; PAM type: NRG; PAM sequence: TGG
caaagcattgtccacagggc

SEQ ID NO: 42598 - DNA, 20 bp, Artificial Sequence
  Description of Artificial Sequence: Synthetic oligonucleotide
  Target: ATXN1; (-) strand; PAM type: NRG; PAM sequence: GGG
tacacaaagcattgtccaca

SEQ ID NO: 42599 - DNA, 20 bp, Artificial Sequence
  Description of Artificial Sequence: Synthetic oligonucleotide
  Target: ATXN1; (-) strand; PAM type: NRG; PAM sequence: AGG
ttacacaaagcattgtccac

SEQ ID NO: 42600 - DNA, 20 bp, Artificial Sequence
  Description of Artificial Sequence: Synthetic oligonucleotide
  Target: ATXN1; (-) strand; PAM type: NRG; PAM sequence: CAG
tttacacaaagcattgtcca

SEQ ID NO: 42601 - DNA, 20 bp, Artificial Sequence
  Description of Artificial Sequence: Synthetic oligonucleotide
  Target: ATXN1; (-) strand; PAM type: NRG; PAM sequence: AAG
acagggaataggtttacaca

SEQ ID NO: 42602 - DNA, 20 bp, Artificial Sequence
  Description of Artificial Sequence: Synthetic oligonucleotide
  Target: ATXN1; (-) strand; PAM type: NRG; PAM sequence: AGG
cttggtttacaacagggaat

SEQ ID NO: 42603 - DNA, 20 bp, Artificial Sequence
  Description of Artificial Sequence: Synthetic oligonucleotide
  Target: ATXN1; (-) strand; PAM type: NRG; PAM sequence: TAG
gcttggtttacaacagggaa

SEQ ID NO: 42604 - DNA, 20 bp, Artificial Sequence
  Description of Artificial Sequence: Synthetic oligonucleotide
  Target: ATXN1; (-) strand; PAM type: NRG; PAM sequence: GGG
gtggagcttggtttacaaca

SEQ ID NO: 42605 - DNA, 20 bp, Artificial Sequence
  Description of Artificial Sequence: Synthetic oligonucleotide
  Target: ATXN1; (-) strand; PAM type: NRG; PAM sequence: AGG
ggtggagcttggtttacaac

SEQ ID NO: 42606 - DNA, 20 bp, Artificial Sequence
  Description of Artificial Sequence: Synthetic oligonucleotide
  Target: ATXN1; (-) strand; PAM type: NRG; PAM sequence: CAG
cggtggagcttggtttacaa

SEQ ID NO: 42607 - DNA, 20 bp, Artificial Sequence
  Description of Artificial Sequence: Synthetic oligonucleotide
  Target: ATXN1; (-) strand; PAM type: NRG; PAM sequence: TGG
gcagggacctcggtggagct

SEQ ID NO: 42608 - DNA, 20 bp, Artificial Sequence
  Description of Artificial Sequence: Synthetic oligonucleotide
  Target: ATXN1; (-) strand; PAM type: NRG; PAM sequence: GAG
ggccggcagggacctcggtg

SEQ ID NO: 42609 - DNA, 20 bp, Artificial Sequence
  Description of Artificial Sequence: Synthetic oligonucleotide
  Target: ATXN1; (-) strand; PAM type: NRG; PAM sequence: TGG
tgggccggcagggacctcgg

SEQ ID NO: 42610 - DNA, 20 bp, Artificial Sequence
  Description of Artificial Sequence: Synthetic oligonucleotide
  Target: ATXN1; (-) strand; PAM type: NRG; PAM sequence: CGG
gcatgggccggcagggacct

SEQ ID NO: 42611 - DNA, 20 bp, Artificial Sequence
  Description of Artificial Sequence: Synthetic oligonucleotide
  Target: ATXN1; (-) strand; PAM type: NRG; PAM sequence: GGG
gcgggaggcatgggccggca

SEQ ID NO: 42612 - DNA, 20 bp, Artificial Sequence
  Description of Artificial Sequence: Synthetic oligonucleotide
  Target: ATXN1; (-) strand; PAM type: NRG; PAM sequence: AGG
ggcgggaggcatgggccggc

SEQ ID NO: 42613 - DNA, 20 bp, Artificial Sequence
  Description of Artificial Sequence: Synthetic oligonucleotide
  Target: ATXN1; (-) strand; PAM type: NRG; PAM sequence: CAG
gggcgggaggcatgggccgg

SEQ ID NO: 42614 - DNA, 20 bp, Artificial Sequence
  Description of Artificial Sequence: Synthetic oligonucleotide
  Target: ATXN1; (-) strand; PAM type: NRG; PAM sequence: CGG
cgggggcgggaggcatgggc

SEQ ID NO: 42615 - DNA, 20 bp, Artificial Sequence
  Description of Artificial Sequence: Synthetic oligonucleotide
  Target: ATXN1; (-) strand; PAM type: NRG; PAM sequence: GGG
gccacgggggcgggaggcat

SEQ ID NO: 42616 - DNA, 20 bp, Artificial Sequence
  Description of Artificial Sequence: Synthetic oligonucleotide
  Target: ATXN1; (-) strand; PAM type: NRG; PAM sequence: TGG
ggccacgggggcgggaggca

SEQ ID NO: 42617 - DNA, 20 bp, Artificial Sequence
  Description of Artificial Sequence: Synthetic oligonucleotide
  Target: ATXN1; (-) strand; PAM type: NRG; PAM sequence: AGG
gccggggccacgggggcggg

SEQ ID NO: 42618 - DNA, 20 bp, Artificial Sequence
  Description of Artificial Sequence: Synthetic oligonucleotide
  Target: ATXN1; (-) strand; PAM type: NRG; PAM sequence: GAG
ggccggggccacgggggcgg

SEQ ID NO: 42619 - DNA, 20 bp, Artificial Sequence
  Description of Artificial Sequence: Synthetic oligonucleotide
  Target: ATXN1; (-) strand; PAM type: NRG; PAM sequence: GGG
gtggccggggccacgggggc

SEQ ID NO: 42620 - DNA, 20 bp, Artificial Sequence
  Description of Artificial Sequence: Synthetic oligonucleotide
  Target: ATXN1; (-) strand; PAM type: NRG; PAM sequence: CGG
ggtggccggggccacggggg

SEQ ID NO: 42621 - DNA, 20 bp, Artificial Sequence
  Description of Artificial Sequence: Synthetic oligonucleotide
  Target: ATXN1; (-) strand; PAM type: NRG; PAM sequence: GGG
cctggtggccggggccacgg

SEQ ID NO: 42622 - DNA, 20 bp, Artificial Sequence
  Description of Artificial Sequence: Synthetic oligonucleotide
  Target: ATXN1; (-) strand; PAM type: NRG; PAM sequence: GGG
ccctggtggccggggccacg

SEQ ID NO: 42623 - DNA, 20 bp, Artificial Sequence
  Description of Artificial Sequence: Synthetic oligonucleotide
  Target: ATXN1; (-) strand; PAM type: NRG; PAM sequence: GGG
accctggtggccggggccac

SEQ ID NO: 42624 - DNA, 20 bp, Artificial Sequence
  Description of Artificial Sequence: Synthetic oligonucleotide
  Target: ATXN1; (-) strand; PAM type: NRG; PAM sequence: CGG
aaccctggtggccggggcca

SEQ ID NO: 42625 - DNA, 20 bp, Artificial Sequence
  Description of Artificial Sequence: Synthetic oligonucleotide
  Target: ATXN1; (-) strand; PAM type: NRG; PAM sequence: GGG
ccgggcaaccctggtggccg

SEQ ID NO: 42626 - DNA, 20 bp, Artificial Sequence
  Description of Artificial Sequence: Synthetic oligonucleotide
  Target: ATXN1; (-) strand; PAM type: NRG; PAM sequence: GGG
cccgggcaaccctggtggcc

SEQ ID NO: 42627 - DNA, 20 bp, Artificial Sequence
  Description of Artificial Sequence: Synthetic oligonucleotide
  Target: ATXN1; (-) strand; PAM type: NRG; PAM sequence: CGG
tcccgggcaaccctggtggc

SEQ ID NO: 42628 - DNA, 20 bp, Artificial Sequence
  Description of Artificial Sequence: Synthetic oligonucleotide
  Target: ATXN1; (-) strand; PAM type: NRG; PAM sequence: TGG
tggctcccgggcaaccctgg

SEQ ID NO: 42629 - DNA, 20 bp, Artificial Sequence
  Description of Artificial Sequence: Synthetic oligonucleotide
  Target: ATXN1; (-) strand; PAM type: NRG; PAM sequence: TGG
gcatggctcccgggcaaccc

SEQ ID NO: 42630 - DNA, 20 bp, Artificial Sequence
  Description of Artificial Sequence: Synthetic oligonucleotide
  Target: ATXN1; (-) strand; PAM type: NRG; PAM sequence: GGG
gagggcacagcatggctccc

SEQ ID NO: 42631 - DNA, 20 bp, Artificial Sequence
  Description of Artificial Sequence: Synthetic oligonucleotide
  Target: ATXN1; (-) strand; PAM type: NRG; PAM sequence: CGG
ggagggcacagcatggctcc

SEQ ID NO: 42632 - DNA, 20 bp, Artificial Sequence
  Description of Artificial Sequence: Synthetic oligonucleotide
  Target: ATXN1; (-) strand; PAM type: NRG; PAM sequence: TGG
accgggtggagggcacagca

SEQ ID NO: 42633 - DNA, 20 bp, Artificial Sequence
  Description of Artificial Sequence: Synthetic oligonucleotide
  Target: ATXN1; (-) strand; PAM type: NRG; PAM sequence: CAG
caaccaccgggtggagggca

SEQ ID NO: 42634 - DNA, 20 bp, Artificial Sequence
  Description of Artificial Sequence: Synthetic oligonucleotide
  Target: ATXN1; (-) strand; PAM type: NRG; PAM sequence: GGG
agcgacaaccaccgggtgga

SEQ ID NO: 42635 - DNA, 20 bp, Artificial Sequence
  Description of Artificial Sequence: Synthetic oligonucleotide
  Target: ATXN1; (-) strand; PAM type: NRG; PAM sequence: AGG
cagcgacaaccaccgggtgg

SEQ ID NO: 42636 - DNA, 20 bp, Artificial Sequence
  Description of Artificial Sequence: Synthetic oligonucleotide
  Target: ATXN1; (-) strand; PAM type: NRG; PAM sequence: GAG
ccagcgacaaccaccgggtg

SEQ ID NO: 42637 - DNA, 20 bp, Artificial Sequence
  Description of Artificial Sequence: Synthetic oligonucleotide
  Target: ATXN1; (-) strand; PAM type: NRG; PAM sequence: TGG
gcccagcgacaaccaccggg

SEQ ID NO: 42638 - DNA, 20 bp, Artificial Sequence
  Description of Artificial Sequence: Synthetic oligonucleotide
  Target: ATXN1; (-) strand; PAM type: NRG; PAM sequence: GGG
cctgcccagcgacaaccacc

SEQ ID NO: 42639 - DNA, 20 bp, Artificial Sequence
  Description of Artificial Sequence: Synthetic oligonucleotide
  Target: ATXN1; (-) strand; PAM type: NRG; PAM sequence: CGG
ccctgcccagcgacaaccac

SEQ ID NO: 42640 - DNA, 20 bp, Artificial Sequence
  Description of Artificial Sequence: Synthetic oligonucleotide
  Target: ATXN1; (-) strand; PAM type: NRG; PAM sequence: CAG
gagaaggcccctaccctgcc

SEQ ID NO: 42641 - DNA, 20 bp, Artificial Sequence
  Description of Artificial Sequence: Synthetic oligonucleotide
  Target: ATXN1; (-) strand; PAM type: NRG; PAM sequence: AGG
cagccggtcctccgaggaga

SEQ ID NO: 42642 - DNA, 20 bp, Artificial Sequence
  Description of Artificial Sequence: Synthetic oligonucleotide
  Target: ATXN1; (-) strand; PAM type: NRG; PAM sequence: AAG
ccagccggtcctccgaggag

SEQ ID NO: 42643 - DNA, 20 bp, Artificial Sequence
  Description of Artificial Sequence: Synthetic oligonucleotide
  Target: ATXN1; (-) strand; PAM type: NRG; PAM sequence: GAG
ccaccagccggtcctccgag

SEQ ID NO: 42644 - DNA, 20 bp, Artificial Sequence
  Description of Artificial Sequence: Synthetic oligonucleotide
  Target: ATXN1; (-) strand; PAM type: NRG; PAM sequence: AGG
cgccaccagccggtcctccg

SEQ ID NO: 42645 - DNA, 20 bp, Artificial Sequence
  Description of Artificial Sequence: Synthetic oligonucleotide
  Target: ATXN1; (-) strand; PAM type: NRG; PAM sequence: GAG
ccgccaccagccggtcctcc

SEQ ID NO: 42646 - DNA, 20 bp, Artificial Sequence
  Description of Artificial Sequence: Synthetic oligonucleotide
  Target: ATXN1; (-) strand; PAM type: NRG; PAM sequence: CGG
gcgagatccccgccaccagc

SEQ ID NO: 42647 - DNA, 20 bp, Artificial Sequence
  Description of Artificial Sequence: Synthetic oligonucleotide
  Target: ATXN1; (-) strand; PAM type: NRG; PAM sequence: CAG
aagcgcgagatccccgccac

SEQ ID NO: 42648 - DNA, 20 bp, Artificial Sequence
  Description of Artificial Sequence: Synthetic oligonucleotide
  Target: ATXN1; (-) strand; PAM type: NRG; PAM sequence: GAG
gcctgcctcccaagaagcgc

SEQ ID NO: 42649 - DNA, 20 bp, Artificial Sequence
  Description of Artificial Sequence: Synthetic oligonucleotide
  Target: ATXN1; (-) strand; PAM type: NRG; PAM sequence: AAG
acgaatgcctgcctcccaag

SEQ ID NO: 42650 - DNA, 20 bp, Artificial Sequence
  Description of Artificial Sequence: Synthetic oligonucleotide
  Target: ATXN1; (-) strand; PAM type: NRG; PAM sequence: AAG
gcaacgaatgcctgcctccc

SEQ ID NO: 42651 - DNA, 20 bp, Artificial Sequence
  Description of Artificial Sequence: Synthetic oligonucleotide
  Target: ATXN1; (-) strand; PAM type: NRG; PAM sequence: GAG
atgaaatccaaccaagagcg

SEQ ID NO: 42652 - DNA, 20 bp, Artificial Sequence
  Description of Artificial Sequence: Synthetic oligonucleotide
  Target: ATXN1; (-) strand; PAM type: NRG; PAM sequence: CGG
aaatgaaatccaaccaagag

SEQ ID NO: 42653 - DNA, 20 bp, Artificial Sequence
  Description of Artificial Sequence: Synthetic oligonucleotide
  Target: ATXN1; (-) strand; PAM type: NRG; PAM sequence: GAG
gaaaaatgaaatccaaccaa

SEQ ID NO: 42654 - DNA, 20 bp, Artificial Sequence
  Description of Artificial Sequence: Synthetic oligonucleotide
  Target: ATXN1; (-) strand; PAM type: NRG; PAM sequence: AAG
gcgaaaaatgaaatccaacc

SEQ ID NO: 42655 - DNA, 20 bp, Artificial Sequence
  Description of Artificial Sequence: Synthetic oligonucleotide
  Target: ATXN1; (-) strand; PAM type: NRG; PAM sequence: CGG
cagtcaccgtggagggggga

SEQ ID NO: 42656 - DNA, 20 bp, Artificial Sequence
  Description of Artificial Sequence: Synthetic oligonucleotide
  Target: ATXN1; (-) strand; PAM type: NRG; PAM sequence: GGG
gaaacagtcaccgtggaggg

SEQ ID NO: 42657 - DNA, 20 bp, Artificial Sequence
  Description of Artificial Sequence: Synthetic oligonucleotide
  Target: ATXN1; (-) strand; PAM type: NRG; PAM sequence: GGG
tgaaacagtcaccgtggagg

SEQ ID NO: 42658 - DNA, 20 bp, Artificial Sequence
  Description of Artificial Sequence: Synthetic oligonucleotide
  Target: ATXN1; (-) strand; PAM type: NRG; PAM sequence: GGG
gtgaaacagtcaccgtggag

SEQ ID NO: 42659 - DNA, 20 bp, Artificial Sequence
  Description of Artificial Sequence: Synthetic oligonucleotide
  Target: ATXN1; (-) strand; PAM type: NRG; PAM sequence: GGG
agtgaaacagtcaccgtgga

SEQ ID NO: 42660 - DNA, 20 bp, Artificial Sequence
  Description of Artificial Sequence: Synthetic oligonucleotide
  Target: ATXN1; (-) strand; PAM type: NRG; PAM sequence: AGG
cagtgaaacagtcaccgtgg

SEQ ID NO: 42661 - DNA, 20 bp, Artificial Sequence
  Description of Artificial Sequence: Synthetic oligonucleotide
  Target: ATXN1; (-) strand; PAM type: NRG; PAM sequence: GAG
acagtgaaacagtcaccgtg

SEQ ID NO: 42662 - DNA, 20 bp, Artificial Sequence
  Description of Artificial Sequence: Synthetic oligonucleotide
  Target: ATXN1; (-) strand; PAM type: NRG; PAM sequence: TGG
agacagtgaaacagtcaccg

SEQ ID NO: 42663 - DNA, 20 bp, Artificial Sequence
  Description of Artificial Sequence: Synthetic oligonucleotide
  Target: ATXN1; (-) strand; PAM type: NRG; PAM sequence: CAG
gagccatccagacagtgaaa

SEQ ID NO: 42664 - DNA, 20 bp, Artificial Sequence
  Description of Artificial Sequence: Synthetic oligonucleotide
  Target: ATXN1; (-) strand; PAM type: NRG; PAM sequence: CAG
taaaatcagagccatccaga

SEQ ID NO: 42665 - DNA, 20 bp, Artificial Sequence
  Description of Artificial Sequence: Synthetic oligonucleotide
  Target: ATXN1; (-) strand; PAM type: NRG; PAM sequence: CAG
agactaaaatcagagccatc

SEQ ID NO: 42666 - DNA, 20 bp, Artificial Sequence
  Description of Artificial Sequence: Synthetic oligonucleotide
  Target: ATXN1; (-) strand; PAM type: NRG; PAM sequence: GAG
cgtttatcagactaaaatca

SEQ ID NO: 42667 - DNA, 20 bp, Artificial Sequence
  Description of Artificial Sequence: Synthetic oligonucleotide
  Target: ATXN1; (-) strand; PAM type: NRG; PAM sequence: CAG
tccgtttatcagactaaaat

SEQ ID NO: 42668 - DNA, 20 bp, Artificial Sequence
  Description of Artificial Sequence: Synthetic oligonucleotide
  Target: ATXN1; (-) strand; PAM type: NRG; PAM sequence: CAG
aaatgtgactttccgtttat

SEQ ID NO: 42669 - DNA, 20 bp, Artificial Sequence
  Description of Artificial Sequence: Synthetic oligonucleotide
  Target: ATXN1; (-) strand; PAM type: NRG; PAM sequence: CAG
tgaagagcctggatccccta

SEQ ID NO: 42670 - DNA, 20 bp, Artificial Sequence
  Description of Artificial Sequence: Synthetic oligonucleotide
  Target: ATXN1; (-) strand; PAM type: NRG; PAM sequence: TGG
atgattcctcatgaagagcc

SEQ ID NO: 42671 - DNA, 20 bp, Artificial Sequence
  Description of Artificial Sequence: Synthetic oligonucleotide
  Target: ATXN1; (-) strand; PAM type: NRG; PAM sequence: GAG
gggagatgattcctcatgaa

SEQ ID NO: 42672 - DNA, 20 bp, Artificial Sequence
  Description of Artificial Sequence: Synthetic oligonucleotide
  Target: ATXN1; (-) strand; PAM type: NRG; PAM sequence: AAG
cggggagatgattcctcatg

SEQ ID NO: 42673 - DNA, 20 bp, Artificial Sequence
  Description of Artificial Sequence: Synthetic oligonucleotide
  Target: ATXN1; (-) strand; PAM type: NRG; PAM sequence: GAG
tggcggattgtacccacggg

SEQ ID NO: 42674 - DNA, 20 bp, Artificial Sequence
  Description of Artificial Sequence: Synthetic oligonucleotide
  Target: ATXN1; (-) strand; PAM type: NRG; PAM sequence: GGG
gttggcggattgtacccacg

SEQ ID NO: 42675 - DNA, 20 bp, Artificial Sequence
  Description of Artificial Sequence: Synthetic oligonucleotide
  Target: ATXN1; (-) strand; PAM type: NRG; PAM sequence: GGG
tgttggcggattgtacccac

SEQ ID NO: 42676 - DNA, 20 bp, Artificial Sequence
  Description of Artificial Sequence: Synthetic oligonucleotide
  Target: ATXN1; (-) strand; PAM type: NRG; PAM sequence: CGG
ctgttggcggattgtaccca

SEQ ID NO: 42677 - DNA, 20 bp, Artificial Sequence
  Description of Artificial Sequence: Synthetic oligonucleotide
  Target: ATXN1; (-) strand; PAM type: NRG; PAM sequence: CGG
gcatccagagctgctgttgg

SEQ ID NO: 42678 - DNA, 20 bp, Artificial Sequence
  Description of Artificial Sequence: Synthetic oligonucleotide
  Target: ATXN1; (-) strand; PAM type: NRG; PAM sequence: TGG
ccagcatccagagctgctgt

SEQ ID NO: 42679 - DNA, 20 bp, Artificial Sequence
  Description of Artificial Sequence: Synthetic oligonucleotide
  Target: ATXN1; (-) strand; PAM type: NRG; PAM sequence: GAG
cttccctttcccagcatcca

SEQ ID NO: 42680 - DNA, 20 bp, Artificial Sequence
  Description of Artificial Sequence: Synthetic oligonucleotide
  Target: ATXN1; (-) strand; PAM type: NRG; PAM sequence: CAG
ctcttccctttcccagcatc

SEQ ID NO: 42681 - DNA, 20 bp, Artificial Sequence
  Description of Artificial Sequence: Synthetic oligonucleotide
  Target: ATXN1; (-) strand; PAM type: NRG; PAM sequence: CAG
cactgccctcttccctttcc

SEQ ID NO: 42682 - DNA, 20 bp, Artificial Sequence
  Description of Artificial Sequence: Synthetic oligonucleotide
  Target: ATXN1; (-) strand; PAM type: NRG; PAM sequence: CGG
tgccaaagatgttctttccc

SEQ ID NO: 42683 - DNA, 20 bp, Artificial Sequence
  Description of Artificial Sequence: Synthetic oligonucleotide
  Target: ATXN1; (-) strand; PAM type: NRG; PAM sequence: AAG
gcctagtcttaatcttgcca

SEQ ID NO: 42684 - DNA, 20 bp, Artificial Sequence
  Description of Artificial Sequence: Synthetic oligonucleotide
  Target: ATXN1; (-) strand; PAM type: NRG; PAM sequence: TAG
ttcacaccgagtccagggcc

SEQ ID NO: 42685 - DNA, 20 bp, Artificial Sequence
  Description of Artificial Sequence: Synthetic oligonucleotide
  Target: ATXN1; (-) strand; PAM type: NRG; PAM sequence: GGG
gggagttcacaccgagtcca

SEQ ID NO: 42686 - DNA, 20 bp, Artificial Sequence
  Description of Artificial Sequence: Synthetic oligonucleotide
  Target: ATXN1; (-) strand; PAM type: NRG; PAM sequence: AGG
tgggagttcacaccgagtcc

SEQ ID NO: 42687 - DNA, 20 bp, Artificial Sequence
  Description of Artificial Sequence: Synthetic oligonucleotide
  Target: ATXN1; (-) strand; PAM type: NRG; PAM sequence: CAG
atgggagttcacaccgagtc

SEQ ID NO: 42688 - DNA, 20 bp, Artificial Sequence
  Description of Artificial Sequence: Synthetic oligonucleotide
  Target: ATXN1; (-) strand; PAM type: NRG; PAM sequence: GAG
gggttatgggagttcacacc

SEQ ID NO: 42689 - DNA, 20 bp, Artificial Sequence
  Description of Artificial Sequence: Synthetic oligonucleotide
  Target: ATXN1; (-) strand; PAM type: NRG; PAM sequence: GAG
ggggtatgattgggttatgg

SEQ ID NO: 42690 - DNA, 20 bp, Artificial Sequence
  Description of Artificial Sequence: Synthetic oligonucleotide
  Target: ATXN1; (-) strand; PAM type: NRG; PAM sequence: GGG
ttggggtatgattgggttat

SEQ ID NO: 42691 - DNA, 20 bp, Artificial Sequence
  Description of Artificial Sequence: Synthetic oligonucleotide
  Target: ATXN1; (-) strand; PAM type: NRG; PAM sequence: TGG
cttggggtatgattgggtta

SEQ ID NO: 42692 - DNA, 20 bp, Artificial Sequence
  Description of Artificial Sequence: Synthetic oligonucleotide
  Target: ATXN1; (-) strand; PAM type: NRG; PAM sequence: GGG
tcagtgcttggggtatgatt

SEQ ID NO: 42693 - DNA, 20 bp, Artificial Sequence
  Description of Artificial Sequence: Synthetic oligonucleotide
  Target: ATXN1; (-) strand; PAM type: NRG; PAM sequence: TGG
ttcagtgcttggggtatgat

SEQ ID NO: 42694 - DNA, 20 bp, Artificial Sequence
  Description of Artificial Sequence: Synthetic oligonucleotide
  Target: ATXN1; (-) strand; PAM type: NRG; PAM sequence: GGG
tttctctgcttcagtgcttg

SEQ ID NO: 42695 - DNA, 20 bp, Artificial Sequence
  Description of Artificial Sequence: Synthetic oligonucleotide
  Target: ATXN1; (-) strand; PAM type: NRG; PAM sequence: GGG
ttttctctgcttcagtgctt

SEQ ID NO: 42696 - DNA, 20 bp, Artificial Sequence
  Description of Artificial Sequence: Synthetic oligonucleotide
  Target: ATXN1; (-) strand; PAM type: NRG; PAM sequence: TGG
gttttctctgcttcagtgct

SEQ ID NO: 42697 - DNA, 20 bp, Artificial Sequence
  Description of Artificial Sequence: Synthetic oligonucleotide
  Target: ATXN1; (-) strand; PAM type: NRG; PAM sequence: CAG
ggctagtgttttctctgctt

SEQ ID NO: 42698 - DNA, 20 bp, Artificial Sequence
  Description of Artificial Sequence: Synthetic oligonucleotide
  Target: ATXN1; (-) strand; PAM type: NRG; PAM sequence: TAG
cggcctcccaaagtgttggc

SEQ ID NO: 42699 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgt

SEQ ID NO: 42700 - DNA, 20 bp, Artificial Sequence
  Description of Artificial Sequence: Synthetic oligonucleotide
  Target: ATXN1; (-) strand; PAM type: NRG; PAM sequence: AAG
ctgcctgcctcggcctccca

SEQ ID NO: 42701 - DNA, 20 bp, Artificial Sequence
  Description of Artificial Sequence: Synthetic oligonucleotide
  Target: ATXN1; (-) strand; PAM type: NRG; PAM sequence: CGG
acctcgtgatctgcctgcct

SEQ ID NO: 42702 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttagccagga

SEQ ID NO: 42703 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttagcc

SEQ ID NO: 42704 - DNA, 20 bp, Artificial Sequence
  Description of Artificial Sequence: Synthetic oligonucleotide
  Target: ATXN1; (-) strand; PAM type: NRG; PAM sequence: CAG
cggggtttcaccatgttagc

SEQ ID NO: 42705 - DNA, 20 bp, Artificial Sequence
  Description of Artificial Sequence: Synthetic oligonucleotide
  Target: ATXN1; (-) strand; PAM type: NRG; PAM sequence: TAG
gagacggggtttcaccatgt

SEQ ID NO: 42706 - DNA, 20 bp, Artificial Sequence
  Description of Artificial Sequence: Synthetic oligonucleotide
  Target: ATXN1; (-) strand; PAM type: NRG; PAM sequence: GGG
ttttatttttggtagagacg

SEQ ID NO: 42707 - DNA, 20 bp, Artificial Sequence
  Description of Artificial Sequence: Synthetic oligonucleotide
  Target: ATXN1; (-) strand; PAM type: NRG; PAM sequence: GGG
tttttatttttggtagagac

SEQ ID NO: 42708 - DNA, 20 bp, Artificial Sequence
  Description of Artificial Sequence: Synthetic oligonucleotide
  Target: ATXN1; (-) strand; PAM type: NRG; PAM sequence: CGG
ttttttatttttggtagaga

SEQ ID NO: 42709 - DNA, 20 bp, Artificial Sequence
  Description of Artificial Sequence: Synthetic oligonucleotide
  Target: ATXN1; (-) strand; PAM type: NRG; PAM sequence: GAG
tttattttttatttttggta

SEQ ID NO: 42710 - DNA, 20 bp, Artificial Sequence
  Description of Artificial Sequence: Synthetic oligonucleotide
  Target: ATXN1; (-) strand; PAM type: NRG; PAM sequence: TAG
tttttattttttatttttgg

SEQ ID NO: 42711 - DNA, 20 bp, Artificial Sequence
  Description of Artificial Sequence: Synthetic oligonucleotide
  Target: ATXN1; (-) strand; PAM type: NRG; PAM sequence: TGG
tgttttttattttttatttt

SEQ ID NO: 42712 - DNA, 20 bp, Artificial Sequence
  Description of Artificial Sequence: Synthetic oligonucleotide
  Target: ATXN1; (-) strand; PAM type: NRG; PAM sequence: AGG
gtgccagctaatgttacacc

SEQ ID NO: 42713 - DNA, 20 bp, Artificial Sequence
  Description of Artificial Sequence: Synthetic oligonucleotide
  Target: ATXN1; (-) strand; PAM type: NRG; PAM sequence: CAG
tgtgccagctaatgttacac

SEQ ID NO: 42714 - DNA, 20 bp, Artificial Sequence
  Description of Artificial Sequence: Synthetic oligonucleotide
  Target: ATXN1; (-) strand; PAM type: NRG; PAM sequence: CAG
ctgggactacagccgtgtgc

SEQ ID NO: 42715 - DNA, 20 bp, Artificial Sequence
  Description of Artificial Sequence: Synthetic oligonucleotide
  Target: ATXN1; (-) strand; PAM type: NRG; PAM sequence: CAG
ctctcaagtagctgggacta

SEQ ID NO: 42716 - DNA, 20 bp, Artificial Sequence
  Description of Artificial Sequence: Synthetic oligonucleotide
  Target: ATXN1; (-) strand; PAM type: NRG; PAM sequence: GGG
cctcagcctctcaagtagct

SEQ ID NO: 42717 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctctcaagtagc

SEQ ID NO: 42718 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctctcaag

SEQ ID NO: 42719 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctctc

SEQ ID NO: 42720 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctgcct

SEQ ID NO: 42721 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcctgggttc

SEQ ID NO: 42722 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctgcctcct

SEQ ID NO: 42723 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctctgcctcc

SEQ ID NO: 42724 - DNA, 20 bp, Artificial Sequence
  Description of Artificial Sequence: Synthetic oligonucleotide
  Target: ATXN1; (-) strand; PAM type: NRG; PAM sequence: CGG
ggagtacaatggtgcaatct

SEQ ID NO: 42725 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtacaa

SEQ ID NO: 42726 - DNA, 20 bp, Artificial Sequence
  Description of Artificial Sequence: Synthetic oligonucleotide
  Target: ATXN1; (-) strand; PAM type: NRG; PAM sequence: GAG
tcgctctgttgcccaggctg

SEQ ID NO: 42727 - DNA, 20 bp, Artificial Sequence
  Description of Artificial Sequence: Synthetic oligonucleotide
  Target: ATXN1; (-) strand; PAM type: NRG; PAM sequence: TGG
tgtcgctctgttgcccaggc

SEQ ID NO: 42728 - DNA, 20 bp, Artificial Sequence
  Description of Artificial Sequence: Synthetic oligonucleotide
  Target: ATXN1; (-) strand; PAM type: NRG; PAM sequence: AGG
agagtgtcgctctgttgccc

SEQ ID NO: 42729 - DNA, 20 bp, Artificial Sequence
  Description of Artificial Sequence: Synthetic oligonucleotide
  Target: ATXN1; (-) strand; PAM type: NRG; PAM sequence: CAG
cagagtgtcgctctgttgcc

SEQ ID NO: 42730 - DNA, 20 bp, Artificial Sequence
  Description of Artificial Sequence: Synthetic oligonucleotide
  Target: ATXN1; (-) strand; PAM type: NRG; PAM sequence: GAG
ttgtttcgtttttggagaca

SEQ ID NO: 42731 - DNA, 20 bp, Artificial Sequence
  Description of Artificial Sequence: Synthetic oligonucleotide
  Target: ATXN1; (-) strand; PAM type: NRG; PAM sequence: CAG
ttttgtttcgtttttggaga

SEQ ID NO: 42732 - DNA, 20 bp, Artificial Sequence
  Description of Artificial Sequence: Synthetic oligonucleotide
  Target: ATXN1; (-) strand; PAM type: NRG; PAM sequence: GAG
gttgttttgtttcgtttttg

SEQ ID NO: 42733 - DNA, 20 bp, Artificial Sequence
  Description of Artificial Sequence: Synthetic oligonucleotide
  Target: ATXN1; (-) strand; PAM type: NRG; PAM sequence: TGG
ttgttgttttgtttcgtttt

SEQ ID NO: 42734 - DNA, 20 bp, Artificial Sequence
  Description of Artificial Sequence: Synthetic oligonucleotide
  Target: ATXN1; (-) strand; PAM type: NRG; PAM sequence: TAG
taatgtgcagctgccacggc

SEQ ID NO: 42735 - DNA, 20 bp, Artificial Sequence
  Description of Artificial Sequence: Synthetic oligonucleotide
  Target: ATXN1; (-) strand; PAM type: NRG; PAM sequence: CGG
tttataatgtgcagctgcca

SEQ ID NO: 42736 - DNA, 20 bp, Artificial Sequence
  Description of Artificial Sequence: Synthetic oligonucleotide
  Target: ATXN1; (-) strand; PAM type: NRG; PAM sequence: CAG
taatcttcctttataatgtg

SEQ ID NO: 42737 - DNA, 20 bp, Artificial Sequence
  Description of Artificial Sequence: Synthetic oligonucleotide
  Target: ATXN1; (-) strand; PAM type: NRG; PAM sequence: CAG
tgttacagtgttcacttgcc

SEQ ID NO: 42738 - DNA, 20 bp, Artificial Sequence
  Description of Artificial Sequence: Synthetic oligonucleotide
  Target: ATXN1; (-) strand; PAM type: NRG; PAM sequence: CAG
attaaaaaatatatgtgtta

SEQ ID NO: 42739 - DNA, 20 bp, Artificial Sequence
  Description of Artificial Sequence: Synthetic oligonucleotide
  Target: ATXN1; (-) strand; PAM type: NRG; PAM sequence: GAG
gtattgagaacatcttaggg

SEQ ID NO: 42740 - DNA, 20 bp, Artificial Sequence
  Description of Artificial Sequence: Synthetic oligonucleotide
  Target: ATXN1; (-) strand; PAM type: NRG; PAM sequence: GGG
gggtattgagaacatcttag

SEQ ID NO: 42741 - DNA, 20 bp, Artificial Sequence
  Description of Artificial Sequence: Synthetic oligonucleotide
  Target: ATXN1; (-) strand; PAM type: NRG; PAM sequence: GGG
agggtattgagaacatctta

SEQ ID NO: 42742 - DNA, 20 bp, Artificial Sequence
  Description of Artificial Sequence: Synthetic oligonucleotide
  Target: ATXN1; (-) strand; PAM type: NRG; PAM sequence: AGG
gagggtattgagaacatctt

SEQ ID NO: 42743 - DNA, 20 bp, Artificial Sequence
  Description of Artificial Sequence: Synthetic oligonucleotide
  Target: ATXN1; (-) strand; PAM type: NRG; PAM sequence: TAG
agagggtattgagaacatct

SEQ ID NO: 42744 - DNA, 20 bp, Artificial Sequence
  Description of Artificial Sequence: Synthetic oligonucleotide
  Target: ATXN1; (-) strand; PAM type: NRG; PAM sequence: GAG
aaaacaggagagagggtatt

SEQ ID NO: 42745 - DNA, 20 bp, Artificial Sequence
  Description of Artificial Sequence: Synthetic oligonucleotide
  Target: ATXN1; (-) strand; PAM type: NRG; PAM sequence: GGG
agaaaaaaaaacaggagaga

SEQ ID NO: 42746 - DNA, 20 bp, Artificial Sequence
  Description of Artificial Sequence: Synthetic oligonucleotide
  Target: ATXN1; (-) strand; PAM type: NRG; PAM sequence: AGG
gagaaaaaaaaacaggagag

SEQ ID NO: 42747 - DNA, 20 bp, Artificial Sequence
  Description of Artificial Sequence: Synthetic oligonucleotide
  Target: ATXN1; (-) strand; PAM type: NRG; PAM sequence: GAG
ggagaaaaaaaaacaggaga

SEQ ID NO: 42748 - DNA, 20 bp, Artificial Sequence
  Description of Artificial Sequence: Synthetic oligonucleotide
  Target: ATXN1; (-) strand; PAM type: NRG; PAM sequence: GAG
aaggagaaaaaaaaacagga

SEQ ID NO: 42749 - DNA, 20 bp, Artificial Sequence
  Description of Artificial Sequence: Synthetic oligonucleotide
  Target: ATXN1; (-) strand; PAM type: NRG; PAM sequence: GAG
aaaaggagaaaaaaaaacag

SEQ ID NO: 42750 - DNA, 20 bp, Artificial Sequence
  Description of Artificial Sequence: Synthetic oligonucleotide
  Target: ATXN1; (-) strand; PAM type: NRG; PAM sequence: AGG
agaaaaggagaaaaaaaaac

SEQ ID NO: 42751 - DNA, 20 bp, Artificial Sequence
  Description of Artificial Sequence: Synthetic oligonucleotide
  Target: ATXN1; (-) strand; PAM type: NRG; PAM sequence: CAG
aagaaaaggagaaaaaaaaa

SEQ ID NO: 42752 - DNA, 20 bp, Artificial Sequence
  Description of Artificial Sequence: Synthetic oligonucleotide
  Target: ATXN1; (-) strand; PAM type: NRG; PAM sequence: GAG
ctgcccttgaagaagaaaag

SEQ ID NO: 42753 - DNA, 20 bp, Artificial Sequence
  Description of Artificial Sequence: Synthetic oligonucleotide
  Target: ATXN1; (-) strand; PAM type: NRG; PAM sequence: AGG
atctgcccttgaagaagaaa

SEQ ID NO: 42754 - DNA, 20 bp, Artificial Sequence
  Description of Artificial Sequence: Synthetic oligonucleotide
  Target: ATXN1; (-) strand; PAM type: NRG; PAM sequence: AAG
catctgcccttgaagaagaa

SEQ ID NO: 42755 - DNA, 20 bp, Artificial Sequence
  Description of Artificial Sequence: Synthetic oligonucleotide
  Target: ATXN1; (-) strand; PAM type: NRG; PAM sequence: AAG
tgcatcatctgcccttgaag

SEQ ID NO: 42756 - DNA, 20 bp, Artificial Sequence
  Description of Artificial Sequence: Synthetic oligonucleotide
  Target: ATXN1; (-) strand; PAM type: NRG; PAM sequence: AAG
aactgcatcatctgcccttg

SEQ ID NO: 42757 - DNA, 20 bp, Artificial Sequence
  Description of Artificial Sequence: Synthetic oligonucleotide
  Target: ATXN1; (-) strand; PAM type: NRG; PAM sequence: AAG
catttctgaaaaggaaattt

SEQ ID NO: 42758 - DNA, 20 bp, Artificial Sequence
  Description of Artificial Sequence: Synthetic oligonucleotide
  Target: ATXN1; (-) strand; PAM type: NRG; PAM sequence: AGG
tggaaccaacatttctgaaa

SEQ ID NO: 42759 - DNA, 20 bp, Artificial Sequence
  Description of Artificial Sequence: Synthetic oligonucleotide
  Target: ATXN1; (-) strand; PAM type: NRG; PAM sequence: AAG
atggaaccaacatttctgaa

SEQ ID NO: 42760 - DNA, 20 bp, Artificial Sequence
  Description of Artificial Sequence: Synthetic oligonucleotide
  Target: ATXN1; (-) strand; PAM type: NRG; PAM sequence: TGG
ggcaaaggagaggtgagaaa

SEQ ID NO: 42761 - DNA, 20 bp, Artificial Sequence
  Description of Artificial Sequence: Synthetic oligonucleotide
  Target: ATXN1; (-) strand; PAM type: NRG; PAM sequence: GAG
cagccaggcaaaggagaggt

SEQ ID NO: 42762 - DNA, 20 bp, Artificial Sequence
  Description of Artificial Sequence: Synthetic oligonucleotide
  Target: ATXN1; (-) strand; PAM type: NRG; PAM sequence: AGG
gttccagccaggcaaaggag

SEQ ID NO: 42763 - DNA, 20 bp, Artificial Sequence
  Description of Artificial Sequence: Synthetic oligonucleotide
  Target: ATXN1; (-) strand; PAM type: NRG; PAM sequence: GAG
tgttccagccaggcaaagga

SEQ ID NO: 42764 - DNA, 20 bp, Artificial Sequence
  Description of Artificial Sequence: Synthetic oligonucleotide
  Target: ATXN1; (-) strand; PAM type: NRG; PAM sequence: GAG
tatgttccagccaggcaaag

SEQ ID NO: 42765 - DNA, 20 bp, Artificial Sequence
  Description of Artificial Sequence: Synthetic oligonucleotide
  Target: ATXN1; (-) strand; PAM type: NRG; PAM sequence: AGG
tttatgttccagccaggcaa

SEQ ID NO: 42766 - DNA, 20 bp, Artificial Sequence
  Description of Artificial Sequence: Synthetic oligonucleotide
  Target: ATXN1; (-) strand; PAM type: NRG; PAM sequence: AAG
ttttatgttccagccaggca

SEQ ID NO: 42767 - DNA, 20 bp, Artificial Sequence
  Description of Artificial Sequence: Synthetic oligonucleotide
  Target: ATXN1; (-) strand; PAM type: NRG; PAM sequence: AGG
cttcattttatgttccagcc

SEQ ID NO: 42768 - DNA, 20 bp, Artificial Sequence
  Description of Artificial Sequence: Synthetic oligonucleotide
  Target: ATXN1; (-) strand; PAM type: NRG; PAM sequence: CAG
gcttcattttatgttccagc

SEQ ID NO: 42769 - DNA, 20 bp, Artificial Sequence
  Description of Artificial Sequence: Synthetic oligonucleotide
  Target: ATXN1; (-) strand; PAM type: NRG; PAM sequence: CAG
aagggcttcattttatgttc

SEQ ID NO: 42770 - DNA, 20 bp, Artificial Sequence
  Description of Artificial Sequence: Synthetic oligonucleotide
  Target: ATXN1; (-) strand; PAM type: NRG; PAM sequence: GGG
gctggtgtcatgctctccaa

SEQ ID NO: 42771 - DNA, 20 bp, Artificial Sequence
  Description of Artificial Sequence: Synthetic oligonucleotide
  Target: ATXN1; (-) strand; PAM type: NRG; PAM sequence: AGG
agctggtgtcatgctctcca

SEQ ID NO: 42772 - DNA, 20 bp, Artificial Sequence
  Description of Artificial Sequence: Synthetic oligonucleotide
  Target: ATXN1; (-) strand; PAM type: NRG; PAM sequence: AAG
cagctggtgtcatgctctcc

SEQ ID NO: 42773 - DNA, 20 bp, Artificial Sequence
  Description of Artificial Sequence: Synthetic oligonucleotide
  Target: ATXN1; (-) strand; PAM type: NRG; PAM sequence: TGG
ctctgagggcagggtccagc

SEQ ID NO: 42774 - DNA, 20 bp, Artificial Sequence
  Description of Artificial Sequence: Synthetic oligonucleotide
  Target: ATXN1; (-) strand; PAM type: NRG; PAM sequence: CAG
ctggctctgagggcagggtc

SEQ ID NO: 42775 - DNA, 20 bp, Artificial Sequence
  Description of Artificial Sequence: Synthetic oligonucleotide
  Target: ATXN1; (-) strand; PAM type: NRG; PAM sequence: GGG
agtgcctggctctgagggca

SEQ ID NO: 42776 - DNA, 20 bp, Artificial Sequence
  Description of Artificial Sequence: Synthetic oligonucleotide
  Target: ATXN1; (-) strand; PAM type: NRG; PAM sequence: AGG
cagtgcctggctctgagggc

SEQ ID NO: 42777 - DNA, 20 bp, Artificial Sequence
  Description of Artificial Sequence: Synthetic oligonucleotide
  Target: ATXN1; (-) strand; PAM type: NRG; PAM sequence: CAG
tcagtgcctggctctgaggg

SEQ ID NO: 42778 - DNA, 20 bp, Artificial Sequence
  Description of Artificial Sequence: Synthetic oligonucleotide
  Target: ATXN1; (-) strand; PAM type: NRG; PAM sequence: GGG
ttctcagtgcctggctctga

SEQ ID NO: 42779 - DNA, 20 bp, Artificial Sequence
  Description of Artificial Sequence: Synthetic oligonucleotide
  Target: ATXN1; (-) strand; PAM type: NRG; PAM sequence: AGG
tttctcagtgcctggctctg

SEQ ID NO: 42780 - DNA, 20 bp, Artificial Sequence
  Description of Artificial Sequence: Synthetic oligonucleotide
  Target: ATXN1; (-) strand; PAM type: NRG; PAM sequence: GAG
ttttctcagtgcctggctct

SEQ ID NO: 42781 - DNA, 20 bp, Artificial Sequence
  Description of Artificial Sequence: Synthetic oligonucleotide
  Target: ATXN1; (-) strand; PAM type: NRG; PAM sequence: TGG
acctgctttttctcagtgcc

SEQ ID NO: 42782 - DNA, 20 bp, Artificial Sequence
  Description of Artificial Sequence: Synthetic oligonucleotide
  Target: ATXN1; (-) strand; PAM type: NRG; PAM sequence: CAG
actgctaacctgctttttct

SEQ ID NO: 42783 - DNA, 20 bp, Artificial Sequence
  Description of Artificial Sequence: Synthetic oligonucleotide
  Target: ATXN1; (-) strand; PAM type: NRG; PAM sequence: TGG
atcgagtgcaaggactgttc

SEQ ID NO: 42784 - DNA, 20 bp, Artificial Sequence
  Description of Artificial Sequence: Synthetic oligonucleotide
  Target: ATXN1; (-) strand; PAM type: NRG; PAM sequence: AGG
ggattcagaaatcgagtgca

SEQ ID NO: 42785 - DNA, 20 bp, Artificial Sequence
  Description of Artificial Sequence: Synthetic oligonucleotide
  Target: ATXN1; (-) strand; PAM type: NRG; PAM sequence: AAG
aggattcagaaatcgagtgc

SEQ ID NO: 42786 - DNA, 20 bp, Artificial Sequence
  Description of Artificial Sequence: Synthetic oligonucleotide
  Target: ATXN1; (-) strand; PAM type: NRG; PAM sequence: GAG
cagatgaggattcagaaatc

SEQ ID NO: 42787 - DNA, 20 bp, Artificial Sequence
  Description of Artificial Sequence: Synthetic oligonucleotide
  Target: ATXN1; (-) strand; PAM type: NRG; PAM sequence: CAG
ggctctggcagatgaggatt

SEQ ID NO: 42788 - DNA, 20 bp, Artificial Sequence
  Description of Artificial Sequence: Synthetic oligonucleotide
  Target: ATXN1; (-) strand; PAM type: NRG; PAM sequence: AGG
agtagtggctctggcagatg

SEQ ID NO: 42789 - DNA, 20 bp, Artificial Sequence
  Description of Artificial Sequence: Synthetic oligonucleotide
  Target: ATXN1; (-) strand; PAM type: NRG; PAM sequence: GAG
gagtagtggctctggcagat

SEQ ID NO: 42790 - DNA, 20 bp, Artificial Sequence
  Description of Artificial Sequence: Synthetic oligonucleotide
  Target: ATXN1; (-) strand; PAM type: NRG; PAM sequence: CAG
ttggagagtagtggctctgg

SEQ ID NO: 42791 - DNA, 20 bp, Artificial Sequence
  Description of Artificial Sequence: Synthetic oligonucleotide
  Target: ATXN1; (-) strand; PAM type: NRG; PAM sequence: TGG
atcttggagagtagtggctc

SEQ ID NO: 42792 - DNA, 20 bp, Artificial Sequence
  Description of Artificial Sequence: Synthetic oligonucleotide
  Target: ATXN1; (-) strand; PAM type: NRG; PAM sequence: TGG
aggggaatcttggagagtag

SEQ ID NO: 42793 - DNA, 20 bp, Artificial Sequence
  Description of Artificial Sequence: Synthetic oligonucleotide
  Target: ATXN1; (-) strand; PAM type: NRG; PAM sequence: TAG
ctaaggggaatcttggagag

SEQ ID NO: 42794 - DNA, 20 bp, Artificial Sequence
  Description of Artificial Sequence: Synthetic oligonucleotide
  Target: ATXN1; (-) strand; PAM type: NRG; PAM sequence: GAG
gagctaaggggaatcttgga

SEQ ID NO: 42795 - DNA, 20 bp, Artificial Sequence
  Description of Artificial Sequence: Synthetic oligonucleotide
  Target: ATXN1; (-) strand; PAM type: NRG; PAM sequence: GAG
cagagctaaggggaatcttg

SEQ ID NO: 42796 - DNA, 20 bp, Artificial Sequence
  Description of Artificial Sequence: Synthetic oligonucleotide
  Target: ATXN1; (-) strand; PAM type: NRG; PAM sequence: TGG
cccagagctaaggggaatct

SEQ ID NO: 42797 - DNA, 20 bp, Artificial Sequence
  Description of Artificial Sequence: Synthetic oligonucleotide
  Target: ATXN1; (-) strand; PAM type: NRG; PAM sequence: GGG
agtgtggacccagagctaag

SEQ ID NO: 42798 - DNA, 20 bp, Artificial Sequence
  Description of Artificial Sequence: Synthetic oligonucleotide
  Target: ATXN1; (-) strand; PAM type: NRG; PAM sequence: GGG
cagtgtggacccagagctaa

SEQ ID NO: 42799 - DNA, 20 bp, Artificial Sequence
  Description of Artificial Sequence: Synthetic oligonucleotide
  Target: ATXN1; (-) strand; PAM type: NRG; PAM sequence: AGG
ccagtgtggacccagagcta

SEQ ID NO: 42800 - DNA, 20 bp, Artificial Sequence
  Description of Artificial Sequence: Synthetic oligonucleotide
  Target: ATXN1; (-) strand; PAM type: NRG; PAM sequence: AAG
tccagtgtggacccagagct

SEQ ID NO: 42801 - DNA, 20 bp, Artificial Sequence
  Description of Artificial Sequence: Synthetic oligonucleotide
  Target: ATXN1; (-) strand; PAM type: NRG; PAM sequence: GAG
gtaggtccagtgtggaccca

SEQ ID NO: 42802 - DNA, 20 bp, Artificial Sequence
  Description of Artificial Sequence: Synthetic oligonucleotide
  Target: ATXN1; (-) strand; PAM type: NRG; PAM sequence: CAG
tcgtaggtccagtgtggacc

SEQ ID NO: 42803 - DNA, 20 bp, Artificial Sequence
  Description of Artificial Sequence: Synthetic oligonucleotide
  Target: ATXN1; (-) strand; PAM type: NRG; PAM sequence: TGG
aggaaatcgtaggtccagtg

SEQ ID NO: 42804 - DNA, 20 bp, Artificial Sequence
  Description of Artificial Sequence: Synthetic oligonucleotide
  Target: ATXN1; (-) strand; PAM type: NRG; PAM sequence: CAG
gggagaggaaatcgtaggtc

SEQ ID NO: 42805 - DNA, 20 bp, Artificial Sequence
  Description of Artificial Sequence: Synthetic oligonucleotide
  Target: ATXN1; (-) strand; PAM type: NRG; PAM sequence: AGG
tattagggagaggaaatcgt

SEQ ID NO: 42806 - DNA, 20 bp, Artificial Sequence
  Description of Artificial Sequence: Synthetic oligonucleotide
  Target: ATXN1; (-) strand; PAM type: NRG; PAM sequence: TAG
gtattagggagaggaaatcg

SEQ ID NO: 42807 - DNA, 20 bp, Artificial Sequence
  Description of Artificial Sequence: Synthetic oligonucleotide
  Target: ATXN1; (-) strand; PAM type: NRG; PAM sequence: AGG
tgtgtgtgtgtattagggag

SEQ ID NO: 42808 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtattaggga

SEQ ID NO: 42809 - DNA, 20 bp, Artificial Sequence
  Description of Artificial Sequence: Synthetic oligonucleotide
  Target: ATXN1; (-) strand; PAM type: NRG; PAM sequence: GAG
ttgtgtgtgtgtgtattagg

SEQ ID NO: 42810 - DNA, 20 bp, Artificial Sequence
  Description of Artificial Sequence: Synthetic oligonucleotide
  Target: ATXN1; (-) strand; PAM type: NRG; PAM sequence: GGG
gtttgtgtgtgtgtgtatta

SEQ ID NO: 42811 - DNA, 20 bp, Artificial Sequence
  Description of Artificial Sequence: Synthetic oligonucleotide
  Target: ATXN1; (-) strand; PAM type: NRG; PAM sequence: AGG
tgtttgtgtgtgtgtgtatt

SEQ ID NO: 42812 - DNA, 20 bp, Artificial Sequence
  Description of Artificial Sequence: Synthetic oligonucleotide
  Target: ATXN1; (-) strand; PAM type: NRG; PAM sequence: TAG
gtgtttgtgtgtgtgtgtat

SEQ ID NO: 42813 - DNA, 20 bp, Artificial Sequence
  Description of Artificial Sequence: Synthetic oligonucleotide
  Target: ATXN1; (-) strand; PAM type: NRG; PAM sequence: TGG
tctggcggcctctgctgagt

SEQ ID NO: 42814 - DNA, 20 bp, Artificial Sequence
  Description of Artificial Sequence: Synthetic oligonucleotide
  Target: ATXN1; (-) strand; PAM type: NRG; PAM sequence: GAG
tatttctggcggcctctgct

SEQ ID NO: 42815 - DNA, 20 bp, Artificial Sequence
  Description of Artificial Sequence: Synthetic oligonucleotide
  Target: ATXN1; (-) strand; PAM type: NRG; PAM sequence: CGG
gagaacaggattatttctgg

SEQ ID NO: 42816 - DNA, 20 bp, Artificial Sequence
  Description of Artificial Sequence: Synthetic oligonucleotide
  Target: ATXN1; (-) strand; PAM type: NRG; PAM sequence: TGG
gcagagaacaggattatttc

SEQ ID NO: 42817 - DNA, 20 bp, Artificial Sequence
  Description of Artificial Sequence: Synthetic oligonucleotide
  Target: ATXN1; (-) strand; PAM type: NRG; PAM sequence: AGG
ttttgaaacttgcagagaac

SEQ ID NO: 42818 - DNA, 20 bp, Artificial Sequence
  Description of Artificial Sequence: Synthetic oligonucleotide
  Target: ATXN1; (-) strand; PAM type: NRG; PAM sequence: CAG
cttttgaaacttgcagagaa

SEQ ID NO: 42819 - DNA, 20 bp, Artificial Sequence
  Description of Artificial Sequence: Synthetic oligonucleotide
  Target: ATXN1; (-) strand; PAM type: NRG; PAM sequence: GAG
gaattcttttgaaacttgca

SEQ ID NO: 42820 - DNA, 20 bp, Artificial Sequence
  Description of Artificial Sequence: Synthetic oligonucleotide
  Target: ATXN1; (-) strand; PAM type: NRG; PAM sequence: CAG
gggaattcttttgaaacttg

SEQ ID NO: 42821 - DNA, 20 bp, Artificial Sequence
  Description of Artificial Sequence: Synthetic oligonucleotide
  Target: ATXN1; (-) strand; PAM type: NRG; PAM sequence: GGG
atcatatgagtggctgtact

SEQ ID NO: 42822 - DNA, 20 bp, Artificial Sequence
  Description of Artificial Sequence: Synthetic oligonucleotide
  Target: ATXN1; (-) strand; PAM type: NRG; PAM sequence: TGG
catcatatgagtggctgtac

SEQ ID NO: 42823 - DNA, 20 bp, Artificial Sequence
  Description of Artificial Sequence: Synthetic oligonucleotide
  Target: ATXN1; (-) strand; PAM type: NRG; PAM sequence: TGG
tcactccgtcatcatatgag

SEQ ID NO: 42824 - DNA, 20 bp, Artificial Sequence
  Description of Artificial Sequence: Synthetic oligonucleotide
  Target: ATXN1; (-) strand; PAM type: NRG; PAM sequence: GAG
gtctcactccgtcatcatat

SEQ ID NO: 42825 - DNA, 20 bp, Artificial Sequence
  Description of Artificial Sequence: Synthetic oligonucleotide
  Target: ATXN1; (-) strand; PAM type: NRG; PAM sequence: CAG
taatcaaattcggtttttaa

SEQ ID NO: 42826 - DNA, 20 bp, Artificial Sequence
  Description of Artificial Sequence: Synthetic oligonucleotide
  Target: ATXN1; (-) strand; PAM type: NRG; PAM sequence: CGG
tttttaaccataatcaaatt

SEQ ID NO: 42827 - DNA, 20 bp, Artificial Sequence
  Description of Artificial Sequence: Synthetic oligonucleotide
  Target: ATXN1; (-) strand; PAM type: NRG; PAM sequence: GGG
cctatttttgtatggtattt

SEQ ID NO: 42828 - DNA, 20 bp, Artificial Sequence
  Description of Artificial Sequence: Synthetic oligonucleotide
  Target: ATXN1; (-) strand; PAM type: NRG; PAM sequence: TGG
ccctatttttgtatggtatt

SEQ ID NO: 42829 - DNA, 20 bp, Artificial Sequence
  Description of Artificial Sequence: Synthetic oligonucleotide
  Target: ATXN1; (-) strand; PAM type: NRG; PAM sequence: TGG
gcactagccctatttttgta

SEQ ID NO: 42830 - DNA, 20 bp, Artificial Sequence
  Description of Artificial Sequence: Synthetic oligonucleotide
  Target: ATXN1; (-) strand; PAM type: NRG; PAM sequence: TAG
tgagaaaacattcagtgcac

SEQ ID NO: 42831 - DNA, 20 bp, Artificial Sequence
  Description of Artificial Sequence: Synthetic oligonucleotide
  Target: ATXN1; (-) strand; PAM type: NRG; PAM sequence: CAG
taacccactgagaaaacatt

SEQ ID NO: 42832 - DNA, 20 bp, Artificial Sequence
  Description of Artificial Sequence: Synthetic oligonucleotide
  Target: ATXN1; (-) strand; PAM type: NRG; PAM sequence: GAG
aaccaagcatgtaacccact

SEQ ID NO: 42833 - DNA, 20 bp, Artificial Sequence
  Description of Artificial Sequence: Synthetic oligonucleotide
  Target: ATXN1; (-) strand; PAM type: NRG; PAM sequence: AAG
aagagagagatggacaaacc

SEQ ID NO: 42834 - DNA, 20 bp, Artificial Sequence
  Description of Artificial Sequence: Synthetic oligonucleotide
  Target: ATXN1; (-) strand; PAM type: NRG; PAM sequence: TGG
cttgaaaaggaagagagaga

SEQ ID NO: 42835 - DNA, 20 bp, Artificial Sequence
  Description of Artificial Sequence: Synthetic oligonucleotide
  Target: ATXN1; (-) strand; PAM type: NRG; PAM sequence: GAG
acaacttgaaaaggaagaga

SEQ ID NO: 42836 - DNA, 20 bp, Artificial Sequence
  Description of Artificial Sequence: Synthetic oligonucleotide
  Target: ATXN1; (-) strand; PAM type: NRG; PAM sequence: GAG
tgacaacttgaaaaggaaga

SEQ ID NO: 42837 - DNA, 20 bp, Artificial Sequence
  Description of Artificial Sequence: Synthetic oligonucleotide
  Target: ATXN1; (-) strand; PAM type: NRG; PAM sequence: GAG
aatgacaacttgaaaaggaa

SEQ ID NO: 42838 - DNA, 20 bp, Artificial Sequence
  Description of Artificial Sequence: Synthetic oligonucleotide
  Target: ATXN1; (-) strand; PAM type: NRG; PAM sequence: AAG
tcaatgacaacttgaaaagg

SEQ ID NO: 42839 - DNA, 20 bp, Artificial Sequence
  Description of Artificial Sequence: Synthetic oligonucleotide
  Target: ATXN1; (-) strand; PAM type: NRG; PAM sequence: AGG
acttcaatgacaacttgaaa

SEQ ID NO: 42840 - DNA, 20 bp, Artificial Sequence
  Description of Artificial Sequence: Synthetic oligonucleotide
  Target: ATXN1; (-) strand; PAM type: NRG; PAM sequence: AAG
aacttcaatgacaacttgaa

SEQ ID NO: 42841 - DNA, 20 bp, Artificial Sequence
  Description of Artificial Sequence: Synthetic oligonucleotide
  Target: ATXN1; (-) strand; PAM type: NRG; PAM sequence: GGG
agaaaggggacggtgtgaag

SEQ ID NO: 42842 - DNA, 20 bp, Artificial Sequence
  Description of Artificial Sequence: Synthetic oligonucleotide
  Target: ATXN1; (-) strand; PAM type: NRG; PAM sequence: GGG
gagaaaggggacggtgtgaa

SEQ ID NO: 42843 - DNA, 20 bp, Artificial Sequence
  Description of Artificial Sequence: Synthetic oligonucleotide
  Target: ATXN1; (-) strand; PAM type: NRG; PAM sequence: AGG
tgagaaaggggacggtgtga

SEQ ID NO: 42844 - DNA, 20 bp, Artificial Sequence
  Description of Artificial Sequence: Synthetic oligonucleotide
  Target: ATXN1; (-) strand; PAM type: NRG; PAM sequence: AAG
atgagaaaggggacggtgtg

SEQ ID NO: 42845 - DNA, 20 bp, Artificial Sequence
  Description of Artificial Sequence: Synthetic oligonucleotide
  Target: ATXN1; (-) strand; PAM type: NRG; PAM sequence: CGG
ctttccaatgagaaagggga

SEQ ID NO: 42846 - DNA, 20 bp, Artificial Sequence
  Description of Artificial Sequence: Synthetic oligonucleotide
  Target: ATXN1; (-) strand; PAM type: NRG; PAM sequence: GGG
gttactttccaatgagaaag

SEQ ID NO: 42847 - DNA, 20 bp, Artificial Sequence
  Description of Artificial Sequence: Synthetic oligonucleotide
  Target: ATXN1; (-) strand; PAM type: NRG; PAM sequence: GGG
tgttactttccaatgagaaa

SEQ ID NO: 42848 - DNA, 20 bp, Artificial Sequence
  Description of Artificial Sequence: Synthetic oligonucleotide
  Target: ATXN1; (-) strand; PAM type: NRG; PAM sequence: AGG
ttgttactttccaatgagaa

SEQ ID NO: 42849 - DNA, 20 bp, Artificial Sequence
  Description of Artificial Sequence: Synthetic oligonucleotide
  Target: ATXN1; (-) strand; PAM type: NRG; PAM sequence: AAG
gttgttactttccaatgaga

SEQ ID NO: 42850 - DNA, 20 bp, Artificial Sequence
  Description of Artificial Sequence: Synthetic oligonucleotide
  Target: ATXN1; (-) strand; PAM type: NRG; PAM sequence: GAG
gcgagttgttactttccaat

SEQ ID NO: 42851 - DNA, 20 bp, Artificial Sequence
  Description of Artificial Sequence: Synthetic oligonucleotide
  Target: ATXN1; (-) strand; PAM type: NRG; PAM sequence: GAG
tcgtctctagtgttaatggc

SEQ ID NO: 42852 - DNA, 20 bp, Artificial Sequence
  Description of Artificial Sequence: Synthetic oligonucleotide
  Target: ATXN1; (-) strand; PAM type: NRG; PAM sequence: TGG
gctgtcgtctctagtgttaa

SEQ ID NO: 42853 - DNA, 20 bp, Artificial Sequence
  Description of Artificial Sequence: Synthetic oligonucleotide
  Target: ATXN1; (-) strand; PAM type: NRG; PAM sequence: TAG
tctgaaagagctgtcgtctc

SEQ ID NO: 42854 - DNA, 20 bp, Artificial Sequence
  Description of Artificial Sequence: Synthetic oligonucleotide
  Target: ATXN1; (-) strand; PAM type: NRG; PAM sequence: GAG
ctgatctgatttgtctgaaa

SEQ ID NO: 42855 - DNA, 20 bp, Artificial Sequence
  Description of Artificial Sequence: Synthetic oligonucleotide
  Target: ATXN1; (-) strand; PAM type: NRG; PAM sequence: AAG
cactgatctgatttgtctga

SEQ ID NO: 42856 - DNA, 20 bp, Artificial Sequence
  Description of Artificial Sequence: Synthetic oligonucleotide
  Target: ATXN1; (-) strand; PAM type: NRG; PAM sequence: AGG
gggtcaccatttgtatgtcc

SEQ ID NO: 42857 - DNA, 20 bp, Artificial Sequence
  Description of Artificial Sequence: Synthetic oligonucleotide
  Target: ATXN1; (-) strand; PAM type: NRG; PAM sequence: CAG
agggtcaccatttgtatgtc

SEQ ID NO: 42858 - DNA, 20 bp, Artificial Sequence
  Description of Artificial Sequence: Synthetic oligonucleotide
  Target: ATXN1; (-) strand; PAM type: NRG; PAM sequence: GGG
gaccataagaactggctcca

SEQ ID NO: 42859 - DNA, 20 bp, Artificial Sequence
  Description of Artificial Sequence: Synthetic oligonucleotide
  Target: ATXN1; (-) strand; PAM type: NRG; PAM sequence: AGG
tgaccataagaactggctcc

SEQ ID NO: 42860 - DNA, 20 bp, Artificial Sequence
  Description of Artificial Sequence: Synthetic oligonucleotide
  Target: ATXN1; (-) strand; PAM type: NRG; PAM sequence: CAG
ttgaccataagaactggctc

SEQ ID NO: 42861 - DNA, 20 bp, Artificial Sequence
  Description of Artificial Sequence: Synthetic oligonucleotide
  Target: ATXN1; (-) strand; PAM type: NRG; PAM sequence: TGG
agatacttgaccataagaac

SEQ ID NO: 42862 - DNA, 20 bp, Artificial Sequence
  Description of Artificial Sequence: Synthetic oligonucleotide
  Target: ATXN1; (-) strand; PAM type: NRG; PAM sequence: AAG
agactgagatacttgaccat

SEQ ID NO: 42863 - DNA, 20 bp, Artificial Sequence
  Description of Artificial Sequence: Synthetic oligonucleotide
  Target: ATXN1; (-) strand; PAM type: NRG; PAM sequence: GAG
tcagtggttagtaagagact

SEQ ID NO: 42864 - DNA, 20 bp, Artificial Sequence
  Description of Artificial Sequence: Synthetic oligonucleotide
  Target: ATXN1; (-) strand; PAM type: NRG; PAM sequence: GAG
cagacttcagtggttagtaa

SEQ ID NO: 42865 - DNA, 20 bp, Artificial Sequence
  Description of Artificial Sequence: Synthetic oligonucleotide
  Target: ATXN1; (-) strand; PAM type: NRG; PAM sequence: AAG
ctcagacttcagtggttagt

SEQ ID NO: 42866 - DNA, 20 bp, Artificial Sequence
  Description of Artificial Sequence: Synthetic oligonucleotide
  Target: ATXN1; (-) strand; PAM type: NRG; PAM sequence: TAG
gtaactcagacttcagtggt

SEQ ID NO: 42867 - DNA, 20 bp, Artificial Sequence
  Description of Artificial Sequence: Synthetic oligonucleotide
  Target: ATXN1; (-) strand; PAM type: NRG; PAM sequence: TGG
agcagtaactcagacttcag

SEQ ID NO: 42868 - DNA, 20 bp, Artificial Sequence
  Description of Artificial Sequence: Synthetic oligonucleotide
  Target: ATXN1; (-) strand; PAM type: NRG; PAM sequence: CAG
agcagcagtaactcagactt

SEQ ID NO: 42869 - DNA, 20 bp, Artificial Sequence
  Description of Artificial Sequence: Synthetic oligonucleotide
  Target: ATXN1; (-) strand; PAM type: NRG; PAM sequence: CAG
cccacacagcagcagtaact

SEQ ID NO: 42870 - DNA, 20 bp, Artificial Sequence
  Description of Artificial Sequence: Synthetic oligonucleotide
  Target: ATXN1; (-) strand; PAM type: NRG; PAM sequence: CAG
ttggtttgcccacacagcag

SEQ ID NO: 42871 - DNA, 20 bp, Artificial Sequence
  Description of Artificial Sequence: Synthetic oligonucleotide
  Target: ATXN1; (-) strand; PAM type: NRG; PAM sequence: CAG
gcattggtttgcccacacag

SEQ ID NO: 42872 - DNA, 20 bp, Artificial Sequence
  Description of Artificial Sequence: Synthetic oligonucleotide
  Target: ATXN1; (-) strand; PAM type: NRG; PAM sequence: CAG
tgggcattggtttgcccaca

SEQ ID NO: 42873 - DNA, 20 bp, Artificial Sequence
  Description of Artificial Sequence: Synthetic oligonucleotide
  Target: ATXN1; (-) strand; PAM type: NRG; PAM sequence: TGG
gcctcttgtctgttgggcat

SEQ ID NO: 42874 - DNA, 20 bp, Artificial Sequence
  Description of Artificial Sequence: Synthetic oligonucleotide
  Target: ATXN1; (-) strand; PAM type: NRG; PAM sequence: GGG
tatttggcctcttgtctgtt

SEQ ID NO: 42875 - DNA, 20 bp, Artificial Sequence
  Description of Artificial Sequence: Synthetic oligonucleotide
  Target: ATXN1; (-) strand; PAM type: NRG; PAM sequence: TGG
atatttggcctcttgtctgt

SEQ ID NO: 42876 - DNA, 20 bp, Artificial Sequence
  Description of Artificial Sequence: Synthetic oligonucleotide
  Target: ATXN1; (-) strand; PAM type: NRG; PAM sequence: TGG
atgtcagttccactgatatt

SEQ ID NO: 42877 - DNA, 20 bp, Artificial Sequence
  Description of Artificial Sequence: Synthetic oligonucleotide
  Target: ATXN1; (-) strand; PAM type: NRG; PAM sequence: CAG
cttgctagcctgggtcatgt

SEQ ID NO: 42878 - DNA, 20 bp, Artificial Sequence
  Description of Artificial Sequence: Synthetic oligonucleotide
  Target: ATXN1; (-) strand; PAM type: NRG; PAM sequence: GGG
catccgctgcttgctagcct

SEQ ID NO: 42879 - DNA, 20 bp, Artificial Sequence
  Description of Artificial Sequence: Synthetic oligonucleotide
  Target: ATXN1; (-) strand; PAM type: NRG; PAM sequence: TGG
acatccgctgcttgctagcc

SEQ ID NO: 42880 - DNA, 20 bp, Artificial Sequence
  Description of Artificial Sequence: Synthetic oligonucleotide
  Target: ATXN1; (-) strand; PAM type: NRG; PAM sequence: TAG
caatcacatccgctgcttgc

SEQ ID NO: 42881 - DNA, 20 bp, Artificial Sequence
  Description of Artificial Sequence: Synthetic oligonucleotide
  Target: ATXN1; (-) strand; PAM type: NRG; PAM sequence: AAG
cctacagctgctacctgtgg

SEQ ID NO: 42882 - DNA, 20 bp, Artificial Sequence
  Description of Artificial Sequence: Synthetic oligonucleotide
  Target: ATXN1; (-) strand; PAM type: NRG; PAM sequence: TGG
atacctacagctgctacctg

SEQ ID NO: 42883 - DNA, 20 bp, Artificial Sequence
  Description of Artificial Sequence: Synthetic oligonucleotide
  Target: ATXN1; (-) strand; PAM type: NRG; PAM sequence: CAG
tgttgcactgtgcataccta

SEQ ID NO: 42884 - DNA, 20 bp, Artificial Sequence
  Description of Artificial Sequence: Synthetic oligonucleotide
  Target: ATXN1; (-) strand; PAM type: NRG; PAM sequence: CAG
tcccacagctctcagaatca

SEQ ID NO: 42885 - DNA, 20 bp, Artificial Sequence
  Description of Artificial Sequence: Synthetic oligonucleotide
  Target: ATXN1; (-) strand; PAM type: NRG; PAM sequence: CAG
aagcccaatcccacagctct

SEQ ID NO: 42886 - DNA, 20 bp, Artificial Sequence
  Description of Artificial Sequence: Synthetic oligonucleotide
  Target: ATXN1; (-) strand; PAM type: NRG; PAM sequence: CAG
attcccaaagcccaatccca

SEQ ID NO: 42887 - DNA, 20 bp, Artificial Sequence
  Description of Artificial Sequence: Synthetic oligonucleotide
  Target: ATXN1; (-) strand; PAM type: NRG; PAM sequence: AAG
ccaagggtgtggaattccca

SEQ ID NO: 42888 - DNA, 20 bp, Artificial Sequence
  Description of Artificial Sequence: Synthetic oligonucleotide
  Target: ATXN1; (-) strand; PAM type: NRG; PAM sequence: TGG
gataccaaaacccaagggtg

SEQ ID NO: 42889 - DNA, 20 bp, Artificial Sequence
  Description of Artificial Sequence: Synthetic oligonucleotide
  Target: ATXN1; (-) strand; PAM type: NRG; PAM sequence: GGG
tgtgagataccaaaacccaa

SEQ ID NO: 42890 - DNA, 20 bp, Artificial Sequence
  Description of Artificial Sequence: Synthetic oligonucleotide
  Target: ATXN1; (-) strand; PAM type: NRG; PAM sequence: AGG
atgtgagataccaaaaccca

SEQ ID NO: 42891 - DNA, 20 bp, Artificial Sequence
  Description of Artificial Sequence: Synthetic oligonucleotide
  Target: ATXN1; (-) strand; PAM type: NRG; PAM sequence: AAG
gatgtgagataccaaaaccc

SEQ ID NO: 42892 - DNA, 20 bp, Artificial Sequence
  Description of Artificial Sequence: Synthetic oligonucleotide
  Target: ATXN1; (-) strand; PAM type: NRG; PAM sequence: GAG
tgaaaagagggtctggatgt

SEQ ID NO: 42893 - DNA, 20 bp, Artificial Sequence
  Description of Artificial Sequence: Synthetic oligonucleotide
  Target: ATXN1; (-) strand; PAM type: NRG; PAM sequence: TGG
agatcattgaaaagagggtc

SEQ ID NO: 42894 - DNA, 20 bp, Artificial Sequence
  Description of Artificial Sequence: Synthetic oligonucleotide
  Target: ATXN1; (-) strand; PAM type: NRG; PAM sequence: GGG
aaatcagatcattgaaaaga

SEQ ID NO: 42895 - DNA, 20 bp, Artificial Sequence
  Description of Artificial Sequence: Synthetic oligonucleotide
  Target: ATXN1; (-) strand; PAM type: NRG; PAM sequence: AGG
aaaatcagatcattgaaaag

SEQ ID NO: 42896 - DNA, 20 bp, Artificial Sequence
  Description of Artificial Sequence: Synthetic oligonucleotide
  Target: ATXN1; (-) strand; PAM type: NRG; PAM sequence: GAG
gaaaatcagatcattgaaaa

SEQ ID NO: 42897 - DNA, 20 bp, Artificial Sequence
  Description of Artificial Sequence: Synthetic oligonucleotide
  Target: ATXN1; (-) strand; PAM type: NRG; PAM sequence: AAG
aagaaaatcagatcattgaa

SEQ ID NO: 42898 - DNA, 20 bp, Artificial Sequence
  Description of Artificial Sequence: Synthetic oligonucleotide
  Target: ATXN1; (-) strand; PAM type: NRG; PAM sequence: CAG
aagaaagaaagaaagaaaat

SEQ ID NO: 42899 - DNA, 20 bp, Artificial Sequence
  Description of Artificial Sequence: Synthetic oligonucleotide
  Target: ATXN1; (-) strand; PAM type: NRG; PAM sequence: AAG
aagaaagaaagaaagaaaga

SEQ ID NO: 42900 - DNA, 20 bp, Artificial Sequence
  Description of Artificial Sequence: Synthetic oligonucleotide
  Target: ATXN1; (-) strand; PAM type: NRG; PAM sequence: AAG
tccaaagaaagaaagaaaga

SEQ ID NO: 42901 - DNA, 20 bp, Artificial Sequence
  Description of Artificial Sequence: Synthetic oligonucleotide
  Target: ATXN1; (-) strand; PAM type: NRG; PAM sequence: AAG
tctctccaaagaaagaaaga

SEQ ID NO: 42902 - DNA, 20 bp, Artificial Sequence
  Description of Artificial Sequence: Synthetic oligonucleotide
  Target: ATXN1; (-) strand; PAM type: NRG; PAM sequence: AAG
cccatctctccaaagaaaga

SEQ ID NO: 42903 - DNA, 20 bp, Artificial Sequence
  Description of Artificial Sequence: Synthetic oligonucleotide
  Target: ATXN1; (-) strand; PAM type: NRG; PAM sequence: AAG
agaccccatctctccaaaga

SEQ ID NO: 42904 - DNA, 20 bp, Artificial Sequence
  Description of Artificial Sequence: Synthetic oligonucleotide
  Target: ATXN1; (-) strand; PAM type: NRG; PAM sequence: AAG
agcaagaccccatctctcca

SEQ ID NO: 42905 - DNA, 20 bp, Artificial Sequence
  Description of Artificial Sequence: Synthetic oligonucleotide
  Target: ATXN1; (-) strand; PAM type: NRG; PAM sequence: AAG
accagcctggttaacatagc

SEQ ID NO: 42906 - DNA, 20 bp, Artificial Sequence
  Description of Artificial Sequence: Synthetic oligonucleotide
  Target: ATXN1; (-) strand; PAM type: NRG; PAM sequence: TAG
caagaccagcctggttaaca

SEQ ID NO: 42907 - DNA, 20 bp, Artificial Sequence
  Description of Artificial Sequence: Synthetic oligonucleotide
  Target: ATXN1; (-) strand; PAM type: NRG; PAM sequence: TGG
ccaggatttcaagaccagcc

SEQ ID NO: 42908 - DNA, 20 bp, Artificial Sequence
  Description of Artificial Sequence: Synthetic oligonucleotide
  Target: ATXN1; (-) strand; PAM type: NRG; PAM sequence: CAG
tgaggccaggatttcaagac

SEQ ID NO: 42909 - DNA, 20 bp, Artificial Sequence
  Description of Artificial Sequence: Synthetic oligonucleotide
  Target: ATXN1; (-) strand; PAM type: NRG; PAM sequence: AAG
tttcttgaggccaggatttc

SEQ ID NO: 42910 - DNA, 20 bp, Artificial Sequence
  Description of Artificial Sequence: Synthetic oligonucleotide
  Target: ATXN1; (-) strand; PAM type: NRG; PAM sequence: AGG
aaggaggatttcttgaggcc

SEQ ID NO: 42911 - DNA, 20 bp, Artificial Sequence
  Description of Artificial Sequence: Synthetic oligonucleotide
  Target: ATXN1; (-) strand; PAM type: NRG; PAM sequence: CAG
gaaggaggatttcttgaggc

SEQ ID NO: 42912 - DNA, 20 bp, Artificial Sequence
  Description of Artificial Sequence: Synthetic oligonucleotide
  Target: ATXN1; (-) strand; PAM type: NRG; PAM sequence: AGG
caaggaaggaggatttcttg

SEQ ID NO: 42913 - DNA, 20 bp, Artificial Sequence
  Description of Artificial Sequence: Synthetic oligonucleotide
  Target: ATXN1; (-) strand; PAM type: NRG; PAM sequence: GAG
ccaaggaaggaggatttctt

SEQ ID NO: 42914 - DNA, 20 bp, Artificial Sequence
  Description of Artificial Sequence: Synthetic oligonucleotide
  Target: ATXN1; (-) strand; PAM type: NRG; PAM sequence: AGG
ctttgggaggccaaggaagg

SEQ ID NO: 42915 - DNA, 20 bp, Artificial Sequence
  Description of Artificial Sequence: Synthetic oligonucleotide
  Target: ATXN1; (-) strand; PAM type: NRG; PAM sequence: GAG
actttgggaggccaaggaag

SEQ ID NO: 42916 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggccaagga

SEQ ID NO: 42917 - DNA, 20 bp, Artificial Sequence
  Description of Artificial Sequence: Synthetic oligonucleotide
  Target: ATXN1; (-) strand; PAM type: NRG; PAM sequence: AAG
agcactttgggaggccaagg

SEQ ID NO: 42918 - DNA, 20 bp, Artificial Sequence
  Description of Artificial Sequence: Synthetic oligonucleotide
  Target: ATXN1; (-) strand; PAM type: NRG; PAM sequence: AGG
cctagcactttgggaggcca

SEQ ID NO: 42919 - DNA, 20 bp, Artificial Sequence
  Description of Artificial Sequence: Synthetic oligonucleotide
  Target: ATXN1; (-) strand; PAM type: NRG; PAM sequence: AAG
tcctagcactttgggaggcc

SEQ ID NO: 42920 - DNA, 20 bp, Artificial Sequence
  Description of Artificial Sequence: Synthetic oligonucleotide
  Target: ATXN1; (-) strand; PAM type: NRG; PAM sequence: AGG
tggaatcctagcactttggg

SEQ ID NO: 42921 - DNA, 20 bp, Artificial Sequence
  Description of Artificial Sequence: Synthetic oligonucleotide
  Target: ATXN1; (-) strand; PAM type: NRG; PAM sequence: GAG
ctggaatcctagcactttgg

SEQ ID NO: 42922 - DNA, 20 bp, Artificial Sequence
  Description of Artificial Sequence: Synthetic oligonucleotide
  Target: ATXN1; (-) strand; PAM type: NRG; PAM sequence: GGG
gcctggaatcctagcacttt

SEQ ID NO: 42923 - DNA, 20 bp, Artificial Sequence
  Description of Artificial Sequence: Synthetic oligonucleotide
  Target: ATXN1; (-) strand; PAM type: NRG; PAM sequence: TGG
tgcctggaatcctagcactt

SEQ ID NO: 42924 - DNA, 20 bp, Artificial Sequence
  Description of Artificial Sequence: Synthetic oligonucleotide
  Target: ATXN1; (-) strand; PAM type: NRG; PAM sequence: TAG
gtggctcatgcctggaatcc

SEQ ID NO: 42925 - DNA, 20 bp, Artificial Sequence
  Description of Artificial Sequence: Synthetic oligonucleotide
  Target: ATXN1; (-) strand; PAM type: NRG; PAM sequence: TGG
tacacacagtggctcatgcc

SEQ ID NO: 42926 - DNA, 20 bp, Artificial Sequence
  Description of Artificial Sequence: Synthetic oligonucleotide
  Target: ATXN1; (-) strand; PAM type: NRG; PAM sequence: TGG
ggatcattggctacacacag

SEQ ID NO: 42927 - DNA, 20 bp, Artificial Sequence
  Description of Artificial Sequence: Synthetic oligonucleotide
  Target: ATXN1; (-) strand; PAM type: NRG; PAM sequence: CAG
atcggatcattggctacaca

SEQ ID NO: 42928 - DNA, 20 bp, Artificial Sequence
  Description of Artificial Sequence: Synthetic oligonucleotide
  Target: ATXN1; (-) strand; PAM type: NRG; PAM sequence: TGG
ttgttttaaaatcggatcat

SEQ ID NO: 42929 - DNA, 20 bp, Artificial Sequence
  Description of Artificial Sequence: Synthetic oligonucleotide
  Target: ATXN1; (-) strand; PAM type: NRG; PAM sequence: CGG
tattgtgtttgttttaaaat

SEQ ID NO: 42930 - DNA, 20 bp, Artificial Sequence
  Description of Artificial Sequence: Synthetic oligonucleotide
  Target: ATXN1; (-) strand; PAM type: NRG; PAM sequence: AGG
ggacaaggattgaatgctga

SEQ ID NO: 42931 - DNA, 20 bp, Artificial Sequence
  Description of Artificial Sequence: Synthetic oligonucleotide
  Target: ATXN1; (-) strand; PAM type: NRG; PAM sequence: AAG
tggacaaggattgaatgctg

SEQ ID NO: 42932 - DNA, 20 bp, Artificial Sequence
  Description of Artificial Sequence: Synthetic oligonucleotide
  Target: ATXN1; (-) strand; PAM type: NRG; PAM sequence: AGG
gtgttgctccaacatggaca

SEQ ID NO: 42933 - DNA, 20 bp, Artificial Sequence
  Description of Artificial Sequence: Synthetic oligonucleotide
  Target: ATXN1; (-) strand; PAM type: NRG; PAM sequence: AAG
agtgttgctccaacatggac

SEQ ID NO: 42934 - DNA, 20 bp, Artificial Sequence
  Description of Artificial Sequence: Synthetic oligonucleotide
  Target: ATXN1; (-) strand; PAM type: NRG; PAM sequence: TGG
atttcagtgttgctccaaca

SEQ ID NO: 42935 - DNA, 20 bp, Artificial Sequence
  Description of Artificial Sequence: Synthetic oligonucleotide
  Target: ATXN1; (-) strand; PAM type: NRG; PAM sequence: CAG
ttatgtttcagtagggattt

SEQ ID NO: 42936 - DNA, 20 bp, Artificial Sequence
  Description of Artificial Sequence: Synthetic oligonucleotide
  Target: ATXN1; (-) strand; PAM type: NRG; PAM sequence: GGG
aagggggttatgtttcagta

SEQ ID NO: 42937 - DNA, 20 bp, Artificial Sequence
  Description of Artificial Sequence: Synthetic oligonucleotide
  Target: ATXN1; (-) strand; PAM type: NRG; PAM sequence: AGG
aaagggggttatgtttcagt

SEQ ID NO: 42938 - DNA, 20 bp, Artificial Sequence
  Description of Artificial Sequence: Synthetic oligonucleotide
  Target: ATXN1; (-) strand; PAM type: NRG; PAM sequence: TAG
gaaagggggttatgtttcag

SEQ ID NO: 42939 - DNA, 20 bp, Artificial Sequence
  Description of Artificial Sequence: Synthetic oligonucleotide
  Target: ATXN1; (-) strand; PAM type: NRG; PAM sequence: CAG
agagaaagggggttatgttt

SEQ ID NO: 42940 - DNA, 20 bp, Artificial Sequence
  Description of Artificial Sequence: Synthetic oligonucleotide
  Target: ATXN1; (-) strand; PAM type: NRG; PAM sequence: GGG
gggggcagagtagagaaagg

SEQ ID NO: 42941 - DNA, 20 bp, Artificial Sequence
  Description of Artificial Sequence: Synthetic oligonucleotide
  Target: ATXN1; (-) strand; PAM type: NRG; PAM sequence: GGG
agggggcagagtagagaaag

SEQ ID NO: 42942 - DNA, 20 bp, Artificial Sequence
  Description of Artificial Sequence: Synthetic oligonucleotide
  Target: ATXN1; (-) strand; PAM type: NRG; PAM sequence: GGG
tagggggcagagtagagaaa

SEQ ID NO: 42943 - DNA, 20 bp, Artificial Sequence
  Description of Artificial Sequence: Synthetic oligonucleotide
  Target: ATXN1; (-) strand; PAM type: NRG; PAM sequence: AGG
gtagggggcagagtagagaa

SEQ ID NO: 42944 - DNA, 20 bp, Artificial Sequence
  Description of Artificial Sequence: Synthetic oligonucleotide
  Target: ATXN1; (-) strand; PAM type: NRG; PAM sequence: AAG
agtagggggcagagtagaga

SEQ ID NO: 42945 - DNA, 20 bp, Artificial Sequence
  Description of Artificial Sequence: Synthetic oligonucleotide
  Target: ATXN1; (-) strand; PAM type: NRG; PAM sequence: GAG
acaaagtagggggcagagta

SEQ ID NO: 42946 - DNA, 20 bp, Artificial Sequence
  Description of Artificial Sequence: Synthetic oligonucleotide
  Target: ATXN1; (-) strand; PAM type: NRG; PAM sequence: TAG
ttacaaagtagggggcagag

SEQ ID NO: 42947 - DNA, 20 bp, Artificial Sequence
  Description of Artificial Sequence: Synthetic oligonucleotide
  Target: ATXN1; (-) strand; PAM type: NRG; PAM sequence: GAG
tagttacaaagtagggggca

SEQ ID NO: 42948 - DNA, 20 bp, Artificial Sequence
  Description of Artificial Sequence: Synthetic oligonucleotide
  Target: ATXN1; (-) strand; PAM type: NRG; PAM sequence: CAG
aatagttacaaagtaggggg

SEQ ID NO: 42949 - DNA, 20 bp, Artificial Sequence
  Description of Artificial Sequence: Synthetic oligonucleotide
  Target: ATXN1; (-) strand; PAM type: NRG; PAM sequence: GGG
aaaaatagttacaaagtagg

SEQ ID NO: 42950 - DNA, 20 bp, Artificial Sequence
  Description of Artificial Sequence: Synthetic oligonucleotide
  Target: ATXN1; (-) strand; PAM type: NRG; PAM sequence: GGG
aaaaaatagttacaaagtag

SEQ ID NO: 42951 - DNA, 20 bp, Artificial Sequence
  Description of Artificial Sequence: Synthetic oligonucleotide
  Target: ATXN1; (-) strand; PAM type: NRG; PAM sequence: GGG
taaaaaatagttacaaagta

SEQ ID NO: 42952 - DNA, 20 bp, Artificial Sequence
  Description of Artificial Sequence: Synthetic oligonucleotide
  Target: ATXN1; (-) strand; PAM type: NRG; PAM sequence: AGG
ctaaaaaatagttacaaagt

SEQ ID NO: 42953 - DNA, 20 bp, Artificial Sequence
  Description of Artificial Sequence: Synthetic oligonucleotide
  Target: ATXN1; (-) strand; PAM type: NRG; PAM sequence: TAG
tctaaaaaatagttacaaag

SEQ ID NO: 42954 - DNA, 20 bp, Artificial Sequence
  Description of Artificial Sequence: Synthetic oligonucleotide
  Target: ATXN1; (-) strand; PAM type: NRG; PAM sequence: AAG
ccctctaaaaaatagttaca

SEQ ID NO: 42955 - DNA, 20 bp, Artificial Sequence
  Description of Artificial Sequence: Synthetic oligonucleotide
  Target: ATXN1; (-) strand; PAM type: NRG; PAM sequence: TAG
tcattgccccctctaaaaaa

SEQ ID NO: 42956 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaggaaggaagga

SEQ ID NO: 42957 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaggaaggaagg

SEQ ID NO: 42958 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaaaaaggaagga

SEQ ID NO: 42959 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaggaagg

SEQ ID NO: 42960 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaaaaaaaaagga

SEQ ID NO: 42961 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaaagg

SEQ ID NO: 42962 - DNA, 20 bp, Artificial Sequence
  Description of Artificial Sequence: Synthetic oligonucleotide
  Target: ATXN1; (-) strand; PAM type: NRG; PAM sequence: AGG
tcaaaaaaaaaaaaaaaaaa

SEQ ID NO: 42963 - DNA, 20 bp, Artificial Sequence
  Description of Artificial Sequence: Synthetic oligonucleotide
  Target: ATXN1; (-) strand; PAM type: NRG; PAM sequence: AAG
ttcaaaaaaaaaaaaaaaaa

SEQ ID NO: 42964 - DNA, 20 bp, Artificial Sequence
  Description of Artificial Sequence: Synthetic oligonucleotide
  Target: ATXN1; (-) strand; PAM type: NRG; PAM sequence: AAG
ttcagtctgagcaacgaagc

SEQ ID NO: 42965 - DNA, 20 bp, Artificial Sequence
  Description of Artificial Sequence: Synthetic oligonucleotide
  Target: ATXN1; (-) strand; PAM type: NRG; PAM sequence: AAG
gcacttcagtctgagcaacg

SEQ ID NO: 42966 - DNA, 20 bp, Artificial Sequence
  Description of Artificial Sequence: Synthetic oligonucleotide
  Target: ATXN1; (-) strand; PAM type: NRG; PAM sequence: GAG
acgccactgcacttcagtct

SEQ ID NO: 42967 - DNA, 20 bp, Artificial Sequence
  Description of Artificial Sequence: Synthetic oligonucleotide
  Target: ATXN1; (-) strand; PAM type: NRG; PAM sequence: CAG
gagatcacgccactgcactt

SEQ ID NO: 42968 - DNA, 20 bp, Artificial Sequence
  Description of Artificial Sequence: Synthetic oligonucleotide
  Target: ATXN1; (-) strand; PAM type: NRG; PAM sequence: GAG
ggcacaggttgcagcaagcc

SEQ ID NO: 42969 - DNA, 20 bp, Artificial Sequence
  Description of Artificial Sequence: Synthetic oligonucleotide
  Target: ATXN1; (-) strand; PAM type: NRG; PAM sequence: AAG
caggaggcacaggttgcagc

SEQ ID NO: 42970 - DNA, 20 bp, Artificial Sequence
  Description of Artificial Sequence: Synthetic oligonucleotide
  Target: ATXN1; (-) strand; PAM type: NRG; PAM sequence: CAG
agcccaggaggcacaggttg

SEQ ID NO: 42971 - DNA, 20 bp, Artificial Sequence
  Description of Artificial Sequence: Synthetic oligonucleotide
  Target: ATXN1; (-) strand; PAM type: NRG; PAM sequence: AGG
cacttgagcccaggaggcac

SEQ ID NO: 42972 - DNA, 20 bp, Artificial Sequence
  Description of Artificial Sequence: Synthetic oligonucleotide
  Target: ATXN1; (-) strand; PAM type: NRG; PAM sequence: CAG
tcacttgagcccaggaggca

SEQ ID NO: 42973 - DNA, 20 bp, Artificial Sequence
  Description of Artificial Sequence: Synthetic oligonucleotide
  Target: ATXN1; (-) strand; PAM type: NRG; PAM sequence: AGG
gaggatcacttgagcccagg

SEQ ID NO: 42974 - DNA, 20 bp, Artificial Sequence
  Description of Artificial Sequence: Synthetic oligonucleotide
  Target: ATXN1; (-) strand; PAM type: NRG; PAM sequence: GAG
ggaggatcacttgagcccag

SEQ ID NO: 42975 - DNA, 20 bp, Artificial Sequence
  Description of Artificial Sequence: Synthetic oligonucleotide
  Target: ATXN1; (-) strand; PAM type: NRG; PAM sequence: AGG
tgggaggatcacttgagccc

SEQ ID NO: 42976 - DNA, 20 bp, Artificial Sequence
  Description of Artificial Sequence: Synthetic oligonucleotide
  Target: ATXN1; (-) strand; PAM type: NRG; PAM sequence: CAG
gtgggaggatcacttgagcc

SEQ ID NO: 42977 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggaggatcactt

SEQ ID NO: 42978 - DNA, 20 bp, Artificial Sequence
  Description of Artificial Sequence: Synthetic oligonucleotide
  Target: ATXN1; (-) strand; PAM type: NRG; PAM sequence: AGG
acctgggaggctgaggtggg

SEQ ID NO: 42979 - DNA, 20 bp, Artificial Sequence
  Description of Artificial Sequence: Synthetic oligonucleotide
  Target: ATXN1; (-) strand; PAM type: NRG; PAM sequence: GAG
tacctgggaggctgaggtgg

SEQ ID NO: 42980 - DNA, 20 bp, Artificial Sequence
  Description of Artificial Sequence: Synthetic oligonucleotide
  Target: ATXN1; (-) strand; PAM type: NRG; PAM sequence: GGG
gctacctgggaggctgaggt

SEQ ID NO: 42981 - DNA, 20 bp, Artificial Sequence
  Description of Artificial Sequence: Synthetic oligonucleotide
  Target: ATXN1; (-) strand; PAM type: NRG; PAM sequence: TGG
agctacctgggaggctgagg

SEQ ID NO: 42982 - DNA, 20 bp, Artificial Sequence
  Description of Artificial Sequence: Synthetic oligonucleotide
  Target: ATXN1; (-) strand; PAM type: NRG; PAM sequence: AGG
cccagctacctgggaggctg

SEQ ID NO: 42983 - DNA, 20 bp, Artificial Sequence
  Description of Artificial Sequence: Synthetic oligonucleotide
  Target: ATXN1; (-) strand; PAM type: NRG; PAM sequence: GAG
tcccagctacctgggaggct

SEQ ID NO: 42984 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctacctggg

SEQ ID NO: 42985 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctacctgg

SEQ ID NO: 42986 - DNA, 20 bp, Artificial Sequence
  Description of Artificial Sequence: Synthetic oligonucleotide
  Target: ATXN1; (-) strand; PAM type: NRG; PAM sequence: GGG
acctgtagtcccagctacct

SEQ ID NO: 42987 - DNA, 20 bp, Artificial Sequence
  Description of Artificial Sequence: Synthetic oligonucleotide
  Target: ATXN1; (-) strand; PAM type: NRG; PAM sequence: TGG
cacctgtagtcccagctacc

SEQ ID NO: 42988 - DNA, 20 bp, Artificial Sequence
  Description of Artificial Sequence: Synthetic oligonucleotide
  Target: ATXN1; (-) strand; PAM type: NRG; PAM sequence: CAG
gtggcgtgcacctgtagtcc

SEQ ID NO: 42989 - DNA, 20 bp, Artificial Sequence
  Description of Artificial Sequence: Synthetic oligonucleotide
  Target: ATXN1; (-) strand; PAM type: NRG; PAM sequence: TAG
ggtgtggtggcgtgcacctg

SEQ ID NO: 42990 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccgggtgtgg

SEQ ID NO: 42991 - DNA, 20 bp, Artificial Sequence
  Description of Artificial Sequence: Synthetic oligonucleotide
  Target: ATXN1; (-) strand; PAM type: NRG; PAM sequence: TGG
gtacaaaaattagccgggtg

SEQ ID NO: 42992 - DNA, 20 bp, Artificial Sequence
  Description of Artificial Sequence: Synthetic oligonucleotide
  Target: ATXN1; (-) strand; PAM type: NRG; PAM sequence: GGG
aaaaagtacaaaaattagcc

SEQ ID NO: 42993 - DNA, 20 bp, Artificial Sequence
  Description of Artificial Sequence: Synthetic oligonucleotide
  Target: ATXN1; (-) strand; PAM type: NRG; PAM sequence: CGG
caaaaagtacaaaaattagc

SEQ ID NO: 42994 - DNA, 20 bp, Artificial Sequence
  Description of Artificial Sequence: Synthetic oligonucleotide
  Target: ATXN1; (-) strand; PAM type: NRG; PAM sequence: TAG
tctacaaaaagtacaaaaat

SEQ ID NO: 42995 - DNA, 20 bp, Artificial Sequence
  Description of Artificial Sequence: Synthetic oligonucleotide
  Target: ATXN1; (-) strand; PAM type: NRG; PAM sequence: AAG
caaaaccccacctctacaaa

SEQ ID NO: 42996 - DNA, 20 bp, Artificial Sequence
  Description of Artificial Sequence: Synthetic oligonucleotide
  Target: ATXN1; (-) strand; PAM type: NRG; PAM sequence: TGG
caagaccagcctggccaaca

SEQ ID NO: 42997 - DNA, 20 bp, Artificial Sequence
  Description of Artificial Sequence: Synthetic oligonucleotide
  Target: ATXN1; (-) strand; PAM type: NRG; PAM sequence: TGG
aggcctgttcaagaccagcc

SEQ ID NO: 42998 - DNA, 20 bp, Artificial Sequence
  Description of Artificial Sequence: Synthetic oligonucleotide
  Target: ATXN1; (-) strand; PAM type: NRG; PAM sequence: CAG
cactgaggcctgttcaagac

SEQ ID NO: 42999 - DNA, 20 bp, Artificial Sequence
  Description of Artificial Sequence: Synthetic oligonucleotide
  Target: ATXN1; (-) strand; PAM type: NRG; PAM sequence: AAG
tggatcactgaggcctgttc

SEQ ID NO: 43000 - DNA, 20 bp, Artificial Sequence
  Description of Artificial Sequence: Synthetic oligonucleotide
  Target: ATXN1; (-) strand; PAM type: NRG; PAM sequence: AGG
gccaagtgggtggatcactg

SEQ ID NO: 43001 - DNA, 20 bp, Artificial Sequence
  Description of Artificial Sequence: Synthetic oligonucleotide
  Target: ATXN1; (-) strand; PAM type: NRG; PAM sequence: GAG
ggccaagtgggtggatcact

SEQ ID NO: 43002 - DNA, 20 bp, Artificial Sequence
  Description of Artificial Sequence: Synthetic oligonucleotide
  Target: ATXN1; (-) strand; PAM type: NRG; PAM sequence: TGG
gcaccgggaggccaagtggg

SEQ ID NO: 43003 - DNA, 20 bp, Artificial Sequence
  Description of Artificial Sequence: Synthetic oligonucleotide
  Target: ATXN1; (-) strand; PAM type: NRG; PAM sequence: GGG
ccagcaccgggaggccaagt

SEQ ID NO: 43004 - DNA, 20 bp, Artificial Sequence
  Description of Artificial Sequence: Synthetic oligonucleotide
  Target: ATXN1; (-) strand; PAM type: NRG; PAM sequence: TGG
cccagcaccgggaggccaag

SEQ ID NO: 43005 - DNA, 20 bp, Artificial Sequence
  Description of Artificial Sequence: Synthetic oligonucleotide
  Target: ATXN1; (-) strand; PAM type: NRG; PAM sequence: AAG
aatcccagcaccgggaggcc

SEQ ID NO: 43006 - DNA, 20 bp, Artificial Sequence
  Description of Artificial Sequence: Synthetic oligonucleotide
  Target: ATXN1; (-) strand; PAM type: NRG; PAM sequence: AGG
cctgtaatcccagcaccggg

SEQ ID NO: 43007 - DNA, 20 bp, Artificial Sequence
  Description of Artificial Sequence: Synthetic oligonucleotide
  Target: ATXN1; (-) strand; PAM type: NRG; PAM sequence: GAG
gcctgtaatcccagcaccgg

SEQ ID NO: 43008 - DNA, 20 bp, Artificial Sequence
  Description of Artificial Sequence: Synthetic oligonucleotide
  Target: ATXN1; (-) strand; PAM type: NRG; PAM sequence: GGG
atgcctgtaatcccagcacc

SEQ ID NO: 43009 - DNA, 20 bp, Artificial Sequence
  Description of Artificial Sequence: Synthetic oligonucleotide
  Target: ATXN1; (-) strand; PAM type: NRG; PAM sequence: CGG
catgcctgtaatcccagcac

SEQ ID NO: 43010 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctgtaatcc

SEQ ID NO: 43011 - DNA, 20 bp, Artificial Sequence
  Description of Artificial Sequence: Synthetic oligonucleotide
  Target: ATXN1; (-) strand; PAM type: NRG; PAM sequence: TGG
cccttccaagctggctgcag

SEQ ID NO: 43012 - DNA, 20 bp, Artificial Sequence
  Description of Artificial Sequence: Synthetic oligonucleotide
  Target: ATXN1; (-) strand; PAM type: NRG; PAM sequence: CAG
tgccccttccaagctggctg

SEQ ID NO: 43013 - DNA, 20 bp, Artificial Sequence
  Description of Artificial Sequence: Synthetic oligonucleotide
  Target: ATXN1; (-) strand; PAM type: NRG; PAM sequence: TGG
aatcattgccccttccaagc

SEQ ID NO: 43014 - DNA, 20 bp, Artificial Sequence
  Description of Artificial Sequence: Synthetic oligonucleotide
  Target: ATXN1; (-) strand; PAM type: NRG; PAM sequence: AAG
attaaatcattgccccttcc

SEQ ID NO: 43015 - DNA, 20 bp, Artificial Sequence
  Description of Artificial Sequence: Synthetic oligonucleotide
  Target: ATXN1; (-) strand; PAM type: NRG; PAM sequence: GGG
tgttggagcaaaaccaataa

SEQ ID NO: 43016 - DNA, 20 bp, Artificial Sequence
  Description of Artificial Sequence: Synthetic oligonucleotide
  Target: ATXN1; (-) strand; PAM type: NRG; PAM sequence: AGG
atgttggagcaaaaccaata

SEQ ID NO: 43017 - DNA, 20 bp, Artificial Sequence
  Description of Artificial Sequence: Synthetic oligonucleotide
  Target: ATXN1; (-) strand; PAM type: NRG; PAM sequence: AAG
gatgttggagcaaaaccaat

SEQ ID NO: 43018 - DNA, 20 bp, Artificial Sequence
  Description of Artificial Sequence: Synthetic oligonucleotide
  Target: ATXN1; (-) strand; PAM type: NRG; PAM sequence: GAG
gatgttcattgatgatgttg

SEQ ID NO: 43019 - DNA, 20 bp, Artificial Sequence
  Description of Artificial Sequence: Synthetic oligonucleotide
  Target: ATXN1; (-) strand; PAM type: NRG; PAM sequence: TGG
atgatgttcattgatgatgt

SEQ ID NO: 43020 - DNA, 20 bp, Artificial Sequence
  Description of Artificial Sequence: Synthetic oligonucleotide
  Target: ATXN1; (-) strand; PAM type: NRG; PAM sequence: GAG
gatcaaaatcattaaggatt

SEQ ID NO: 43021 - DNA, 20 bp, Artificial Sequence
  Description of Artificial Sequence: Synthetic oligonucleotide
  Target: ATXN1; (-) strand; PAM type: NRG; PAM sequence: AGG
atatctgatcaaaatcatta

SEQ ID NO: 43022 - DNA, 20 bp, Artificial Sequence
  Description of Artificial Sequence: Synthetic oligonucleotide
  Target: ATXN1; (-) strand; PAM type: NRG; PAM sequence: AAG
gatatctgatcaaaatcatt

SEQ ID NO: 43023 - DNA, 20 bp, Artificial Sequence
  Description of Artificial Sequence: Synthetic oligonucleotide
  Target: ATXN1; (-) strand; PAM type: NRG; PAM sequence: TAG
tttctaaacctgcaccttcc

SEQ ID NO: 43024 - DNA, 20 bp, Artificial Sequence
  Description of Artificial Sequence: Synthetic oligonucleotide
  Target: ATXN1; (-) strand; PAM type: NRG; PAM sequence: GAG
ctgaaatgtcctttgatatc

SEQ ID NO: 43025 - DNA, 20 bp, Artificial Sequence
  Description of Artificial Sequence: Synthetic oligonucleotide
  Target: ATXN1; (-) strand; PAM type: NRG; PAM sequence: GAG
aagcgcctctcttgtcatat

SEQ ID NO: 43026 - DNA, 20 bp, Artificial Sequence
  Description of Artificial Sequence: Synthetic oligonucleotide
  Target: ATXN1; (-) strand; PAM type: NRG; PAM sequence: AAG
tcatttccgtcccagtcttt

SEQ ID NO: 43027 - DNA, 20 bp, Artificial Sequence
  Description of Artificial Sequence: Synthetic oligonucleotide
  Target: ATXN1; (-) strand; PAM type: NRG; PAM sequence: CAG
cttatttttcatttccgtcc

SEQ ID NO: 43028 - DNA, 20 bp, Artificial Sequence
  Description of Artificial Sequence: Synthetic oligonucleotide
  Target: ATXN1; (-) strand; PAM type: NRG; PAM sequence: GGG
tcttcagcataagtgtttta

SEQ ID NO: 43029 - DNA, 20 bp, Artificial Sequence
  Description of Artificial Sequence: Synthetic oligonucleotide
  Target: ATXN1; (-) strand; PAM type: NRG; PAM sequence: AGG
ttcttcagcataagtgtttt

SEQ ID NO: 43030 - DNA, 20 bp, Artificial Sequence
  Description of Artificial Sequence: Synthetic oligonucleotide
  Target: ATXN1; (-) strand; PAM type: NRG; PAM sequence: TAG
tttcttcagcataagtgttt

SEQ ID NO: 43031 - DNA, 20 bp, Artificial Sequence
  Description of Artificial Sequence: Synthetic oligonucleotide
  Target: ATXN1; (-) strand; PAM type: NRG; PAM sequence: AAG
acacttcatttcttcagcat

SEQ ID NO: 43032 - DNA, 20 bp, Artificial Sequence
  Description of Artificial Sequence: Synthetic oligonucleotide
  Target: ATXN1; (-) strand; PAM type: NRG; PAM sequence: CAG
ccttcaacacttcatttctt

SEQ ID NO: 43033 - DNA, 20 bp, Artificial Sequence
  Description of Artificial Sequence: Synthetic oligonucleotide
  Target: ATXN1; (-) strand; PAM type: NRG; PAM sequence: AAG
cctgggttgcgagagtaaat

SEQ ID NO: 43034 - DNA, 20 bp, Artificial Sequence
  Description of Artificial Sequence: Synthetic oligonucleotide
  Target: ATXN1; (-) strand; PAM type: NRG; PAM sequence: GAG
aaaaaacacctgggttgcga

SEQ ID NO: 43035 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaacacctgggttgc

SEQ ID NO: 43036 - DNA, 20 bp, Artificial Sequence
  Description of Artificial Sequence: Synthetic oligonucleotide
  Target: ATXN1; (-) strand; PAM type: NRG; PAM sequence: GGG
atctcaaaaaaaaaacacct

SEQ ID NO: 43037 - DNA, 20 bp, Artificial Sequence
  Description of Artificial Sequence: Synthetic oligonucleotide
  Target: ATXN1; (-) strand; PAM type: NRG; PAM sequence: TGG
catctcaaaaaaaaaacacc

SEQ ID NO: 43038 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggcgacagagt

SEQ ID NO: 43039 - DNA, 20 bp, Artificial Sequence
  Description of Artificial Sequence: Synthetic oligonucleotide
  Target: ATXN1; (-) strand; PAM type: NRG; PAM sequence: GAG
gccctccagcctgggcgaca

SEQ ID NO: 43040 - DNA, 20 bp, Artificial Sequence
  Description of Artificial Sequence: Synthetic oligonucleotide
  Target: ATXN1; (-) strand; PAM type: NRG; PAM sequence: CAG
ttgccctccagcctgggcga

SEQ ID NO: 43041 - DNA, 20 bp, Artificial Sequence
  Description of Artificial Sequence: Synthetic oligonucleotide
  Target: ATXN1; (-) strand; PAM type: NRG; PAM sequence: GGG
ggcacattgccctccagcct

SEQ ID NO: 43042 - DNA, 20 bp, Artificial Sequence
  Description of Artificial Sequence: Synthetic oligonucleotide
  Target: ATXN1; (-) strand; PAM type: NRG; PAM sequence: TGG
tggcacattgccctccagcc

SEQ ID NO: 43043 - DNA, 20 bp, Artificial Sequence
  Description of Artificial Sequence: Synthetic oligonucleotide
  Target: ATXN1; (-) strand; PAM type: NRG; PAM sequence: CAG
gagattggcacattgccctc

SEQ ID NO: 43044 - DNA, 20 bp, Artificial Sequence
  Description of Artificial Sequence: Synthetic oligonucleotide
  Target: ATXN1; (-) strand; PAM type: NRG; PAM sequence: TGG
aggttgcagtgagccgagat

SEQ ID NO: 43045 - DNA, 20 bp, Artificial Sequence
  Description of Artificial Sequence: Synthetic oligonucleotide
  Target: ATXN1; (-) strand; PAM type: NRG; PAM sequence: GAG
ggcggaggttgcagtgagcc

SEQ ID NO: 43046 - DNA, 20 bp, Artificial Sequence
  Description of Artificial Sequence: Synthetic oligonucleotide
  Target: ATXN1; (-) strand; PAM type: NRG; PAM sequence: GAG
cgggaggcggaggttgcagt

SEQ ID NO: 43047 - DNA, 20 bp, Artificial Sequence
  Description of Artificial Sequence: Synthetic oligonucleotide
  Target: ATXN1; (-) strand; PAM type: NRG; PAM sequence: CAG
aacccgggaggcggaggttg

SEQ ID NO: 43048 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacccgggaggcgg

SEQ ID NO: 43049 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccgggaggcg

SEQ ID NO: 43050 - DNA, 20 bp, Artificial Sequence
  Description of Artificial Sequence: Synthetic oligonucleotide
  Target: ATXN1; (-) strand; PAM type: NRG; PAM sequence: CGG
aatcgcttgaacccgggagg

SEQ ID NO: 43051 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacccggg

SEQ ID NO: 43052 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaacccgg

SEQ ID NO: 43053 - DNA, 20 bp, Artificial Sequence
  Description of Artificial Sequence: Synthetic oligonucleotide
  Target: ATXN1; (-) strand; PAM type: NRG; PAM sequence: GGG
caggagaatcgcttgaaccc

SEQ ID NO: 43054 - DNA, 20 bp, Artificial Sequence
  Description of Artificial Sequence: Synthetic oligonucleotide
  Target: ATXN1; (-) strand; PAM type: NRG; PAM sequence: CGG
gcaggagaatcgcttgaacc

SEQ ID NO: 43055 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggcag

SEQ ID NO: 43056 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgaggc

SEQ ID NO: 43057 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgagg

SEQ ID NO: 43058 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 43059 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 43060 - DNA, 20 bp, Artificial Sequence
  Description of Artificial Sequence: Synthetic oligonucleotide
  Target: ATXN1; (-) strand; PAM type: NRG; PAM sequence: AGG
tataatcccagctactcagg

SEQ ID NO: 43061 - DNA, 20 bp, Artificial Sequence
  Description of Artificial Sequence: Synthetic oligonucleotide
  Target: ATXN1; (-) strand; PAM type: NRG; PAM sequence: GAG
ctataatcccagctactcag

SEQ ID NO: 43062 - DNA, 20 bp, Artificial Sequence
  Description of Artificial Sequence: Synthetic oligonucleotide
  Target: ATXN1; (-) strand; PAM type: NRG; PAM sequence: AGG
gcctataatcccagctactc

SEQ ID NO: 43063 - DNA, 20 bp, Artificial Sequence
  Description of Artificial Sequence: Synthetic oligonucleotide
  Target: ATXN1; (-) strand; PAM type: NRG; PAM sequence: CAG
cgcctataatcccagctact

SEQ ID NO: 43064 - DNA, 20 bp, Artificial Sequence
  Description of Artificial Sequence: Synthetic oligonucleotide
  Target: ATXN1; (-) strand; PAM type: NRG; PAM sequence: CAG
gcggcagccgcctataatcc

SEQ ID NO: 43065 - DNA, 20 bp, Artificial Sequence
  Description of Artificial Sequence: Synthetic oligonucleotide
  Target: ATXN1; (-) strand; PAM type: NRG; PAM sequence: CAG
aaattagccaggcatggcgg

SEQ ID NO: 43066 - DNA, 20 bp, Artificial Sequence
  Description of Artificial Sequence: Synthetic oligonucleotide
  Target: ATXN1; (-) strand; PAM type: NRG; PAM sequence: CGG
caaaaattagccaggcatgg

SEQ ID NO: 43067 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagccaggca

SEQ ID NO: 43068 - DNA, 20 bp, Artificial Sequence
  Description of Artificial Sequence: Synthetic oligonucleotide
  Target: ATXN1; (-) strand; PAM type: NRG; PAM sequence: AGG
taaaaatacaaaaattagcc

SEQ ID NO: 43069 - DNA, 20 bp, Artificial Sequence
  Description of Artificial Sequence: Synthetic oligonucleotide
  Target: ATXN1; (-) strand; PAM type: NRG; PAM sequence: CAG
ctaaaaatacaaaaattagc

SEQ ID NO: 43070 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatacaaaaat

SEQ ID NO: 43071 - DNA, 20 bp, Artificial Sequence
  Description of Artificial Sequence: Synthetic oligonucleotide
  Target: ATXN1; (-) strand; PAM type: NRG; PAM sequence: TGG
cgagaccagcctggccaaca

SEQ ID NO: 43072 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgagaccagcc

SEQ ID NO: 43073 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagttcgagac

SEQ ID NO: 43074 - DNA, 20 bp, Artificial Sequence
  Description of Artificial Sequence: Synthetic oligonucleotide
  Target: ATXN1; (-) strand; PAM type: NRG; PAM sequence: GAG
tcatttgaggtcaggagttc

SEQ ID NO: 43075 - DNA, 20 bp, Artificial Sequence
  Description of Artificial Sequence: Synthetic oligonucleotide
  Target: ATXN1; (-) strand; PAM type: NRG; PAM sequence: GAG
ggtggatcatttgaggtcag

SEQ ID NO: 43076 - DNA, 20 bp, Artificial Sequence
  Description of Artificial Sequence: Synthetic oligonucleotide
  Target: ATXN1; (-) strand; PAM type: NRG; PAM sequence: AGG
ctggtggatcatttgaggtc

SEQ ID NO: 43077 - DNA, 20 bp, Artificial Sequence
  Description of Artificial Sequence: Synthetic oligonucleotide
  Target: ATXN1; (-) strand; PAM type: NRG; PAM sequence: CAG
gctggtggatcatttgaggt

SEQ ID NO: 43078 - DNA, 20 bp, Artificial Sequence
  Description of Artificial Sequence: Synthetic oligonucleotide
  Target: ATXN1; (-) strand; PAM type: NRG; PAM sequence: AGG
agaggctggtggatcatttg

SEQ ID NO: 43079 - DNA, 20 bp, Artificial Sequence
  Description of Artificial Sequence: Synthetic oligonucleotide
  Target: ATXN1; (-) strand; PAM type: NRG; PAM sequence: GAG
tagaggctggtggatcattt

SEQ ID NO: 43080 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggtagaggctgg

SEQ ID NO: 43081 - DNA, 20 bp, Artificial Sequence
  Description of Artificial Sequence: Synthetic oligonucleotide
  Target: ATXN1; (-) strand; PAM type: NRG; PAM sequence: TGG
gcactttgggaggtagaggc

SEQ ID NO: 43082 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggtag

SEQ ID NO: 43083 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggta

SEQ ID NO: 43084 - DNA, 20 bp, Artificial Sequence
  Description of Artificial Sequence: Synthetic oligonucleotide
  Target: ATXN1; (-) strand; PAM type: NRG; PAM sequence: TAG
aatcccagcactttgggagg

SEQ ID NO: 43085 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 43086 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 43087 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 43088 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 43089 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 43090 - DNA, 20 bp, Artificial Sequence
  Description of Artificial Sequence: Synthetic oligonucleotide
  Target: ATXN1; (-) strand; PAM type: NRG; PAM sequence: TGG
cctaggtgggcagggcgcag

SEQ ID NO: 43091 - DNA, 20 bp, Artificial Sequence
  Description of Artificial Sequence: Synthetic oligonucleotide
  Target: ATXN1; (-) strand; PAM type: NRG; PAM sequence: CAG
aaccctaggtgggcagggcg

SEQ ID NO: 43092 - DNA, 20 bp, Artificial Sequence
  Description of Artificial Sequence: Synthetic oligonucleotide
  Target: ATXN1; (-) strand; PAM type: NRG; PAM sequence: GGG
acaaaaaccctaggtgggca

SEQ ID NO: 43093 - DNA, 20 bp, Artificial Sequence
  Description of Artificial Sequence: Synthetic oligonucleotide
  Target: ATXN1; (-) strand; PAM type: NRG; PAM sequence: AGG
tacaaaaaccctaggtgggc

SEQ ID NO: 43094 - DNA, 20 bp, Artificial Sequence
  Description of Artificial Sequence: Synthetic oligonucleotide
  Target: ATXN1; (-) strand; PAM type: NRG; PAM sequence: CAG
ttacaaaaaccctaggtggg

SEQ ID NO: 43095 - DNA, 20 bp, Artificial Sequence
  Description of Artificial Sequence: Synthetic oligonucleotide
  Target: ATXN1; (-) strand; PAM type: NRG; PAM sequence: GGG
cacttacaaaaaccctaggt

SEQ ID NO: 43096 - DNA, 20 bp, Artificial Sequence
  Description of Artificial Sequence: Synthetic oligonucleotide
  Target: ATXN1; (-) strand; PAM type: NRG; PAM sequence: TGG
tcacttacaaaaaccctagg

SEQ ID NO: 43097 - DNA, 20 bp, Artificial Sequence
  Description of Artificial Sequence: Synthetic oligonucleotide
  Target: ATXN1; (-) strand; PAM type: NRG; PAM sequence: AGG
ttgtcacttacaaaaaccct

SEQ ID NO: 43098 - DNA, 20 bp, Artificial Sequence
  Description of Artificial Sequence: Synthetic oligonucleotide
  Target: ATXN1; (-) strand; PAM type: NRG; PAM sequence: TAG
tttgtcacttacaaaaaccc

SEQ ID NO: 43099 - DNA, 20 bp, Artificial Sequence
  Description of Artificial Sequence: Synthetic oligonucleotide
  Target: ATXN1; (-) strand; PAM type: NRG; PAM sequence: CAG
agggaaggctgtacagaaca

SEQ ID NO: 43100 - DNA, 20 bp, Artificial Sequence
  Description of Artificial Sequence: Synthetic oligonucleotide
  Target: ATXN1; (-) strand; PAM type: NRG; PAM sequence: CAG
ttttacaagggaaggctgta

SEQ ID NO: 43101 - DNA, 20 bp, Artificial Sequence
  Description of Artificial Sequence: Synthetic oligonucleotide
  Target: ATXN1; (-) strand; PAM type: NRG; PAM sequence: AGG
gaacttctttttacaaggga

SEQ ID NO: 43102 - DNA, 20 bp, Artificial Sequence
  Description of Artificial Sequence: Synthetic oligonucleotide
  Target: ATXN1; (-) strand; PAM type: NRG; PAM sequence: AAG
agaacttctttttacaaggg

SEQ ID NO: 43103 - DNA, 20 bp, Artificial Sequence
  Description of Artificial Sequence: Synthetic oligonucleotide
  Target: ATXN1; (-) strand; PAM type: NRG; PAM sequence: GGG
attagaacttctttttacaa

SEQ ID NO: 43104 - DNA, 20 bp, Artificial Sequence
  Description of Artificial Sequence: Synthetic oligonucleotide
  Target: ATXN1; (-) strand; PAM type: NRG; PAM sequence: AGG
tattagaacttctttttaca

SEQ ID NO: 43105 - DNA, 20 bp, Artificial Sequence
  Description of Artificial Sequence: Synthetic oligonucleotide
  Target: ATXN1; (-) strand; PAM type: NRG; PAM sequence: AAG
ttattagaacttctttttac

SEQ ID NO: 43106 - DNA, 20 bp, Artificial Sequence
  Description of Artificial Sequence: Synthetic oligonucleotide
  Target: ATXN1; (-) strand; PAM type: NRG; PAM sequence: TAG
taaagataaaagttcattat

SEQ ID NO: 43107 - DNA, 20 bp, Artificial Sequence
  Description of Artificial Sequence: Synthetic oligonucleotide
  Target: ATXN1; (-) strand; PAM type: NRG; PAM sequence: AAG
gtcttgaaatttaaagataa

SEQ ID NO: 43108 - DNA, 20 bp, Artificial Sequence
  Description of Artificial Sequence: Synthetic oligonucleotide
  Target: ATXN1; (-) strand; PAM type: NRG; PAM sequence: AAG
agagtgagtcttgaaattta

SEQ ID NO: 43109 - DNA, 20 bp, Artificial Sequence
  Description of Artificial Sequence: Synthetic oligonucleotide
  Target: ATXN1; (-) strand; PAM type: NRG; PAM sequence: GAG
gcattccctttcttaagagt

SEQ ID NO: 43110 - DNA, 20 bp, Artificial Sequence
  Description of Artificial Sequence: Synthetic oligonucleotide
  Target: ATXN1; (-) strand; PAM type: NRG; PAM sequence: GAG
tttggcattccctttcttaa

SEQ ID NO: 43111 - DNA, 20 bp, Artificial Sequence
  Description of Artificial Sequence: Synthetic oligonucleotide
  Target: ATXN1; (-) strand; PAM type: NRG; PAM sequence: AAG
cgtttggcattccctttctt

SEQ ID NO: 43112 - DNA, 20 bp, Artificial Sequence
  Description of Artificial Sequence: Synthetic oligonucleotide
  Target: ATXN1; (-) strand; PAM type: NRG; PAM sequence: TGG
tatggaaatgtgggagcgtt

SEQ ID NO: 43113 - DNA, 20 bp, Artificial Sequence
  Description of Artificial Sequence: Synthetic oligonucleotide
  Target: ATXN1; (-) strand; PAM type: NRG; PAM sequence: GAG
tcgttggtatggaaatgtgg

SEQ ID NO: 43114 - DNA, 20 bp, Artificial Sequence
  Description of Artificial Sequence: Synthetic oligonucleotide
  Target: ATXN1; (-) strand; PAM type: NRG; PAM sequence: GGG
gctcgttggtatggaaatgt

SEQ ID NO: 43115 - DNA, 20 bp, Artificial Sequence
  Description of Artificial Sequence: Synthetic oligonucleotide
  Target: ATXN1; (-) strand; PAM type: NRG; PAM sequence: TGG
tgctcgttggtatggaaatg

SEQ ID NO: 43116 - DNA, 20 bp, Artificial Sequence
  Description of Artificial Sequence: Synthetic oligonucleotide
  Target: ATXN1; (-) strand; PAM type: NRG; PAM sequence: TGG
gttttccttgctcgttggta

SEQ ID NO: 43117 - DNA, 20 bp, Artificial Sequence
  Description of Artificial Sequence: Synthetic oligonucleotide
  Target: ATXN1; (-) strand; PAM type: NRG; PAM sequence: TGG
catgagttttccttgctcgt

SEQ ID NO: 43118 - DNA, 20 bp, Artificial Sequence
  Description of Artificial Sequence: Synthetic oligonucleotide
  Target: ATXN1; (-) strand; PAM type: NRG; PAM sequence: GAG
tctgagtaggtctcacgcat

SEQ ID NO: 43119 - DNA, 20 bp, Artificial Sequence
  Description of Artificial Sequence: Synthetic oligonucleotide
  Target: ATXN1; (-) strand; PAM type: NRG; PAM sequence: AGG
tggactggttctctctgagt

SEQ ID NO: 43120 - DNA, 20 bp, Artificial Sequence
  Description of Artificial Sequence: Synthetic oligonucleotide
  Target: ATXN1; (-) strand; PAM type: NRG; PAM sequence: TAG
atggactggttctctctgag

SEQ ID NO: 43121 - DNA, 20 bp, Artificial Sequence
  Description of Artificial Sequence: Synthetic oligonucleotide
  Target: ATXN1; (-) strand; PAM type: NRG; PAM sequence: GAG
cgcatggactggttctctct

SEQ ID NO: 43122 - DNA, 20 bp, Artificial Sequence
  Description of Artificial Sequence: Synthetic oligonucleotide
  Target: ATXN1; (-) strand; PAM type: NRG; PAM sequence: TGG
ccagcagggggcgcatggac

SEQ ID NO: 43123 - DNA, 20 bp, Artificial Sequence
  Description of Artificial Sequence: Synthetic oligonucleotide
  Target: ATXN1; (-) strand; PAM type: NRG; PAM sequence: TGG
gagggccagcagggggcgca

SEQ ID NO: 43124 - DNA, 20 bp, Artificial Sequence
  Description of Artificial Sequence: Synthetic oligonucleotide
  Target: ATXN1; (-) strand; PAM type: NRG; PAM sequence: GGG
gctgcaggagggccagcagg

SEQ ID NO: 43125 - DNA, 20 bp, Artificial Sequence
  Description of Artificial Sequence: Synthetic oligonucleotide
  Target: ATXN1; (-) strand; PAM type: NRG; PAM sequence: GGG
tgctgcaggagggccagcag

SEQ ID NO: 43126 - DNA, 20 bp, Artificial Sequence
  Description of Artificial Sequence: Synthetic oligonucleotide
  Target: ATXN1; (-) strand; PAM type: NRG; PAM sequence: GGG
gtgctgcaggagggccagca

SEQ ID NO: 43127 - DNA, 20 bp, Artificial Sequence
  Description of Artificial Sequence: Synthetic oligonucleotide
  Target: ATXN1; (-) strand; PAM type: NRG; PAM sequence: AGG
agtgctgcaggagggccagc

SEQ ID NO: 43128 - DNA, 20 bp, Artificial Sequence
  Description of Artificial Sequence: Synthetic oligonucleotide
  Target: ATXN1; (-) strand; PAM type: NRG; PAM sequence: CAG
cagtgctgcaggagggccag

SEQ ID NO: 43129 - DNA, 20 bp, Artificial Sequence
  Description of Artificial Sequence: Synthetic oligonucleotide
  Target: ATXN1; (-) strand; PAM type: NRG; PAM sequence: CAG
gatcagtgctgcaggagggc

SEQ ID NO: 43130 - DNA, 20 bp, Artificial Sequence
  Description of Artificial Sequence: Synthetic oligonucleotide
  Target: ATXN1; (-) strand; PAM type: NRG; PAM sequence: GGG
attggatcagtgctgcagga

SEQ ID NO: 43131 - DNA, 20 bp, Artificial Sequence
  Description of Artificial Sequence: Synthetic oligonucleotide
  Target: ATXN1; (-) strand; PAM type: NRG; PAM sequence: AGG
tattggatcagtgctgcagg

SEQ ID NO: 43132 - DNA, 20 bp, Artificial Sequence
  Description of Artificial Sequence: Synthetic oligonucleotide
  Target: ATXN1; (-) strand; PAM type: NRG; PAM sequence: GAG
ttattggatcagtgctgcag

SEQ ID NO: 43133 - DNA, 20 bp, Artificial Sequence
  Description of Artificial Sequence: Synthetic oligonucleotide
  Target: ATXN1; (-) strand; PAM type: NRG; PAM sequence: AGG
ttttattggatcagtgctgc

SEQ ID NO: 43134 - DNA, 20 bp, Artificial Sequence
  Description of Artificial Sequence: Synthetic oligonucleotide
  Target: ATXN1; (-) strand; PAM type: NRG; PAM sequence: CAG
gttttattggatcagtgctg

SEQ ID NO: 43135 - DNA, 20 bp, Artificial Sequence
  Description of Artificial Sequence: Synthetic oligonucleotide
  Target: ATXN1; (-) strand; PAM type: NRG; PAM sequence: CAG
cctgtggggttttattggat

SEQ ID NO: 43136 - DNA, 20 bp, Artificial Sequence
  Description of Artificial Sequence: Synthetic oligonucleotide
  Target: ATXN1; (-) strand; PAM type: NRG; PAM sequence: TGG
gaaaccctgtggggttttat

SEQ ID NO: 43137 - DNA, 20 bp, Artificial Sequence
  Description of Artificial Sequence: Synthetic oligonucleotide
  Target: ATXN1; (-) strand; PAM type: NRG; PAM sequence: GGG
atccctcatgaaaccctgtg

SEQ ID NO: 43138 - DNA, 20 bp, Artificial Sequence
  Description of Artificial Sequence: Synthetic oligonucleotide
  Target: ATXN1; (-) strand; PAM type: NRG; PAM sequence: GGG
tatccctcatgaaaccctgt

SEQ ID NO: 43139 - DNA, 20 bp, Artificial Sequence
  Description of Artificial Sequence: Synthetic oligonucleotide
  Target: ATXN1; (-) strand; PAM type: NRG; PAM sequence: TGG
atatccctcatgaaaccctg

SEQ ID NO: 43140 - DNA, 20 bp, Artificial Sequence
  Description of Artificial Sequence: Synthetic oligonucleotide
  Target: ATXN1; (-) strand; PAM type: NRG; PAM sequence: GGG
aacctattcccttactggct

SEQ ID NO: 43141 - DNA, 20 bp, Artificial Sequence
  Description of Artificial Sequence: Synthetic oligonucleotide
  Target: ATXN1; (-) strand; PAM type: NRG; PAM sequence: TGG
taacctattcccttactggc

SEQ ID NO: 43142 - DNA, 20 bp, Artificial Sequence
  Description of Artificial Sequence: Synthetic oligonucleotide
  Target: ATXN1; (-) strand; PAM type: NRG; PAM sequence: TGG
taattaacctattcccttac

SEQ ID NO: 43143 - DNA, 20 bp, Artificial Sequence
  Description of Artificial Sequence: Synthetic oligonucleotide
  Target: ATXN1; (-) strand; PAM type: NRG; PAM sequence: GGG
ttcttccctagtgctgcctt

SEQ ID NO: 43144 - DNA, 20 bp, Artificial Sequence
  Description of Artificial Sequence: Synthetic oligonucleotide
  Target: ATXN1; (-) strand; PAM type: NRG; PAM sequence: TGG
tttcttccctagtgctgcct

SEQ ID NO: 43145 - DNA, 20 bp, Artificial Sequence
  Description of Artificial Sequence: Synthetic oligonucleotide
  Target: ATXN1; (-) strand; PAM type: NRG; PAM sequence: TAG
tgccgctgctttttcttccc

SEQ ID NO: 43146 - DNA, 20 bp, Artificial Sequence
  Description of Artificial Sequence: Synthetic oligonucleotide
  Target: ATXN1; (-) strand; PAM type: NRG; PAM sequence: AGG
acattttacttggctttgaa

SEQ ID NO: 43147 - DNA, 20 bp, Artificial Sequence
  Description of Artificial Sequence: Synthetic oligonucleotide
  Target: ATXN1; (-) strand; PAM type: NRG; PAM sequence: AAG
gacattttacttggctttga

SEQ ID NO: 43148 - DNA, 20 bp, Artificial Sequence
  Description of Artificial Sequence: Synthetic oligonucleotide
  Target: ATXN1; (-) strand; PAM type: NRG; PAM sequence: TGG
aatgtgtttgacattttact

SEQ ID NO: 43149 - DNA, 20 bp, Artificial Sequence
  Description of Artificial Sequence: Synthetic oligonucleotide
  Target: ATXN1; (-) strand; PAM type: NRG; PAM sequence: TAG
tgttacatttgcattgctaa

SEQ ID NO: 43150 - DNA, 20 bp, Artificial Sequence
  Description of Artificial Sequence: Synthetic oligonucleotide
  Target: ATXN1; (-) strand; PAM type: NRG; PAM sequence: AGG
tattgtgcattcaattgtac

SEQ ID NO: 43151 - DNA, 20 bp, Artificial Sequence
  Description of Artificial Sequence: Synthetic oligonucleotide
  Target: ATXN1; (-) strand; PAM type: NRG; PAM sequence: CAG
gtattgtgcattcaattgta

SEQ ID NO: 43152 - DNA, 20 bp, Artificial Sequence
  Description of Artificial Sequence: Synthetic oligonucleotide
  Target: ATXN1; (-) strand; PAM type: NRG; PAM sequence: TAG
gtaccttcagaggagttttc

SEQ ID NO: 43153 - DNA, 20 bp, Artificial Sequence
  Description of Artificial Sequence: Synthetic oligonucleotide
  Target: ATXN1; (-) strand; PAM type: NRG; PAM sequence: GAG
ctaaagaagtaccttcagag

SEQ ID NO: 43154 - DNA, 20 bp, Artificial Sequence
  Description of Artificial Sequence: Synthetic oligonucleotide
  Target: ATXN1; (-) strand; PAM type: NRG; PAM sequence: AGG
tcctaaagaagtaccttcag

SEQ ID NO: 43155 - DNA, 20 bp, Artificial Sequence
  Description of Artificial Sequence: Synthetic oligonucleotide
  Target: ATXN1; (-) strand; PAM type: NRG; PAM sequence: GAG
ttcctaaagaagtaccttca

SEQ ID NO: 43156 - DNA, 20 bp, Artificial Sequence
  Description of Artificial Sequence: Synthetic oligonucleotide
  Target: ATXN1; (-) strand; PAM type: NRG; PAM sequence: CAG
gcttcctaaagaagtacctt

SEQ ID NO: 43157 - DNA, 20 bp, Artificial Sequence
  Description of Artificial Sequence: Synthetic oligonucleotide
  Target: ATXN1; (-) strand; PAM type: NRG; PAM sequence: AAG
cgaaagctggcttcctaaag

SEQ ID NO: 43158 - DNA, 20 bp, Artificial Sequence
  Description of Artificial Sequence: Synthetic oligonucleotide
  Target: ATXN1; (-) strand; PAM type: NRG; PAM sequence: AAG
ttacgaaagctggcttccta

SEQ ID NO: 43159 - DNA, 20 bp, Artificial Sequence
  Description of Artificial Sequence: Synthetic oligonucleotide
  Target: ATXN1; (-) strand; PAM type: NRG; PAM sequence: TGG
tttttcaaatttacgaaagc

SEQ ID NO: 43160 - DNA, 20 bp, Artificial Sequence
  Description of Artificial Sequence: Synthetic oligonucleotide
  Target: ATXN1; (-) strand; PAM type: NRG; PAM sequence: AAG
attctttttcaaatttacga

SEQ ID NO: 43161 - DNA, 20 bp, Artificial Sequence
  Description of Artificial Sequence: Synthetic oligonucleotide
  Target: ATXN1; (-) strand; PAM type: NRG; PAM sequence: CAG
agcactactgagaaccaagt

SEQ ID NO: 43162 - DNA, 20 bp, Artificial Sequence
  Description of Artificial Sequence: Synthetic oligonucleotide
  Target: ATXN1; (-) strand; PAM type: NRG; PAM sequence: AAG
cctgagcactactgagaacc

SEQ ID NO: 43163 - DNA, 20 bp, Artificial Sequence
  Description of Artificial Sequence: Synthetic oligonucleotide
  Target: ATXN1; (-) strand; PAM type: NRG; PAM sequence: GAG
aattaaacctgagcactact

SEQ ID NO: 43164 - DNA, 20 bp, Artificial Sequence
  Description of Artificial Sequence: Synthetic oligonucleotide
  Target: ATXN1; (-) strand; PAM type: NRG; PAM sequence: GAG
taaacagtataattaaacct

SEQ ID NO: 43165 - DNA, 20 bp, Artificial Sequence
  Description of Artificial Sequence: Synthetic oligonucleotide
  Target: ATXN1; (-) strand; PAM type: NRG; PAM sequence: CAG
gccgatgtctctcaaataaa

SEQ ID NO: 43166 - DNA, 20 bp, Artificial Sequence
  Description of Artificial Sequence: Synthetic oligonucleotide
  Target: ATXN1; (-) strand; PAM type: NRG; PAM sequence: AAG
gtgagtcttcagggctgact

SEQ ID NO: 43167 - DNA, 20 bp, Artificial Sequence
  Description of Artificial Sequence: Synthetic oligonucleotide
  Target: ATXN1; (-) strand; PAM type: NRG; PAM sequence: GGG
accagtccagtgagtcttca

SEQ ID NO: 43168 - DNA, 20 bp, Artificial Sequence
  Description of Artificial Sequence: Synthetic oligonucleotide
  Target: ATXN1; (-) strand; PAM type: NRG; PAM sequence: AGG
gaccagtccagtgagtcttc

SEQ ID NO: 43169 - DNA, 20 bp, Artificial Sequence
  Description of Artificial Sequence: Synthetic oligonucleotide
  Target: ATXN1; (-) strand; PAM type: NRG; PAM sequence: CAG
agaccagtccagtgagtctt

SEQ ID NO: 43170 - DNA, 20 bp, Artificial Sequence
  Description of Artificial Sequence: Synthetic oligonucleotide
  Target: ATXN1; (-) strand; PAM type: NRG; PAM sequence: GAG
tcgcagaagaccagtccagt

SEQ ID NO: 43171 - DNA, 20 bp, Artificial Sequence
  Description of Artificial Sequence: Synthetic oligonucleotide
  Target: ATXN1; (-) strand; PAM type: NRG; PAM sequence: CAG
catttcgcagaagaccagtc

SEQ ID NO: 43172 - DNA, 20 bp, Artificial Sequence
  Description of Artificial Sequence: Synthetic oligonucleotide
  Target: ATXN1; (-) strand; PAM type: NRG; PAM sequence: CAG
gcaatcatttcgcagaagac

SEQ ID NO: 43173 - DNA, 20 bp, Artificial Sequence
  Description of Artificial Sequence: Synthetic oligonucleotide
  Target: ATXN1; (-) strand; PAM type: NRG; PAM sequence: AAG
tcttagcaatcatttcgcag

SEQ ID NO: 43174 - DNA, 20 bp, Artificial Sequence
  Description of Artificial Sequence: Synthetic oligonucleotide
  Target: ATXN1; (-) strand; PAM type: NRG; PAM sequence: CAG
atgtcttagcaatcatttcg

SEQ ID NO: 43175 - DNA, 20 bp, Artificial Sequence
  Description of Artificial Sequence: Synthetic oligonucleotide
  Target: ATXN1; (-) strand; PAM type: NRG; PAM sequence: TAG
gtgttaaggccaatatgtct

SEQ ID NO: 43176 - DNA, 20 bp, Artificial Sequence
  Description of Artificial Sequence: Synthetic oligonucleotide
  Target: ATXN1; (-) strand; PAM type: NRG; PAM sequence: AGG
aaatttggatttgtgtgtta

SEQ ID NO: 43177 - DNA, 20 bp, Artificial Sequence
  Description of Artificial Sequence: Synthetic oligonucleotide
  Target: ATXN1; (-) strand; PAM type: NRG; PAM sequence: AAG
taaatttggatttgtgtgtt

SEQ ID NO: 43178 - DNA, 20 bp, Artificial Sequence
  Description of Artificial Sequence: Synthetic oligonucleotide
  Target: ATXN1; (-) strand; PAM type: NRG; PAM sequence: TGG
agttttcagaagaataaatt

SEQ ID NO: 43179 - DNA, 20 bp, Artificial Sequence
  Description of Artificial Sequence: Synthetic oligonucleotide
  Target: ATXN1; (-) strand; PAM type: NRG; PAM sequence: AAG
atcaatggataagttttcag

SEQ ID NO: 43180 - DNA, 20 bp, Artificial Sequence
  Description of Artificial Sequence: Synthetic oligonucleotide
  Target: ATXN1; (-) strand; PAM type: NRG; PAM sequence: CAG
tttatcaatggataagtttt

SEQ ID NO: 43181 - DNA, 20 bp, Artificial Sequence
  Description of Artificial Sequence: Synthetic oligonucleotide
  Target: ATXN1; (-) strand; PAM type: NRG; PAM sequence: AAG
gatgctgtttatcaatggat

SEQ ID NO: 43182 - DNA, 20 bp, Artificial Sequence
  Description of Artificial Sequence: Synthetic oligonucleotide
  Target: ATXN1; (-) strand; PAM type: NRG; PAM sequence: TGG
gaaaagatgctgtttatcaa

SEQ ID NO: 43183 - DNA, 20 bp, Artificial Sequence
  Description of Artificial Sequence: Synthetic oligonucleotide
  Target: ATXN1; (-) strand; PAM type: NRG; PAM sequence: AAG
ctcattggcaatctctggaa

SEQ ID NO: 43184 - DNA, 20 bp, Artificial Sequence
  Description of Artificial Sequence: Synthetic oligonucleotide
  Target: ATXN1; (-) strand; PAM type: NRG; PAM sequence: TGG
gatttctcattggcaatctc

SEQ ID NO: 43185 - DNA, 20 bp, Artificial Sequence
  Description of Artificial Sequence: Synthetic oligonucleotide
  Target: ATXN1; (-) strand; PAM type: NRG; PAM sequence: TGG
ttgtgtccttgatttctcat

SEQ ID NO: 43186 - DNA, 20 bp, Artificial Sequence
  Description of Artificial Sequence: Synthetic oligonucleotide
  Target: ATXN1; (-) strand; PAM type: NRG; PAM sequence: CAG
aacttttatcggtttggccc

SEQ ID NO: 43187 - DNA, 20 bp, Artificial Sequence
  Description of Artificial Sequence: Synthetic oligonucleotide
  Target: ATXN1; (-) strand; PAM type: NRG; PAM sequence: TGG
ggtggaaacttttatcggtt

SEQ ID NO: 43188 - DNA, 20 bp, Artificial Sequence
  Description of Artificial Sequence: Synthetic oligonucleotide
  Target: ATXN1; (-) strand; PAM type: NRG; PAM sequence: CGG
ggatgggtggaaacttttat

SEQ ID NO: 43189 - DNA, 20 bp, Artificial Sequence
  Description of Artificial Sequence: Synthetic oligonucleotide
  Target: ATXN1; (-) strand; PAM type: NRG; PAM sequence: TGG
aaatgtaggaggaggatggg

SEQ ID NO: 43190 - DNA, 20 bp, Artificial Sequence
  Description of Artificial Sequence: Synthetic oligonucleotide
  Target: ATXN1; (-) strand; PAM type: NRG; PAM sequence: GGG
cctaaatgtaggaggaggat

SEQ ID NO: 43191 - DNA, 20 bp, Artificial Sequence
  Description of Artificial Sequence: Synthetic oligonucleotide
  Target: ATXN1; (-) strand; PAM type: NRG; PAM sequence: TGG
ccctaaatgtaggaggagga

SEQ ID NO: 43192 - DNA, 20 bp, Artificial Sequence
  Description of Artificial Sequence: Synthetic oligonucleotide
  Target: ATXN1; (-) strand; PAM type: NRG; PAM sequence: AGG
atagccctaaatgtaggagg

SEQ ID NO: 43193 - DNA, 20 bp, Artificial Sequence
  Description of Artificial Sequence: Synthetic oligonucleotide
  Target: ATXN1; (-) strand; PAM type: NRG; PAM sequence: GAG
aatagccctaaatgtaggag

SEQ ID NO: 43194 - DNA, 20 bp, Artificial Sequence
  Description of Artificial Sequence: Synthetic oligonucleotide
  Target: ATXN1; (-) strand; PAM type: NRG; PAM sequence: AGG
taaatagccctaaatgtagg

SEQ ID NO: 43195 - DNA, 20 bp, Artificial Sequence
  Description of Artificial Sequence: Synthetic oligonucleotide
  Target: ATXN1; (-) strand; PAM type: NRG; PAM sequence: GAG
gtaaatagccctaaatgtag

SEQ ID NO: 43196 - DNA, 20 bp, Artificial Sequence
  Description of Artificial Sequence: Synthetic oligonucleotide
  Target: ATXN1; (-) strand; PAM type: NRG; PAM sequence: AGG
tggtaaatagccctaaatgt

SEQ ID NO: 43197 - DNA, 20 bp, Artificial Sequence
  Description of Artificial Sequence: Synthetic oligonucleotide
  Target: ATXN1; (-) strand; PAM type: NRG; PAM sequence: TAG
ctggtaaatagccctaaatg

SEQ ID NO: 43198 - DNA, 20 bp, Artificial Sequence
  Description of Artificial Sequence: Synthetic oligonucleotide
  Target: ATXN1; (-) strand; PAM type: NRG; PAM sequence: TAG
ctccgtgctgcactggtaaa

SEQ ID NO: 43199 - DNA, 20 bp, Artificial Sequence
  Description of Artificial Sequence: Synthetic oligonucleotide
  Target: ATXN1; (-) strand; PAM type: NRG; PAM sequence: TGG
ctgtctgctccgtgctgcac

SEQ ID NO: 43200 - DNA, 20 bp, Artificial Sequence
  Description of Artificial Sequence: Synthetic oligonucleotide
  Target: ATXN1; (-) strand; PAM type: NRG; PAM sequence: GAG
acacatacctcagcgttaga

SEQ ID NO: 43201 - DNA, 20 bp, Artificial Sequence
  Description of Artificial Sequence: Synthetic oligonucleotide
  Target: ATXN1; (-) strand; PAM type: NRG; PAM sequence: GAG
ggacacatacctcagcgtta

SEQ ID NO: 43202 - DNA, 20 bp, Artificial Sequence
  Description of Artificial Sequence: Synthetic oligonucleotide
  Target: ATXN1; (-) strand; PAM type: NRG; PAM sequence: TAG
agggacacatacctcagcgt

SEQ ID NO: 43203 - DNA, 20 bp, Artificial Sequence
  Description of Artificial Sequence: Synthetic oligonucleotide
  Target: ATXN1; (-) strand; PAM type: NRG; PAM sequence: CAG
cagagaagggacacatacct

SEQ ID NO: 43204 - DNA, 20 bp, Artificial Sequence
  Description of Artificial Sequence: Synthetic oligonucleotide
  Target: ATXN1; (-) strand; PAM type: NRG; PAM sequence: GGG
agcttacggggcccagagaa

SEQ ID NO: 43205 - DNA, 20 bp, Artificial Sequence
  Description of Artificial Sequence: Synthetic oligonucleotide
  Target: ATXN1; (-) strand; PAM type: NRG; PAM sequence: AGG
aagcttacggggcccagaga

SEQ ID NO: 43206 - DNA, 20 bp, Artificial Sequence
  Description of Artificial Sequence: Synthetic oligonucleotide
  Target: ATXN1; (-) strand; PAM type: NRG; PAM sequence: AAG
aaagcttacggggcccagag

SEQ ID NO: 43207 - DNA, 20 bp, Artificial Sequence
  Description of Artificial Sequence: Synthetic oligonucleotide
  Target: ATXN1; (-) strand; PAM type: NRG; PAM sequence: GAG
ctgaaagcttacggggccca

SEQ ID NO: 43208 - DNA, 20 bp, Artificial Sequence
  Description of Artificial Sequence: Synthetic oligonucleotide
  Target: ATXN1; (-) strand; PAM type: NRG; PAM sequence: CAG
tactgaaagcttacggggcc

SEQ ID NO: 43209 - DNA, 20 bp, Artificial Sequence
  Description of Artificial Sequence: Synthetic oligonucleotide
  Target: ATXN1; (-) strand; PAM type: NRG; PAM sequence: GGG
atcagtactgaaagcttacg

SEQ ID NO: 43210 - DNA, 20 bp, Artificial Sequence
  Description of Artificial Sequence: Synthetic oligonucleotide
  Target: ATXN1; (-) strand; PAM type: NRG; PAM sequence: GGG
tatcagtactgaaagcttac

SEQ ID NO: 43211 - DNA, 20 bp, Artificial Sequence
  Description of Artificial Sequence: Synthetic oligonucleotide
  Target: ATXN1; (-) strand; PAM type: NRG; PAM sequence: CGG
ttatcagtactgaaagctta

SEQ ID NO: 43212 - DNA, 20 bp, Artificial Sequence
  Description of Artificial Sequence: Synthetic oligonucleotide
  Target: ATXN1; (-) strand; PAM type: NRG; PAM sequence: AAG
tttccccttatcagtactga

SEQ ID NO: 43213 - DNA, 20 bp, Artificial Sequence
  Description of Artificial Sequence: Synthetic oligonucleotide
  Target: ATXN1; (-) strand; PAM type: NRG; PAM sequence: CAG
acccgtgggtttccccttat

SEQ ID NO: 43214 - DNA, 20 bp, Artificial Sequence
  Description of Artificial Sequence: Synthetic oligonucleotide
  Target: ATXN1; (-) strand; PAM type: NRG; PAM sequence: GGG
aagacccaatctctacccgt

SEQ ID NO: 43215 - DNA, 20 bp, Artificial Sequence
  Description of Artificial Sequence: Synthetic oligonucleotide
  Target: ATXN1; (-) strand; PAM type: NRG; PAM sequence: TGG
caagacccaatctctacccg

SEQ ID NO: 43216 - DNA, 20 bp, Artificial Sequence
  Description of Artificial Sequence: Synthetic oligonucleotide
  Target: ATXN1; (-) strand; PAM type: NRG; PAM sequence: AAG
tggttcattgaaaatacagc

SEQ ID NO: 43217 - DNA, 20 bp, Artificial Sequence
  Description of Artificial Sequence: Synthetic oligonucleotide
  Target: ATXN1; (-) strand; PAM type: NRG; PAM sequence: CAG
ctggtggttcattgaaaata

SEQ ID NO: 43218 - DNA, 20 bp, Artificial Sequence
  Description of Artificial Sequence: Synthetic oligonucleotide
  Target: ATXN1; (-) strand; PAM type: NRG; PAM sequence: TGG
catcctggggcgccctctgg

SEQ ID NO: 43219 - DNA, 20 bp, Artificial Sequence
  Description of Artificial Sequence: Synthetic oligonucleotide
  Target: ATXN1; (-) strand; PAM type: NRG; PAM sequence: TGG
tgccatcctggggcgccctc

SEQ ID NO: 43220 - DNA, 20 bp, Artificial Sequence
  Description of Artificial Sequence: Synthetic oligonucleotide
  Target: ATXN1; (-) strand; PAM type: NRG; PAM sequence: GGG
aggaatgtggtgccatcctg

SEQ ID NO: 43221 - DNA, 20 bp, Artificial Sequence
  Description of Artificial Sequence: Synthetic oligonucleotide
  Target: ATXN1; (-) strand; PAM type: NRG; PAM sequence: GGG
caggaatgtggtgccatcct

SEQ ID NO: 43222 - DNA, 20 bp, Artificial Sequence
  Description of Artificial Sequence: Synthetic oligonucleotide
  Target: ATXN1; (-) strand; PAM type: NRG; PAM sequence: TGG
ccaggaatgtggtgccatcc

SEQ ID NO: 43223 - DNA, 20 bp, Artificial Sequence
  Description of Artificial Sequence: Synthetic oligonucleotide
  Target: ATXN1; (-) strand; PAM type: NRG; PAM sequence: TGG
cacccgatagaccaggaatg

SEQ ID NO: 43224 - DNA, 20 bp, Artificial Sequence
  Description of Artificial Sequence: Synthetic oligonucleotide
  Target: ATXN1; (-) strand; PAM type: NRG; PAM sequence: AGG
ccatgatcacccgatagacc

SEQ ID NO: 43225 - DNA, 20 bp, Artificial Sequence
  Description of Artificial Sequence: Synthetic oligonucleotide
  Target: ATXN1; (-) strand; PAM type: NRG; PAM sequence: CAG
cccatgatcacccgatagac

SEQ ID NO: 43226 - DNA, 20 bp, Artificial Sequence
  Description of Artificial Sequence: Synthetic oligonucleotide
  Target: ATXN1; (-) strand; PAM type: NRG; PAM sequence: TAG
ttagtcccatgatcacccga

SEQ ID NO: 43227 - DNA, 20 bp, Artificial Sequence
  Description of Artificial Sequence: Synthetic oligonucleotide
  Target: ATXN1; (-) strand; PAM type: NRG; PAM sequence: TAG
taagttacttctttgttgtt

SEQ ID NO: 43228 - DNA, 20 bp, Artificial Sequence
  Description of Artificial Sequence: Synthetic oligonucleotide
  Target: ATXN1; (-) strand; PAM type: NRG; PAM sequence: AAG
atctacttttccaccttcat

SEQ ID NO: 43229 - DNA, 20 bp, Artificial Sequence
  Description of Artificial Sequence: Synthetic oligonucleotide
  Target: ATXN1; (-) strand; PAM type: NRG; PAM sequence: CAG
gcaactagagactctaagag

SEQ ID NO: 43230 - DNA, 20 bp, Artificial Sequence
  Description of Artificial Sequence: Synthetic oligonucleotide
  Target: ATXN1; (-) strand; PAM type: NRG; PAM sequence: GAG
tctgcaactagagactctaa

SEQ ID NO: 43231 - DNA, 20 bp, Artificial Sequence
  Description of Artificial Sequence: Synthetic oligonucleotide
  Target: ATXN1; (-) strand; PAM type: NRG; PAM sequence: AAG
tgtctgcaactagagactct

SEQ ID NO: 43232 - DNA, 20 bp, Artificial Sequence
  Description of Artificial Sequence: Synthetic oligonucleotide
  Target: ATXN1; (-) strand; PAM type: NRG; PAM sequence: GAG
aggccagttgtctgcaacta

SEQ ID NO: 43233 - DNA, 20 bp, Artificial Sequence
  Description of Artificial Sequence: Synthetic oligonucleotide
  Target: ATXN1; (-) strand; PAM type: NRG; PAM sequence: TAG
agaggccagttgtctgcaac

SEQ ID NO: 43234 - DNA, 20 bp, Artificial Sequence
  Description of Artificial Sequence: Synthetic oligonucleotide
  Target: ATXN1; (-) strand; PAM type: NRG; PAM sequence: CAG
gcaattcaggacacagaggc

SEQ ID NO: 43235 - DNA, 20 bp, Artificial Sequence
  Description of Artificial Sequence: Synthetic oligonucleotide
  Target: ATXN1; (-) strand; PAM type: NRG; PAM sequence: AGG
gagggcaattcaggacacag

SEQ ID NO: 43236 - DNA, 20 bp, Artificial Sequence
  Description of Artificial Sequence: Synthetic oligonucleotide
  Target: ATXN1; (-) strand; PAM type: NRG; PAM sequence: GAG
ggagggcaattcaggacaca

SEQ ID NO: 43237 - DNA, 20 bp, Artificial Sequence
  Description of Artificial Sequence: Synthetic oligonucleotide
  Target: ATXN1; (-) strand; PAM type: NRG; PAM sequence: CAG
tgggagggcaattcaggaca

SEQ ID NO: 43238 - DNA, 20 bp, Artificial Sequence
  Description of Artificial Sequence: Synthetic oligonucleotide
  Target: ATXN1; (-) strand; PAM type: NRG; PAM sequence: AGG
gtcccctgggagggcaattc

SEQ ID NO: 43239 - DNA, 20 bp, Artificial Sequence
  Description of Artificial Sequence: Synthetic oligonucleotide
  Target: ATXN1; (-) strand; PAM type: NRG; PAM sequence: CAG
ggtcccctgggagggcaatt

SEQ ID NO: 43240 - DNA, 20 bp, Artificial Sequence
  Description of Artificial Sequence: Synthetic oligonucleotide
  Target: ATXN1; (-) strand; PAM type: NRG; PAM sequence: GGG
tcctcgggggtcccctggga

SEQ ID NO: 43241 - DNA, 20 bp, Artificial Sequence
  Description of Artificial Sequence: Synthetic oligonucleotide
  Target: ATXN1; (-) strand; PAM type: NRG; PAM sequence: AGG
ctcctcgggggtcccctggg

SEQ ID NO: 43242 - DNA, 20 bp, Artificial Sequence
  Description of Artificial Sequence: Synthetic oligonucleotide
  Target: ATXN1; (-) strand; PAM type: NRG; PAM sequence: GAG
actcctcgggggtcccctgg

SEQ ID NO: 43243 - DNA, 20 bp, Artificial Sequence
  Description of Artificial Sequence: Synthetic oligonucleotide
  Target: ATXN1; (-) strand; PAM type: NRG; PAM sequence: GGG
aaactcctcgggggtcccct

SEQ ID NO: 43244 - DNA, 20 bp, Artificial Sequence
  Description of Artificial Sequence: Synthetic oligonucleotide
  Target: ATXN1; (-) strand; PAM type: NRG; PAM sequence: TGG
taaactcctcgggggtcccc

SEQ ID NO: 43245 - DNA, 20 bp, Artificial Sequence
  Description of Artificial Sequence: Synthetic oligonucleotide
  Target: ATXN1; (-) strand; PAM type: NRG; PAM sequence: GGG
tccagagataaactcctcgg

SEQ ID NO: 43246 - DNA, 20 bp, Artificial Sequence
  Description of Artificial Sequence: Synthetic oligonucleotide
  Target: ATXN1; (-) strand; PAM type: NRG; PAM sequence: GGG
ttccagagataaactcctcg

SEQ ID NO: 43247 - DNA, 20 bp, Artificial Sequence
  Description of Artificial Sequence: Synthetic oligonucleotide
  Target: ATXN1; (-) strand; PAM type: NRG; PAM sequence: GGG
cttccagagataaactcctc

SEQ ID NO: 43248 - DNA, 20 bp, Artificial Sequence
  Description of Artificial Sequence: Synthetic oligonucleotide
  Target: ATXN1; (-) strand; PAM type: NRG; PAM sequence: CGG
gcttccagagataaactcct

SEQ ID NO: 43249 - DNA, 20 bp, Artificial Sequence
  Description of Artificial Sequence: Synthetic oligonucleotide
  Target: ATXN1; (-) strand; PAM type: NRG; PAM sequence: GAG
tgttgtggcaggtgcttcca

SEQ ID NO: 43250 - DNA, 20 bp, Artificial Sequence
  Description of Artificial Sequence: Synthetic oligonucleotide
  Target: ATXN1; (-) strand; PAM type: NRG; PAM sequence: CAG
tttgttgtggcaggtgcttc

SEQ ID NO: 43251 - DNA, 20 bp, Artificial Sequence
  Description of Artificial Sequence: Synthetic oligonucleotide
  Target: ATXN1; (-) strand; PAM type: NRG; PAM sequence: AGG
agaaatctttttgttgtggc

SEQ ID NO: 43252 - DNA, 20 bp, Artificial Sequence
  Description of Artificial Sequence: Synthetic oligonucleotide
  Target: ATXN1; (-) strand; PAM type: NRG; PAM sequence: CAG
aagaaatctttttgttgtgg

SEQ ID NO: 43253 - DNA, 20 bp, Artificial Sequence
  Description of Artificial Sequence: Synthetic oligonucleotide
  Target: ATXN1; (-) strand; PAM type: NRG; PAM sequence: TGG
tggaagaaatctttttgttg

SEQ ID NO: 43254 - DNA, 20 bp, Artificial Sequence
  Description of Artificial Sequence: Synthetic oligonucleotide
  Target: ATXN1; (-) strand; PAM type: NRG; PAM sequence: AAG
gtgcatggccccatgtttgg

SEQ ID NO: 43255 - DNA, 20 bp, Artificial Sequence
  Description of Artificial Sequence: Synthetic oligonucleotide
  Target: ATXN1; (-) strand; PAM type: NRG; PAM sequence: TGG
attgtgcatggccccatgtt

SEQ ID NO: 43256 - DNA, 20 bp, Artificial Sequence
  Description of Artificial Sequence: Synthetic oligonucleotide
  Target: ATXN1; (-) strand; PAM type: NRG; PAM sequence: TGG
ggcattgatataattgtgca

SEQ ID NO: 43257 - DNA, 20 bp, Artificial Sequence
  Description of Artificial Sequence: Synthetic oligonucleotide
  Target: ATXN1; (-) strand; PAM type: NRG; PAM sequence: TGG
tatgtggctctctggtaatt

SEQ ID NO: 43258 - DNA, 20 bp, Artificial Sequence
  Description of Artificial Sequence: Synthetic oligonucleotide
  Target: ATXN1; (-) strand; PAM type: NRG; PAM sequence: TGG
gatctgcatatgtggctctc

SEQ ID NO: 43259 - DNA, 20 bp, Artificial Sequence
  Description of Artificial Sequence: Synthetic oligonucleotide
  Target: ATXN1; (-) strand; PAM type: NRG; PAM sequence: TGG
aacagtgcgatctgcatatg

SEQ ID NO: 43260 - DNA, 20 bp, Artificial Sequence
  Description of Artificial Sequence: Synthetic oligonucleotide
  Target: ATXN1; (-) strand; PAM type: NRG; PAM sequence: CAG
ttccaataggaatgtttaaa

SEQ ID NO: 43261 - DNA, 20 bp, Artificial Sequence
  Description of Artificial Sequence: Synthetic oligonucleotide
  Target: ATXN1; (-) strand; PAM type: NRG; PAM sequence: AGG
tccaatttcccttttccaat

SEQ ID NO: 43262 - DNA, 20 bp, Artificial Sequence
  Description of Artificial Sequence: Synthetic oligonucleotide
  Target: ATXN1; (-) strand; PAM type: NRG; PAM sequence: TAG
ctccaatttcccttttccaa

SEQ ID NO: 43263 - DNA, 20 bp, Artificial Sequence
  Description of Artificial Sequence: Synthetic oligonucleotide
  Target: ATXN1; (-) strand; PAM type: NRG; PAM sequence: TAG
attatcaggcaaaccatggg

SEQ ID NO: 43264 - DNA, 20 bp, Artificial Sequence
  Description of Artificial Sequence: Synthetic oligonucleotide
  Target: ATXN1; (-) strand; PAM type: NRG; PAM sequence: GGG
gtgattatcaggcaaaccat

SEQ ID NO: 43265 - DNA, 20 bp, Artificial Sequence
  Description of Artificial Sequence: Synthetic oligonucleotide
  Target: ATXN1; (-) strand; PAM type: NRG; PAM sequence: TGG
agtgattatcaggcaaacca

SEQ ID NO: 43266 - DNA, 20 bp, Artificial Sequence
  Description of Artificial Sequence: Synthetic oligonucleotide
  Target: ATXN1; (-) strand; PAM type: NRG; PAM sequence: AGG
tattcagaacagtgattatc

SEQ ID NO: 43267 - DNA, 20 bp, Artificial Sequence
  Description of Artificial Sequence: Synthetic oligonucleotide
  Target: ATXN1; (-) strand; PAM type: NRG; PAM sequence: CAG
gtattcagaacagtgattat

SEQ ID NO: 43268 - DNA, 20 bp, Artificial Sequence
  Description of Artificial Sequence: Synthetic oligonucleotide
  Target: ATXN1; (-) strand; PAM type: NRG; PAM sequence: CAG
taagatgaatgtattcagaa

SEQ ID NO: 43269 - DNA, 20 bp, Artificial Sequence
  Description of Artificial Sequence: Synthetic oligonucleotide
  Target: ATXN1; (-) strand; PAM type: NRG; PAM sequence: CAG
cggcttaagatgaatgtatt

SEQ ID NO: 43270 - DNA, 20 bp, Artificial Sequence
  Description of Artificial Sequence: Synthetic oligonucleotide
  Target: ATXN1; (-) strand; PAM type: NRG; PAM sequence: AAG
atgtagctctaaagcggctt

SEQ ID NO: 43271 - DNA, 20 bp, Artificial Sequence
  Description of Artificial Sequence: Synthetic oligonucleotide
  Target: ATXN1; (-) strand; PAM type: NRG; PAM sequence: CGG
tagttaatgtagctctaaag

SEQ ID NO: 43272 - DNA, 20 bp, Artificial Sequence
  Description of Artificial Sequence: Synthetic oligonucleotide
  Target: ATXN1; (-) strand; PAM type: NRG; PAM sequence: AAG
agatagttaatgtagctcta

SEQ ID NO: 43273 - DNA, 20 bp, Artificial Sequence
  Description of Artificial Sequence: Synthetic oligonucleotide
  Target: ATXN1; (-) strand; PAM type: NRG; PAM sequence: TAG
tgatagagagatagttaatg

SEQ ID NO: 43274 - DNA, 20 bp, Artificial Sequence
  Description of Artificial Sequence: Synthetic oligonucleotide
  Target: ATXN1; (-) strand; PAM type: NRG; PAM sequence: TAG
tagaaattatgatagagaga

SEQ ID NO: 43275 - DNA, 20 bp, Artificial Sequence
  Description of Artificial Sequence: Synthetic oligonucleotide
  Target: ATXN1; (-) strand; PAM type: NRG; PAM sequence: GAG
aatttagaaattatgataga

SEQ ID NO: 43276 - DNA, 20 bp, Artificial Sequence
  Description of Artificial Sequence: Synthetic oligonucleotide
  Target: ATXN1; (-) strand; PAM type: NRG; PAM sequence: GAG
taaatttagaaattatgata

SEQ ID NO: 43277 - DNA, 20 bp, Artificial Sequence
  Description of Artificial Sequence: Synthetic oligonucleotide
  Target: ATXN1; (-) strand; PAM type: NRG; PAM sequence: TAG
gctaaatttagaaattatga

SEQ ID NO: 43278 - DNA, 20 bp, Artificial Sequence
  Description of Artificial Sequence: Synthetic oligonucleotide
  Target: ATXN1; (-) strand; PAM type: NRG; PAM sequence: TAG
ttataccactgggctaaatt

SEQ ID NO: 43279 - DNA, 20 bp, Artificial Sequence
  Description of Artificial Sequence: Synthetic oligonucleotide
  Target: ATXN1; (-) strand; PAM type: NRG; PAM sequence: GGG
tagcaaagccttataccact

SEQ ID NO: 43280 - DNA, 20 bp, Artificial Sequence
  Description of Artificial Sequence: Synthetic oligonucleotide
  Target: ATXN1; (-) strand; PAM type: NRG; PAM sequence: TGG
ctagcaaagccttataccac

SEQ ID NO: 43281 - DNA, 20 bp, Artificial Sequence
  Description of Artificial Sequence: Synthetic oligonucleotide
  Target: ATXN1; (-) strand; PAM type: NRG; PAM sequence: AAG
ggaccacacttcgactagca

SEQ ID NO: 43282 - DNA, 20 bp, Artificial Sequence
  Description of Artificial Sequence: Synthetic oligonucleotide
  Target: ATXN1; (-) strand; PAM type: NRG; PAM sequence: TAG
tcggaggaccacacttcgac

SEQ ID NO: 43283 - DNA, 20 bp, Artificial Sequence
  Description of Artificial Sequence: Synthetic oligonucleotide
  Target: ATXN1; (-) strand; PAM type: NRG; PAM sequence: AGG
atgctgatgtcacgggtcgg

SEQ ID NO: 43284 - DNA, 20 bp, Artificial Sequence
  Description of Artificial Sequence: Synthetic oligonucleotide
  Target: ATXN1; (-) strand; PAM type: NRG; PAM sequence: GAG
gatgctgatgtcacgggtcg

SEQ ID NO: 43285 - DNA, 20 bp, Artificial Sequence
  Description of Artificial Sequence: Synthetic oligonucleotide
  Target: ATXN1; (-) strand; PAM type: NRG; PAM sequence: CGG
aggatgctgatgtcacgggt

SEQ ID NO: 43286 - DNA, 20 bp, Artificial Sequence
  Description of Artificial Sequence: Synthetic oligonucleotide
  Target: ATXN1; (-) strand; PAM type: NRG; PAM sequence: GGG
gcagaggatgctgatgtcac

SEQ ID NO: 43287 - DNA, 20 bp, Artificial Sequence
  Description of Artificial Sequence: Synthetic oligonucleotide
  Target: ATXN1; (-) strand; PAM type: NRG; PAM sequence: CGG
tgcagaggatgctgatgtca

SEQ ID NO: 43288 - DNA, 20 bp, Artificial Sequence
  Description of Artificial Sequence: Synthetic oligonucleotide
  Target: ATXN1; (-) strand; PAM type: NRG; PAM sequence: AGG
catttccagcaaacttgcag

SEQ ID NO: 43289 - DNA, 20 bp, Artificial Sequence
  Description of Artificial Sequence: Synthetic oligonucleotide
  Target: ATXN1; (-) strand; PAM type: NRG; PAM sequence: GAG
gcatttccagcaaacttgca

SEQ ID NO: 43290 - DNA, 20 bp, Artificial Sequence
  Description of Artificial Sequence: Synthetic oligonucleotide
  Target: ATXN1; (-) strand; PAM type: NRG; PAM sequence: CAG
ctgcatttccagcaaacttg

SEQ ID NO: 43291 - DNA, 20 bp, Artificial Sequence
  Description of Artificial Sequence: Synthetic oligonucleotide
  Target: ATXN1; (-) strand; PAM type: NRG; PAM sequence: CAG
ggcctgagagtctgcatttc

SEQ ID NO: 43292 - DNA, 20 bp, Artificial Sequence
  Description of Artificial Sequence: Synthetic oligonucleotide
  Target: ATXN1; (-) strand; PAM type: NRG; PAM sequence: GAG
caggactgggtggggcctga

SEQ ID NO: 43293 - DNA, 20 bp, Artificial Sequence
  Description of Artificial Sequence: Synthetic oligonucleotide
  Target: ATXN1; (-) strand; PAM type: NRG; PAM sequence: GAG
tgcaggactgggtggggcct

SEQ ID NO: 43294 - DNA, 20 bp, Artificial Sequence
  Description of Artificial Sequence: Synthetic oligonucleotide
  Target: ATXN1; (-) strand; PAM type: NRG; PAM sequence: GGG
ttaaaatgcaggactgggtg

SEQ ID NO: 43295 - DNA, 20 bp, Artificial Sequence
  Description of Artificial Sequence: Synthetic oligonucleotide
  Target: ATXN1; (-) strand; PAM type: NRG; PAM sequence: GGG
gttaaaatgcaggactgggt

SEQ ID NO: 43296 - DNA, 20 bp, Artificial Sequence
  Description of Artificial Sequence: Synthetic oligonucleotide
  Target: ATXN1; (-) strand; PAM type: NRG; PAM sequence: TGG
tgttaaaatgcaggactggg

SEQ ID NO: 43297 - DNA, 20 bp, Artificial Sequence
  Description of Artificial Sequence: Synthetic oligonucleotide
  Target: ATXN1; (-) strand; PAM type: NRG; PAM sequence: GGG
tcttgttaaaatgcaggact

SEQ ID NO: 43298 - DNA, 20 bp, Artificial Sequence
  Description of Artificial Sequence: Synthetic oligonucleotide
  Target: ATXN1; (-) strand; PAM type: NRG; PAM sequence: TGG
atcttgttaaaatgcaggac

SEQ ID NO: 43299 - DNA, 20 bp, Artificial Sequence
  Description of Artificial Sequence: Synthetic oligonucleotide
  Target: ATXN1; (-) strand; PAM type: NRG; PAM sequence: AGG
tggatatcttgttaaaatgc

SEQ ID NO: 43300 - DNA, 20 bp, Artificial Sequence
  Description of Artificial Sequence: Synthetic oligonucleotide
  Target: ATXN1; (-) strand; PAM type: NRG; PAM sequence: CAG
ctggatatcttgttaaaatg

SEQ ID NO: 43301 - DNA, 20 bp, Artificial Sequence
  Description of Artificial Sequence: Synthetic oligonucleotide
  Target: ATXN1; (-) strand; PAM type: NRG; PAM sequence: TGG
ttactgtgcatagaatcatc

SEQ ID NO: 43302 - DNA, 20 bp, Artificial Sequence
  Description of Artificial Sequence: Synthetic oligonucleotide
  Target: ATXN1; (-) strand; PAM type: NRG; PAM sequence: TAG
ttctcaaaccttactgtgca

SEQ ID NO: 43303 - DNA, 20 bp, Artificial Sequence
  Description of Artificial Sequence: Synthetic oligonucleotide
  Target: ATXN1; (-) strand; PAM type: NRG; PAM sequence: GGG
atttaatcggatagctgcta

SEQ ID NO: 43304 - DNA, 20 bp, Artificial Sequence
  Description of Artificial Sequence: Synthetic oligonucleotide
  Target: ATXN1; (-) strand; PAM type: NRG; PAM sequence: AGG
aatttaatcggatagctgct

SEQ ID NO: 43305 - DNA, 20 bp, Artificial Sequence
  Description of Artificial Sequence: Synthetic oligonucleotide
  Target: ATXN1; (-) strand; PAM type: NRG; PAM sequence: TAG
aaatttaatcggatagctgc

SEQ ID NO: 43306 - DNA, 20 bp, Artificial Sequence
  Description of Artificial Sequence: Synthetic oligonucleotide
  Target: ATXN1; (-) strand; PAM type: NRG; PAM sequence: TAG
cagtagaaaatttaatcgga

SEQ ID NO: 43307 - DNA, 20 bp, Artificial Sequence
  Description of Artificial Sequence: Synthetic oligonucleotide
  Target: ATXN1; (-) strand; PAM type: NRG; PAM sequence: CGG
ttagcagtagaaaatttaat

SEQ ID NO: 43308 - DNA, 20 bp, Artificial Sequence
  Description of Artificial Sequence: Synthetic oligonucleotide
  Target: ATXN1; (-) strand; PAM type: NRG; PAM sequence: TAG
tttgcttaagagtttagcag

SEQ ID NO: 43309 - DNA, 20 bp, Artificial Sequence
  Description of Artificial Sequence: Synthetic oligonucleotide
  Target: ATXN1; (-) strand; PAM type: NRG; PAM sequence: CAG
taatttgcttaagagtttag

SEQ ID NO: 43310 - DNA, 20 bp, Artificial Sequence
  Description of Artificial Sequence: Synthetic oligonucleotide
  Target: ATXN1; (-) strand; PAM type: NRG; PAM sequence: TAG
gtttaatttgcttaagagtt

SEQ ID NO: 43311 - DNA, 20 bp, Artificial Sequence
  Description of Artificial Sequence: Synthetic oligonucleotide
  Target: ATXN1; (-) strand; PAM type: NRG; PAM sequence: GAG
gagatgtttaatttgcttaa

SEQ ID NO: 43312 - DNA, 20 bp, Artificial Sequence
  Description of Artificial Sequence: Synthetic oligonucleotide
  Target: ATXN1; (-) strand; PAM type: NRG; PAM sequence: AAG
tagagatgtttaatttgctt

SEQ ID NO: 43313 - DNA, 20 bp, Artificial Sequence
  Description of Artificial Sequence: Synthetic oligonucleotide
  Target: ATXN1; (-) strand; PAM type: NRG; PAM sequence: GAG
gctccattaggaagaggcta

SEQ ID NO: 43314 - DNA, 20 bp, Artificial Sequence
  Description of Artificial Sequence: Synthetic oligonucleotide
  Target: ATXN1; (-) strand; PAM type: NRG; PAM sequence: TAG
ctgctccattaggaagaggc

SEQ ID NO: 43315 - DNA, 20 bp, Artificial Sequence
  Description of Artificial Sequence: Synthetic oligonucleotide
  Target: ATXN1; (-) strand; PAM type: NRG; PAM sequence: AGG
gtgcctgctccattaggaag

SEQ ID NO: 43316 - DNA, 20 bp, Artificial Sequence
  Description of Artificial Sequence: Synthetic oligonucleotide
  Target: ATXN1; (-) strand; PAM type: NRG; PAM sequence: GAG
agtgcctgctccattaggaa

SEQ ID NO: 43317 - DNA, 20 bp, Artificial Sequence
  Description of Artificial Sequence: Synthetic oligonucleotide
  Target: ATXN1; (-) strand; PAM type: NRG; PAM sequence: AAG
ccagtgcctgctccattagg

SEQ ID NO: 43318 - DNA, 20 bp, Artificial Sequence
  Description of Artificial Sequence: Synthetic oligonucleotide
  Target: ATXN1; (-) strand; PAM type: NRG; PAM sequence: AGG
ttcccagtgcctgctccatt

SEQ ID NO: 43319 - DNA, 20 bp, Artificial Sequence
  Description of Artificial Sequence: Synthetic oligonucleotide
  Target: ATXN1; (-) strand; PAM type: NRG; PAM sequence: TAG
tttcccagtgcctgctccat

SEQ ID NO: 43320 - DNA, 20 bp, Artificial Sequence
  Description of Artificial Sequence: Synthetic oligonucleotide
  Target: ATXN1; (-) strand; PAM type: NRG; PAM sequence: CAG
caacacctagtttggtttcc

SEQ ID NO: 43321 - DNA, 20 bp, Artificial Sequence
  Description of Artificial Sequence: Synthetic oligonucleotide
  Target: ATXN1; (-) strand; PAM type: NRG; PAM sequence: TGG
tttacgtacaacacctagtt

SEQ ID NO: 43322 - DNA, 20 bp, Artificial Sequence
  Description of Artificial Sequence: Synthetic oligonucleotide
  Target: ATXN1; (-) strand; PAM type: NRG; PAM sequence: TAG
ctgtgtttacgtacaacacc

SEQ ID NO: 43323 - DNA, 20 bp, Artificial Sequence
  Description of Artificial Sequence: Synthetic oligonucleotide
  Target: ATXN1; (-) strand; PAM type: NRG; PAM sequence: AGG
atattagatgtttatctccg

SEQ ID NO: 43324 - DNA, 20 bp, Artificial Sequence
  Description of Artificial Sequence: Synthetic oligonucleotide
  Target: ATXN1; (-) strand; PAM type: NRG; PAM sequence: GAG
aatattagatgtttatctcc

SEQ ID NO: 43325 - DNA, 20 bp, Artificial Sequence
  Description of Artificial Sequence: Synthetic oligonucleotide
  Target: ATXN1; (-) strand; PAM type: NRG; PAM sequence: TAG
gtggagcatcacctaaatat

SEQ ID NO: 43326 - DNA, 20 bp, Artificial Sequence
  Description of Artificial Sequence: Synthetic oligonucleotide
  Target: ATXN1; (-) strand; PAM type: NRG; PAM sequence: GAG
tgaccccagaggaagcagtg

SEQ ID NO: 43327 - DNA, 20 bp, Artificial Sequence
  Description of Artificial Sequence: Synthetic oligonucleotide
  Target: ATXN1; (-) strand; PAM type: NRG; PAM sequence: TGG
gatgaccccagaggaagcag

SEQ ID NO: 43328 - DNA, 20 bp, Artificial Sequence
  Description of Artificial Sequence: Synthetic oligonucleotide
  Target: ATXN1; (-) strand; PAM type: NRG; PAM sequence: CAG
ttagatgaccccagaggaag

SEQ ID NO: 43329 - DNA, 20 bp, Artificial Sequence
  Description of Artificial Sequence: Synthetic oligonucleotide
  Target: ATXN1; (-) strand; PAM type: NRG; PAM sequence: AAG
ggtttagatgaccccagagg

SEQ ID NO: 43330 - DNA, 20 bp, Artificial Sequence
  Description of Artificial Sequence: Synthetic oligonucleotide
  Target: ATXN1; (-) strand; PAM type: NRG; PAM sequence: AGG
ttaggtttagatgaccccag

SEQ ID NO: 43331 - DNA, 20 bp, Artificial Sequence
  Description of Artificial Sequence: Synthetic oligonucleotide
  Target: ATXN1; (-) strand; PAM type: NRG; PAM sequence: GAG
attaggtttagatgacccca

SEQ ID NO: 43332 - DNA, 20 bp, Artificial Sequence
  Description of Artificial Sequence: Synthetic oligonucleotide
  Target: ATXN1; (-) strand; PAM type: NRG; PAM sequence: CAG
gtattaggtttagatgaccc

SEQ ID NO: 43333 - DNA, 20 bp, Artificial Sequence
  Description of Artificial Sequence: Synthetic oligonucleotide
  Target: ATXN1; (-) strand; PAM type: NRG; PAM sequence: TAG
atttgcagccgtattaggtt

SEQ ID NO: 43334 - DNA, 20 bp, Artificial Sequence
  Description of Artificial Sequence: Synthetic oligonucleotide
  Target: ATXN1; (-) strand; PAM type: NRG; PAM sequence: AGG
ttgttatttgcagccgtatt

SEQ ID NO: 43335 - DNA, 20 bp, Artificial Sequence
  Description of Artificial Sequence: Synthetic oligonucleotide
  Target: ATXN1; (-) strand; PAM type: NRG; PAM sequence: TAG
tttgttatttgcagccgtat

SEQ ID NO: 43336 - DNA, 20 bp, Artificial Sequence
  Description of Artificial Sequence: Synthetic oligonucleotide
  Target: ATXN1; (-) strand; PAM type: NRG; PAM sequence: CAG
aaagcagcatttgttatttg

SEQ ID NO: 43337 - DNA, 20 bp, Artificial Sequence
  Description of Artificial Sequence: Synthetic oligonucleotide
  Target: ATXN1; (-) strand; PAM type: NRG; PAM sequence: CAG
gtaaagaaccagaagaaaag

SEQ ID NO: 43338 - DNA, 20 bp, Artificial Sequence
  Description of Artificial Sequence: Synthetic oligonucleotide
  Target: ATXN1; (-) strand; PAM type: NRG; PAM sequence: AAG
tgtgtaaagaaccagaagaa

SEQ ID NO: 43339 - DNA, 20 bp, Artificial Sequence
  Description of Artificial Sequence: Synthetic oligonucleotide
  Target: ATXN1; (-) strand; PAM type: NRG; PAM sequence: AAG
gcagttgtgtaaagaaccag

SEQ ID NO: 43340 - DNA, 20 bp, Artificial Sequence
  Description of Artificial Sequence: Synthetic oligonucleotide
  Target: ATXN1; (-) strand; PAM type: NRG; PAM sequence: CAG
tctgcagttgtgtaaagaac

SEQ ID NO: 43341 - DNA, 20 bp, Artificial Sequence
  Description of Artificial Sequence: Synthetic oligonucleotide
  Target: ATXN1; (-) strand; PAM type: NRG; PAM sequence: AAG
tatttctctgcagttgtgta

SEQ ID NO: 43342 - DNA, 20 bp, Artificial Sequence
  Description of Artificial Sequence: Synthetic oligonucleotide
  Target: ATXN1; (-) strand; PAM type: NRG; PAM sequence: CAG
ttttaaagtatatttctctg

SEQ ID NO: 43343 - DNA, 20 bp, Artificial Sequence
  Description of Artificial Sequence: Synthetic oligonucleotide
  Target: ATXN1; (-) strand; PAM type: NRG; PAM sequence: AAG
ttatgataatagccttttta

SEQ ID NO: 43344 - DNA, 20 bp, Artificial Sequence
  Description of Artificial Sequence: Synthetic oligonucleotide
  Target: ATXN1; (-) strand; PAM type: NRG; PAM sequence: TAG
gtgtataaaatttatgataa

SEQ ID NO: 43345 - DNA, 20 bp, Artificial Sequence
  Description of Artificial Sequence: Synthetic oligonucleotide
  Target: ATXN1; (-) strand; PAM type: NRG; PAM sequence: GAG
ttttcttcctgggaatgatt

SEQ ID NO: 43346 - DNA, 20 bp, Artificial Sequence
  Description of Artificial Sequence: Synthetic oligonucleotide
  Target: ATXN1; (-) strand; PAM type: NRG; PAM sequence: GGG
taaatttcatttttcttcct

SEQ ID NO: 43347 - DNA, 20 bp, Artificial Sequence
  Description of Artificial Sequence: Synthetic oligonucleotide
  Target: ATXN1; (-) strand; PAM type: NRG; PAM sequence: TGG
ttaaatttcatttttcttcc

SEQ ID NO: 43348 - DNA, 20 bp, Artificial Sequence
  Description of Artificial Sequence: Synthetic oligonucleotide
  Target: ATXN1; (-) strand; PAM type: NRG; PAM sequence: GAG
atagcaaagaaagaagtgtg

SEQ ID NO: 43349 - DNA, 20 bp, Artificial Sequence
  Description of Artificial Sequence: Synthetic oligonucleotide
  Target: ATXN1; (-) strand; PAM type: NRG; PAM sequence: TGG
ttatagcaaagaaagaagtg

SEQ ID NO: 43350 - DNA, 20 bp, Artificial Sequence
  Description of Artificial Sequence: Synthetic oligonucleotide
  Target: ATXN1; (-) strand; PAM type: NRG; PAM sequence: AAG
tgaaattatagcaaagaaag

SEQ ID NO: 43351 - DNA, 20 bp, Artificial Sequence
  Description of Artificial Sequence: Synthetic oligonucleotide
  Target: ATXN1; (-) strand; PAM type: NRG; PAM sequence: AAG
aaatgaaattatagcaaaga

SEQ ID NO: 43352 - DNA, 20 bp, Artificial Sequence
  Description of Artificial Sequence: Synthetic oligonucleotide
  Target: ATXN1; (-) strand; PAM type: NRG; PAM sequence: AAG
ctcgaaatgaaattatagca

SEQ ID NO: 43353 - DNA, 20 bp, Artificial Sequence
  Description of Artificial Sequence: Synthetic oligonucleotide
  Target: ATXN1; (-) strand; PAM type: NRG; PAM sequence: TAG
aatttctcgaaatgaaatta

SEQ ID NO: 43354 - DNA, 20 bp, Artificial Sequence
  Description of Artificial Sequence: Synthetic oligonucleotide
  Target: ATXN1; (-) strand; PAM type: NRG; PAM sequence: TAG
gcagtctgaatccatggtaa

SEQ ID NO: 43355 - DNA, 20 bp, Artificial Sequence
  Description of Artificial Sequence: Synthetic oligonucleotide
  Target: ATXN1; (-) strand; PAM type: NRG; PAM sequence: TGG
tcccaagcagtctgaatcca

SEQ ID NO: 43356 - DNA, 20 bp, Artificial Sequence
  Description of Artificial Sequence: Synthetic oligonucleotide
  Target: ATXN1; (-) strand; PAM type: NRG; PAM sequence: CAG
ttttcctatcacttcccaag

SEQ ID NO: 43357 - DNA, 20 bp, Artificial Sequence
  Description of Artificial Sequence: Synthetic oligonucleotide
  Target: ATXN1; (-) strand; PAM type: NRG; PAM sequence: AAG
tcattttcctatcacttccc

SEQ ID NO: 43358 - DNA, 20 bp, Artificial Sequence
  Description of Artificial Sequence: Synthetic oligonucleotide
  Target: ATXN1; (-) strand; PAM type: NRG; PAM sequence: AAG
tccccacatccctagcacag

SEQ ID NO: 43359 - DNA, 20 bp, Artificial Sequence
  Description of Artificial Sequence: Synthetic oligonucleotide
  Target: ATXN1; (-) strand; PAM type: NRG; PAM sequence: CAG
tattccccacatccctagca

SEQ ID NO: 43360 - DNA, 20 bp, Artificial Sequence
  Description of Artificial Sequence: Synthetic oligonucleotide
  Target: ATXN1; (-) strand; PAM type: NRG; PAM sequence: TAG
gcatatattccccacatccc

SEQ ID NO: 43361 - DNA, 20 bp, Artificial Sequence
  Description of Artificial Sequence: Synthetic oligonucleotide
  Target: ATXN1; (-) strand; PAM type: NRG; PAM sequence: GGG
ttactggacttgcagtcagt

SEQ ID NO: 43362 - DNA, 20 bp, Artificial Sequence
  Description of Artificial Sequence: Synthetic oligonucleotide
  Target: ATXN1; (-) strand; PAM type: NRG; PAM sequence: TGG
tttactggacttgcagtcag

SEQ ID NO: 43363 - DNA, 20 bp, Artificial Sequence
  Description of Artificial Sequence: Synthetic oligonucleotide
  Target: ATXN1; (-) strand; PAM type: NRG; PAM sequence: CAG
ctatttactggacttgcagt

SEQ ID NO: 43364 - DNA, 20 bp, Artificial Sequence
  Description of Artificial Sequence: Synthetic oligonucleotide
  Target: ATXN1; (-) strand; PAM type: NRG; PAM sequence: CAG
gctgctatttactggacttg

SEQ ID NO: 43365 - DNA, 20 bp, Artificial Sequence
  Description of Artificial Sequence: Synthetic oligonucleotide
  Target: ATXN1; (-) strand; PAM type: NRG; PAM sequence: TGG
agcagttggctgctatttac

SEQ ID NO: 43366 - DNA, 20 bp, Artificial Sequence
  Description of Artificial Sequence: Synthetic oligonucleotide
  Target: ATXN1; (-) strand; PAM type: NRG; PAM sequence: TGG
catcttccattctgagcagt

SEQ ID NO: 43367 - DNA, 20 bp, Artificial Sequence
  Description of Artificial Sequence: Synthetic oligonucleotide
  Target: ATXN1; (-) strand; PAM type: NRG; PAM sequence: CAG
agagcatcttccattctgag

SEQ ID NO: 43368 - DNA, 20 bp, Artificial Sequence
  Description of Artificial Sequence: Synthetic oligonucleotide
  Target: ATXN1; (-) strand; PAM type: NRG; PAM sequence: GAG
ctaagagcatcttccattct

SEQ ID NO: 43369 - DNA, 20 bp, Artificial Sequence
  Description of Artificial Sequence: Synthetic oligonucleotide
  Target: ATXN1; (-) strand; PAM type: NRG; PAM sequence: GAG
gtttatatatcaaattctaa

SEQ ID NO: 43370 - DNA, 20 bp, Artificial Sequence
  Description of Artificial Sequence: Synthetic oligonucleotide
  Target: ATXN1; (-) strand; PAM type: NRG; PAM sequence: AAG
gagtttatatatcaaattct

SEQ ID NO: 43371 - DNA, 20 bp, Artificial Sequence
  Description of Artificial Sequence: Synthetic oligonucleotide
  Target: ATXN1; (-) strand; PAM type: NRG; PAM sequence: GAG
ggtttaagatgtatttttag

SEQ ID NO: 43372 - DNA, 20 bp, Artificial Sequence
  Description of Artificial Sequence: Synthetic oligonucleotide
  Target: ATXN1; (-) strand; PAM type: NRG; PAM sequence: AGG
taggtttaagatgtattttt

SEQ ID NO: 43373 - DNA, 20 bp, Artificial Sequence
  Description of Artificial Sequence: Synthetic oligonucleotide
  Target: ATXN1; (-) strand; PAM type: NRG; PAM sequence: TAG
ctaggtttaagatgtatttt

SEQ ID NO: 43374 - DNA, 20 bp, Artificial Sequence
  Description of Artificial Sequence: Synthetic oligonucleotide
  Target: ATXN1; (-) strand; PAM type: NRG; PAM sequence: AAG
cattttcttgccctaggttt

SEQ ID NO: 43375 - DNA, 20 bp, Artificial Sequence
  Description of Artificial Sequence: Synthetic oligonucleotide
  Target: ATXN1; (-) strand; PAM type: NRG; PAM sequence: AGG
gcaacccattttcttgccct

SEQ ID NO: 43376 - DNA, 20 bp, Artificial Sequence
  Description of Artificial Sequence: Synthetic oligonucleotide
  Target: ATXN1; (-) strand; PAM type: NRG; PAM sequence: TAG
agcaacccattttcttgccc

SEQ ID NO: 43377 - DNA, 20 bp, Artificial Sequence
  Description of Artificial Sequence: Synthetic oligonucleotide
  Target: ATXN1; (-) strand; PAM type: NRG; PAM sequence: AAG
caggattgggggtgtaggaa

SEQ ID NO: 43378 - DNA, 20 bp, Artificial Sequence
  Description of Artificial Sequence: Synthetic oligonucleotide
  Target: ATXN1; (-) strand; PAM type: NRG; PAM sequence: AGG
aagcacaggattgggggtgt

SEQ ID NO: 43379 - DNA, 20 bp, Artificial Sequence
  Description of Artificial Sequence: Synthetic oligonucleotide
  Target: ATXN1; (-) strand; PAM type: NRG; PAM sequence: TAG
gaagcacaggattgggggtg

SEQ ID NO: 43380 - DNA, 20 bp, Artificial Sequence
  Description of Artificial Sequence: Synthetic oligonucleotide
  Target: ATXN1; (-) strand; PAM type: NRG; PAM sequence: GGG
actgagaagcacaggattgg

SEQ ID NO: 43381 - DNA, 20 bp, Artificial Sequence
  Description of Artificial Sequence: Synthetic oligonucleotide
  Target: ATXN1; (-) strand; PAM type: NRG; PAM sequence: GGG
aactgagaagcacaggattg

SEQ ID NO: 43382 - DNA, 20 bp, Artificial Sequence
  Description of Artificial Sequence: Synthetic oligonucleotide
  Target: ATXN1; (-) strand; PAM type: NRG; PAM sequence: GGG
aaactgagaagcacaggatt

SEQ ID NO: 43383 - DNA, 20 bp, Artificial Sequence
  Description of Artificial Sequence: Synthetic oligonucleotide
  Target: ATXN1; (-) strand; PAM type: NRG; PAM sequence: TGG
caaactgagaagcacaggat

SEQ ID NO: 43384 - DNA, 20 bp, Artificial Sequence
  Description of Artificial Sequence: Synthetic oligonucleotide
  Target: ATXN1; (-) strand; PAM type: NRG; PAM sequence: AGG
tcattcaaactgagaagcac

SEQ ID NO: 43385 - DNA, 20 bp, Artificial Sequence
  Description of Artificial Sequence: Synthetic oligonucleotide
  Target: ATXN1; (-) strand; PAM type: NRG; PAM sequence: CAG
ttcattcaaactgagaagca

SEQ ID NO: 43386 - DNA, 20 bp, Artificial Sequence
  Description of Artificial Sequence: Synthetic oligonucleotide
  Target: ATXN1; (-) strand; PAM type: NRG; PAM sequence: AAG
atgggttcattcaaactgag

SEQ ID NO: 43387 - DNA, 20 bp, Artificial Sequence
  Description of Artificial Sequence: Synthetic oligonucleotide
  Target: ATXN1; (-) strand; PAM type: NRG; PAM sequence: GAG
gccatgggttcattcaaact

SEQ ID NO: 43388 - DNA, 20 bp, Artificial Sequence
  Description of Artificial Sequence: Synthetic oligonucleotide
  Target: ATXN1; (-) strand; PAM type: NRG; PAM sequence: GGG
tatacaggccaggcagccat

SEQ ID NO: 43389 - DNA, 20 bp, Artificial Sequence
  Description of Artificial Sequence: Synthetic oligonucleotide
  Target: ATXN1; (-) strand; PAM type: NRG; PAM sequence: TGG
atatacaggccaggcagcca

SEQ ID NO: 43390 - DNA, 20 bp, Artificial Sequence
  Description of Artificial Sequence: Synthetic oligonucleotide
  Target: ATXN1; (-) strand; PAM type: NRG; PAM sequence: CAG
ccatagatatacaggccagg

SEQ ID NO: 43391 - DNA, 20 bp, Artificial Sequence
  Description of Artificial Sequence: Synthetic oligonucleotide
  Target: ATXN1; (-) strand; PAM type: NRG; PAM sequence: AGG
tgtccatagatatacaggcc

SEQ ID NO: 43392 - DNA, 20 bp, Artificial Sequence
  Description of Artificial Sequence: Synthetic oligonucleotide
  Target: ATXN1; (-) strand; PAM type: NRG; PAM sequence: CAG
ttgtccatagatatacaggc

SEQ ID NO: 43393 - DNA, 20 bp, Artificial Sequence
  Description of Artificial Sequence: Synthetic oligonucleotide
  Target: ATXN1; (-) strand; PAM type: NRG; PAM sequence: AGG
ctgtttgtccatagatatac

SEQ ID NO: 43394 - DNA, 20 bp, Artificial Sequence
  Description of Artificial Sequence: Synthetic oligonucleotide
  Target: ATXN1; (-) strand; PAM type: NRG; PAM sequence: CAG
cctgtttgtccatagatata

SEQ ID NO: 43395 - DNA, 20 bp, Artificial Sequence
  Description of Artificial Sequence: Synthetic oligonucleotide
  Target: ATXN1; (-) strand; PAM type: NRG; PAM sequence: TAG
aaccgtgccctgtttgtcca

SEQ ID NO: 43396 - DNA, 20 bp, Artificial Sequence
  Description of Artificial Sequence: Synthetic oligonucleotide
  Target: ATXN1; (-) strand; PAM type: NRG; PAM sequence: AAG
cctgctcttcctcttcttta

SEQ ID NO: 43397 - DNA, 20 bp, Artificial Sequence
  Description of Artificial Sequence: Synthetic oligonucleotide
  Target: ATXN1; (-) strand; PAM type: NRG; PAM sequence: CAG
cagtcctggcacaagctcat

SEQ ID NO: 43398 - DNA, 20 bp, Artificial Sequence
  Description of Artificial Sequence: Synthetic oligonucleotide
  Target: ATXN1; (-) strand; PAM type: NRG; PAM sequence: AAG
agtttttccagtcctggcac

SEQ ID NO: 43399 - DNA, 20 bp, Artificial Sequence
  Description of Artificial Sequence: Synthetic oligonucleotide
  Target: ATXN1; (-) strand; PAM type: NRG; PAM sequence: TGG
atacgtagtttttccagtcc

SEQ ID NO: 43400 - DNA, 20 bp, Artificial Sequence
  Description of Artificial Sequence: Synthetic oligonucleotide
  Target: ATXN1; (-) strand; PAM type: NRG; PAM sequence: CAG
gtttgcatacgtagtttttc

SEQ ID NO: 43401 - DNA, 20 bp, Artificial Sequence
  Description of Artificial Sequence: Synthetic oligonucleotide
  Target: ATXN1; (-) strand; PAM type: NRG; PAM sequence: TAG
ctcttcagtgtttgcatacg

SEQ ID NO: 43402 - DNA, 20 bp, Artificial Sequence
  Description of Artificial Sequence: Synthetic oligonucleotide
  Target: ATXN1; (-) strand; PAM type: NRG; PAM sequence: CAG
cccaggtattctgccctctt

SEQ ID NO: 43403 - DNA, 20 bp, Artificial Sequence
  Description of Artificial Sequence: Synthetic oligonucleotide
  Target: ATXN1; (-) strand; PAM type: NRG; PAM sequence: AGG
taacctctgtcctcacaccc

SEQ ID NO: 43404 - DNA, 20 bp, Artificial Sequence
  Description of Artificial Sequence: Synthetic oligonucleotide
  Target: ATXN1; (-) strand; PAM type: NRG; PAM sequence: CAG
gtaacctctgtcctcacacc

SEQ ID NO: 43405 - DNA, 20 bp, Artificial Sequence
  Description of Artificial Sequence: Synthetic oligonucleotide
  Target: ATXN1; (-) strand; PAM type: NRG; PAM sequence: AAG
tgagaatccttgacatgccc

SEQ ID NO: 43406 - DNA, 20 bp, Artificial Sequence
  Description of Artificial Sequence: Synthetic oligonucleotide
  Target: ATXN1; (-) strand; PAM type: NRG; PAM sequence: GAG
gattggtgagtcagcacttt

SEQ ID NO: 43407 - DNA, 20 bp, Artificial Sequence
  Description of Artificial Sequence: Synthetic oligonucleotide
  Target: ATXN1; (-) strand; PAM type: NRG; PAM sequence: CAG
ctggaaggagattggtgagt

SEQ ID NO: 43408 - DNA, 20 bp, Artificial Sequence
  Description of Artificial Sequence: Synthetic oligonucleotide
  Target: ATXN1; (-) strand; PAM type: NRG; PAM sequence: GAG
aaagctggaaggagattggt

SEQ ID NO: 43409 - DNA, 20 bp, Artificial Sequence
  Description of Artificial Sequence: Synthetic oligonucleotide
  Target: ATXN1; (-) strand; PAM type: NRG; PAM sequence: TGG
taataaagctggaaggagat

SEQ ID NO: 43410 - DNA, 20 bp, Artificial Sequence
  Description of Artificial Sequence: Synthetic oligonucleotide
  Target: ATXN1; (-) strand; PAM type: NRG; PAM sequence: GAG
tgatgtaataaagctggaag

SEQ ID NO: 43411 - DNA, 20 bp, Artificial Sequence
  Description of Artificial Sequence: Synthetic oligonucleotide
  Target: ATXN1; (-) strand; PAM type: NRG; PAM sequence: AGG
agtgatgtaataaagctgga

SEQ ID NO: 43412 - DNA, 20 bp, Artificial Sequence
  Description of Artificial Sequence: Synthetic oligonucleotide
  Target: ATXN1; (-) strand; PAM type: NRG; PAM sequence: AAG
tagtgatgtaataaagctgg

SEQ ID NO: 43413 - DNA, 20 bp, Artificial Sequence
  Description of Artificial Sequence: Synthetic oligonucleotide
  Target: ATXN1; (-) strand; PAM type: NRG; PAM sequence: TGG
gtttagtgatgtaataaagc

SEQ ID NO: 43414 - DNA, 20 bp, Artificial Sequence
  Description of Artificial Sequence: Synthetic oligonucleotide
  Target: ATXN1; (-) strand; PAM type: NRG; PAM sequence: AAG
tccagtttagtgatgtaata

SEQ ID NO: 43415 - DNA, 20 bp, Artificial Sequence
  Description of Artificial Sequence: Synthetic oligonucleotide
  Target: ATXN1; (-) strand; PAM type: NRG; PAM sequence: TAG
accacacaggccttccagtt

SEQ ID NO: 43416 - DNA, 20 bp, Artificial Sequence
  Description of Artificial Sequence: Synthetic oligonucleotide
  Target: ATXN1; (-) strand; PAM type: NRG; PAM sequence: CAG
agtgcaccacacaggccttc

SEQ ID NO: 43417 - DNA, 20 bp, Artificial Sequence
  Description of Artificial Sequence: Synthetic oligonucleotide
  Target: ATXN1; (-) strand; PAM type: NRG; PAM sequence: AGG
tttctgccagtgcaccacac

SEQ ID NO: 43418 - DNA, 20 bp, Artificial Sequence
  Description of Artificial Sequence: Synthetic oligonucleotide
  Target: ATXN1; (-) strand; PAM type: NRG; PAM sequence: CAG
ctttctgccagtgcaccaca

SEQ ID NO: 43419 - DNA, 20 bp, Artificial Sequence
  Description of Artificial Sequence: Synthetic oligonucleotide
  Target: ATXN1; (-) strand; PAM type: NRG; PAM sequence: CAG
caaaatgaagtgctttctgc

SEQ ID NO: 43420 - DNA, 20 bp, Artificial Sequence
  Description of Artificial Sequence: Synthetic oligonucleotide
  Target: ATXN1; (-) strand; PAM type: NRG; PAM sequence: AAG
tttaatgcttggccaaaatg

SEQ ID NO: 43421 - DNA, 20 bp, Artificial Sequence
  Description of Artificial Sequence: Synthetic oligonucleotide
  Target: ATXN1; (-) strand; PAM type: NRG; PAM sequence: TGG
ttggacctgtttttaatgct

SEQ ID NO: 43422 - DNA, 20 bp, Artificial Sequence
  Description of Artificial Sequence: Synthetic oligonucleotide
  Target: ATXN1; (-) strand; PAM type: NRG; PAM sequence: TGG
tactccaagcatgtcgggtt

SEQ ID NO: 43423 - DNA, 20 bp, Artificial Sequence
  Description of Artificial Sequence: Synthetic oligonucleotide
  Target: ATXN1; (-) strand; PAM type: NRG; PAM sequence: GGG
ctagatactccaagcatgtc

SEQ ID NO: 43424 - DNA, 20 bp, Artificial Sequence
  Description of Artificial Sequence: Synthetic oligonucleotide
  Target: ATXN1; (-) strand; PAM type: NRG; PAM sequence: CGG
tctagatactccaagcatgt

SEQ ID NO: 43425 - DNA, 20 bp, Artificial Sequence
  Description of Artificial Sequence: Synthetic oligonucleotide
  Target: ATXN1; (-) strand; PAM type: NRG; PAM sequence: AAG
ttctccattctagatactcc

SEQ ID NO: 43426 - DNA, 20 bp, Artificial Sequence
  Description of Artificial Sequence: Synthetic oligonucleotide
  Target: ATXN1; (-) strand; PAM type: NRG; PAM sequence: TAG
caatccacctttctccattc

SEQ ID NO: 43427 - DNA, 20 bp, Artificial Sequence
  Description of Artificial Sequence: Synthetic oligonucleotide
  Target: ATXN1; (-) strand; PAM type: NRG; PAM sequence: TAG
accataaaggcatctaatta

SEQ ID NO: 43428 - DNA, 20 bp, Artificial Sequence
  Description of Artificial Sequence: Synthetic oligonucleotide
  Target: ATXN1; (-) strand; PAM type: NRG; PAM sequence: AGG
gcctgttcagtcaaccataa

SEQ ID NO: 43429 - DNA, 20 bp, Artificial Sequence
  Description of Artificial Sequence: Synthetic oligonucleotide
  Target: ATXN1; (-) strand; PAM type: NRG; PAM sequence: AAG
tgcctgttcagtcaaccata

SEQ ID NO: 43430 - DNA, 20 bp, Artificial Sequence
  Description of Artificial Sequence: Synthetic oligonucleotide
  Target: ATXN1; (-) strand; PAM type: NRG; PAM sequence: CAG
actttgggggcatgcctgtt

SEQ ID NO: 43431 - DNA, 20 bp, Artificial Sequence
  Description of Artificial Sequence: Synthetic oligonucleotide
  Target: ATXN1; (-) strand; PAM type: NRG; PAM sequence: GGG
gaatgtgtgatccactttgg

SEQ ID NO: 43432 - DNA, 20 bp, Artificial Sequence
  Description of Artificial Sequence: Synthetic oligonucleotide
  Target: ATXN1; (-) strand; PAM type: NRG; PAM sequence: GGG
tgaatgtgtgatccactttg

SEQ ID NO: 43433 - DNA, 20 bp, Artificial Sequence
  Description of Artificial Sequence: Synthetic oligonucleotide
  Target: ATXN1; (-) strand; PAM type: NRG; PAM sequence: GGG
atgaatgtgtgatccacttt

SEQ ID NO: 43434 - DNA, 20 bp, Artificial Sequence
  Description of Artificial Sequence: Synthetic oligonucleotide
  Target: ATXN1; (-) strand; PAM type: NRG; PAM sequence: TGG
aatgaatgtgtgatccactt

SEQ ID NO: 43435 - DNA, 20 bp, Artificial Sequence
  Description of Artificial Sequence: Synthetic oligonucleotide
  Target: ATXN1; (-) strand; PAM type: NRG; PAM sequence: GAG
atacatactagaaacggaat

SEQ ID NO: 43436 - DNA, 20 bp, Artificial Sequence
  Description of Artificial Sequence: Synthetic oligonucleotide
  Target: ATXN1; (-) strand; PAM type: NRG; PAM sequence: CGG
cccgtcatacatactagaaa

SEQ ID NO: 43437 - DNA, 20 bp, Artificial Sequence
  Description of Artificial Sequence: Synthetic oligonucleotide
  Target: ATXN1; (-) strand; PAM type: NRG; PAM sequence: TAG
gaggtccccgtcatacatac

SEQ ID NO: 43438 - DNA, 20 bp, Artificial Sequence
  Description of Artificial Sequence: Synthetic oligonucleotide
  Target: ATXN1; (-) strand; PAM type: NRG; PAM sequence: AGG
acactgacattgaacaattg

SEQ ID NO: 43439 - DNA, 20 bp, Artificial Sequence
  Description of Artificial Sequence: Synthetic oligonucleotide
  Target: ATXN1; (-) strand; PAM type: NRG; PAM sequence: GAG
cacactgacattgaacaatt

SEQ ID NO: 43440 - DNA, 20 bp, Artificial Sequence
  Description of Artificial Sequence: Synthetic oligonucleotide
  Target: ATXN1; (-) strand; PAM type: NRG; PAM sequence: TGG
cagaactaaaaatagagttc

SEQ ID NO: 43441 - DNA, 20 bp, Artificial Sequence
  Description of Artificial Sequence: Synthetic oligonucleotide
  Target: ATXN1; (-) strand; PAM type: NRG; PAM sequence: GAG
atagaacagaactaaaaata

SEQ ID NO: 43442 - DNA, 20 bp, Artificial Sequence
  Description of Artificial Sequence: Synthetic oligonucleotide
  Target: ATXN1; (-) strand; PAM type: NRG; PAM sequence: TAG
gaatagaacagaactaaaaa

SEQ ID NO: 43443 - DNA, 20 bp, Artificial Sequence
  Description of Artificial Sequence: Synthetic oligonucleotide
  Target: ATXN1; (-) strand; PAM type: NRG; PAM sequence: CAG
tgtattagtattgaatagaa

SEQ ID NO: 43444 - DNA, 20 bp, Artificial Sequence
  Description of Artificial Sequence: Synthetic oligonucleotide
  Target: ATXN1; (-) strand; PAM type: NRG; PAM sequence: TAG
aacactgtattagtattgaa

SEQ ID NO: 43445 - DNA, 20 bp, Artificial Sequence
  Description of Artificial Sequence: Synthetic oligonucleotide
  Target: ATXN1; (-) strand; PAM type: NRG; PAM sequence: TAG
tgataaccaaaacactgtat

SEQ ID NO: 43446 - DNA, 20 bp, Artificial Sequence
  Description of Artificial Sequence: Synthetic oligonucleotide
  Target: ATXN1; (-) strand; PAM type: NRG; PAM sequence: TAG
ttcgcaacatatatcccttc

SEQ ID NO: 43447 - DNA, 20 bp, Artificial Sequence
  Description of Artificial Sequence: Synthetic oligonucleotide
  Target: ATXN1; (-) strand; PAM type: NRG; PAM sequence: AAG
accatcacttccggcttctt

SEQ ID NO: 43448 - DNA, 20 bp, Artificial Sequence
  Description of Artificial Sequence: Synthetic oligonucleotide
  Target: ATXN1; (-) strand; PAM type: NRG; PAM sequence: CGG
tggtttggtaccatcacttc

SEQ ID NO: 43449 - DNA, 20 bp, Artificial Sequence
  Description of Artificial Sequence: Synthetic oligonucleotide
  Target: ATXN1; (-) strand; PAM type: NRG; PAM sequence: TGG
tgatcttaattttcctggtt

SEQ ID NO: 43450 - DNA, 20 bp, Artificial Sequence
  Description of Artificial Sequence: Synthetic oligonucleotide
  Target: ATXN1; (-) strand; PAM type: NRG; PAM sequence: TGG
ctcattgatcttaattttcc

SEQ ID NO: 43451 - DNA, 20 bp, Artificial Sequence
  Description of Artificial Sequence: Synthetic oligonucleotide
  Target: ATXN1; (-) strand; PAM type: NRG; PAM sequence: AGG
gagctgttgaaaccaagggc

SEQ ID NO: 43452 - DNA, 20 bp, Artificial Sequence
  Description of Artificial Sequence: Synthetic oligonucleotide
  Target: ATXN1; (-) strand; PAM type: NRG; PAM sequence: CAG
tgagctgttgaaaccaaggg

SEQ ID NO: 43453 - DNA, 20 bp, Artificial Sequence
  Description of Artificial Sequence: Synthetic oligonucleotide
  Target: ATXN1; (-) strand; PAM type: NRG; PAM sequence: GGG
aattgagctgttgaaaccaa

SEQ ID NO: 43454 - DNA, 20 bp, Artificial Sequence
  Description of Artificial Sequence: Synthetic oligonucleotide
  Target: ATXN1; (-) strand; PAM type: NRG; PAM sequence: AGG
taattgagctgttgaaacca

SEQ ID NO: 43455 - DNA, 20 bp, Artificial Sequence
  Description of Artificial Sequence: Synthetic oligonucleotide
  Target: ATXN1; (-) strand; PAM type: NRG; PAM sequence: AAG
ctaattgagctgttgaaacc

SEQ ID NO: 43456 - DNA, 20 bp, Artificial Sequence
  Description of Artificial Sequence: Synthetic oligonucleotide
  Target: ATXN1; (-) strand; PAM type: NRG; PAM sequence: GAG
accctgctagtaggctaatt

SEQ ID NO: 43457 - DNA, 20 bp, Artificial Sequence
  Description of Artificial Sequence: Synthetic oligonucleotide
  Target: ATXN1; (-) strand; PAM type: NRG; PAM sequence: AGG
atctcttcaaccctgctagt

SEQ ID NO: 43458 - DNA, 20 bp, Artificial Sequence
  Description of Artificial Sequence: Synthetic oligonucleotide
  Target: ATXN1; (-) strand; PAM type: NRG; PAM sequence: TAG
gatctcttcaaccctgctag

SEQ ID NO: 43459 - DNA, 20 bp, Artificial Sequence
  Description of Artificial Sequence: Synthetic oligonucleotide
  Target: ATXN1; (-) strand; PAM type: NRG; PAM sequence: TAG
ccagatctcttcaaccctgc

SEQ ID NO: 43460 - DNA, 20 bp, Artificial Sequence
  Description of Artificial Sequence: Synthetic oligonucleotide
  Target: ATXN1; (-) strand; PAM type: NRG; PAM sequence: CAG
cattgaaaccattattaaac

SEQ ID NO: 43461 - DNA, 20 bp, Artificial Sequence
  Description of Artificial Sequence: Synthetic oligonucleotide
  Target: ATXN1; (-) strand; PAM type: NRG; PAM sequence: GGG
tagtcaaacaaaaactttct

SEQ ID NO: 43462 - DNA, 20 bp, Artificial Sequence
  Description of Artificial Sequence: Synthetic oligonucleotide
  Target: ATXN1; (-) strand; PAM type: NRG; PAM sequence: TGG
atagtcaaacaaaaactttc

SEQ ID NO: 43463 - DNA, 20 bp, Artificial Sequence
  Description of Artificial Sequence: Synthetic oligonucleotide
  Target: ATXN1; (-) strand; PAM type: NRG; PAM sequence: TAG
ggttgttcatattgagtgta

SEQ ID NO: 43464 - DNA, 20 bp, Artificial Sequence
  Description of Artificial Sequence: Synthetic oligonucleotide
  Target: ATXN1; (-) strand; PAM type: NRG; PAM sequence: GAG
accaaatggttgttcatatt

SEQ ID NO: 43465 - DNA, 20 bp, Artificial Sequence
  Description of Artificial Sequence: Synthetic oligonucleotide
  Target: ATXN1; (-) strand; PAM type: NRG; PAM sequence: TGG
tttttaagaaccctaccaaa

SEQ ID NO: 43466 - DNA, 20 bp, Artificial Sequence
  Description of Artificial Sequence: Synthetic oligonucleotide
  Target: ATXN1; (-) strand; PAM type: NRG; PAM sequence: AAG
ttataattactatacttttt

SEQ ID NO: 43467 - DNA, 20 bp, Artificial Sequence
  Description of Artificial Sequence: Synthetic oligonucleotide
  Target: ATXN1; (-) strand; PAM type: NRG; PAM sequence: AGG
cattatattttttttaatga

SEQ ID NO: 43468 - DNA, 20 bp, Artificial Sequence
  Description of Artificial Sequence: Synthetic oligonucleotide
  Target: ATXN1; (-) strand; PAM type: NRG; PAM sequence: AAG
acattatattttttttaatg

SEQ ID NO: 43469 - DNA, 20 bp, Artificial Sequence
  Description of Artificial Sequence: Synthetic oligonucleotide
  Target: ATXN1; (-) strand; PAM type: NRG; PAM sequence: CAG
caggtgtgagccactgaacc

SEQ ID NO: 43470 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggtgt

SEQ ID NO: 43471 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 43472 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 43473 - DNA, 20 bp, Artificial Sequence
  Description of Artificial Sequence: Synthetic oligonucleotide
  Target: ATXN1; (-) strand; PAM type: NRG; PAM sequence: GGG
tcctgggctcccaaagtgct

SEQ ID NO: 43474 - DNA, 20 bp, Artificial Sequence
  Description of Artificial Sequence: Synthetic oligonucleotide
  Target: ATXN1; (-) strand; PAM type: NRG; PAM sequence: TGG
ctcctgggctcccaaagtgc

SEQ ID NO: 43475 - DNA, 20 bp, Artificial Sequence
  Description of Artificial Sequence: Synthetic oligonucleotide
  Target: ATXN1; (-) strand; PAM type: NRG; PAM sequence: AAG
cttgagctcctgggctccca

SEQ ID NO: 43476 - DNA, 20 bp, Artificial Sequence
  Description of Artificial Sequence: Synthetic oligonucleotide
  Target: ATXN1; (-) strand; PAM type: NRG; PAM sequence: GGG
caggctggccttgagctcct

SEQ ID NO: 43477 - DNA, 20 bp, Artificial Sequence
  Description of Artificial Sequence: Synthetic oligonucleotide
  Target: ATXN1; (-) strand; PAM type: NRG; PAM sequence: TGG
ccaggctggccttgagctcc

SEQ ID NO: 43478 - DNA, 20 bp, Artificial Sequence
  Description of Artificial Sequence: Synthetic oligonucleotide
  Target: ATXN1; (-) strand; PAM type: NRG; PAM sequence: GAG
atgttgtccaggctggcctt

SEQ ID NO: 43479 - DNA, 20 bp, Artificial Sequence
  Description of Artificial Sequence: Synthetic oligonucleotide
  Target: ATXN1; (-) strand; PAM type: NRG; PAM sequence: TGG
tctcgatatgttgtccaggc

SEQ ID NO: 43480 - DNA, 20 bp, Artificial Sequence
  Description of Artificial Sequence: Synthetic oligonucleotide
  Target: ATXN1; (-) strand; PAM type: NRG; PAM sequence: AGG
aggatctcgatatgttgtcc

SEQ ID NO: 43481 - DNA, 20 bp, Artificial Sequence
  Description of Artificial Sequence: Synthetic oligonucleotide
  Target: ATXN1; (-) strand; PAM type: NRG; PAM sequence: CAG
caggatctcgatatgttgtc

SEQ ID NO: 43482 - DNA, 20 bp, Artificial Sequence
  Description of Artificial Sequence: Synthetic oligonucleotide
  Target: ATXN1; (-) strand; PAM type: NRG; PAM sequence: AGG
tttttattttttgtagagac

SEQ ID NO: 43483 - DNA, 20 bp, Artificial Sequence
  Description of Artificial Sequence: Synthetic oligonucleotide
  Target: ATXN1; (-) strand; PAM type: NRG; PAM sequence: CAG
ttttttattttttgtagaga

SEQ ID NO: 43484 - DNA, 20 bp, Artificial Sequence
  Description of Artificial Sequence: Synthetic oligonucleotide
  Target: ATXN1; (-) strand; PAM type: NRG; PAM sequence: GAG
aattttttttattttttgta

SEQ ID NO: 43485 - DNA, 20 bp, Artificial Sequence
  Description of Artificial Sequence: Synthetic oligonucleotide
  Target: ATXN1; (-) strand; PAM type: NRG; PAM sequence: TAG
ctaattttttttattttttg

SEQ ID NO: 43486 - DNA, 20 bp, Artificial Sequence
  Description of Artificial Sequence: Synthetic oligonucleotide
  Target: ATXN1; (-) strand; PAM type: NRG; PAM sequence: TAG
cagatgcaaaccaccatgcc

SEQ ID NO: 43487 - DNA, 20 bp, Artificial Sequence
  Description of Artificial Sequence: Synthetic oligonucleotide
  Target: ATXN1; (-) strand; PAM type: NRG; PAM sequence: CAG
ctcctgggtagctaggacca

SEQ ID NO: 43488 - DNA, 20 bp, Artificial Sequence
  Description of Artificial Sequence: Synthetic oligonucleotide
  Target: ATXN1; (-) strand; PAM type: NRG; PAM sequence: AGG
ccttagcctcctgggtagct

SEQ ID NO: 43489 - DNA, 20 bp, Artificial Sequence
  Description of Artificial Sequence: Synthetic oligonucleotide
  Target: ATXN1; (-) strand; PAM type: NRG; PAM sequence: TAG
gccttagcctcctgggtagc

SEQ ID NO: 43490 - DNA, 20 bp, Artificial Sequence
  Description of Artificial Sequence: Synthetic oligonucleotide
  Target: ATXN1; (-) strand; PAM type: NRG; PAM sequence: TAG
tcctgccttagcctcctggg

SEQ ID NO: 43491 - DNA, 20 bp, Artificial Sequence
  Description of Artificial Sequence: Synthetic oligonucleotide
  Target: ATXN1; (-) strand; PAM type: NRG; PAM sequence: GGG
tcctcctgccttagcctcct

SEQ ID NO: 43492 - DNA, 20 bp, Artificial Sequence
  Description of Artificial Sequence: Synthetic oligonucleotide
  Target: ATXN1; (-) strand; PAM type: NRG; PAM sequence: TGG
atcctcctgccttagcctcc

SEQ ID NO: 43493 - DNA, 20 bp, Artificial Sequence
  Description of Artificial Sequence: Synthetic oligonucleotide
  Target: ATXN1; (-) strand; PAM type: NRG; PAM sequence: TAG
ctcaagcaatcctcctgcct

SEQ ID NO: 43494 - DNA, 20 bp, Artificial Sequence
  Description of Artificial Sequence: Synthetic oligonucleotide
  Target: ATXN1; (-) strand; PAM type: NRG; PAM sequence: AAG
agcctcaacctcctgggctc

SEQ ID NO: 43495 - DNA, 20 bp, Artificial Sequence
  Description of Artificial Sequence: Synthetic oligonucleotide
  Target: ATXN1; (-) strand; PAM type: NRG; PAM sequence: GGG
cactgcagcctcaacctcct

SEQ ID NO: 43496 - DNA, 20 bp, Artificial Sequence
  Description of Artificial Sequence: Synthetic oligonucleotide
  Target: ATXN1; (-) strand; PAM type: NRG; PAM sequence: TGG
tcactgcagcctcaacctcc

SEQ ID NO: 43497 - DNA, 20 bp, Artificial Sequence
  Description of Artificial Sequence: Synthetic oligonucleotide
  Target: ATXN1; (-) strand; PAM type: NRG; PAM sequence: CAG
ggagcaatcatggctcactg

SEQ ID NO: 43498 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggagcaatca

SEQ ID NO: 43499 - DNA, 20 bp, Artificial Sequence
  Description of Artificial Sequence: Synthetic oligonucleotide
  Target: ATXN1; (-) strand; PAM type: NRG; PAM sequence: GAG
acctaggctggagtgcagtg

SEQ ID NO: 43500 - DNA, 20 bp, Artificial Sequence
  Description of Artificial Sequence: Synthetic oligonucleotide
  Target: ATXN1; (-) strand; PAM type: NRG; PAM sequence: TGG
tcacctaggctggagtgcag

SEQ ID NO: 43501 - DNA, 20 bp, Artificial Sequence
  Description of Artificial Sequence: Synthetic oligonucleotide
  Target: ATXN1; (-) strand; PAM type: NRG; PAM sequence: CAG
ttatcacctaggctggagtg

SEQ ID NO: 43502 - DNA, 20 bp, Artificial Sequence
  Description of Artificial Sequence: Synthetic oligonucleotide
  Target: ATXN1; (-) strand; PAM type: NRG; PAM sequence: GAG
ttgctttatcacctaggctg

SEQ ID NO: 43503 - DNA, 20 bp, Artificial Sequence
  Description of Artificial Sequence: Synthetic oligonucleotide
  Target: ATXN1; (-) strand; PAM type: NRG; PAM sequence: TGG
tcttgctttatcacctaggc

SEQ ID NO: 43504 - DNA, 20 bp, Artificial Sequence
  Description of Artificial Sequence: Synthetic oligonucleotide
  Target: ATXN1; (-) strand; PAM type: NRG; PAM sequence: AGG
agggtcttgctttatcacct

SEQ ID NO: 43505 - DNA, 20 bp, Artificial Sequence
  Description of Artificial Sequence: Synthetic oligonucleotide
  Target: ATXN1; (-) strand; PAM type: NRG; PAM sequence: TAG
cagggtcttgctttatcacc

SEQ ID NO: 43506 - DNA, 20 bp, Artificial Sequence
  Description of Artificial Sequence: Synthetic oligonucleotide
  Target: ATXN1; (-) strand; PAM type: NRG; PAM sequence: GGG
ctttctcttttcttgagaca

SEQ ID NO: 43507 - DNA, 20 bp, Artificial Sequence
  Description of Artificial Sequence: Synthetic oligonucleotide
  Target: ATXN1; (-) strand; PAM type: NRG; PAM sequence: AGG
tctttctcttttcttgagac

SEQ ID NO: 43508 - DNA, 20 bp, Artificial Sequence
  Description of Artificial Sequence: Synthetic oligonucleotide
  Target: ATXN1; (-) strand; PAM type: NRG; PAM sequence: CAG
ttctttctcttttcttgaga

SEQ ID NO: 43509 - DNA, 20 bp, Artificial Sequence
  Description of Artificial Sequence: Synthetic oligonucleotide
  Target: ATXN1; (-) strand; PAM type: NRG; PAM sequence: GAG
tgttttctttctcttttctt

SEQ ID NO: 43510 - DNA, 20 bp, Artificial Sequence
  Description of Artificial Sequence: Synthetic oligonucleotide
  Target: ATXN1; (-) strand; PAM type: NRG; PAM sequence: CAG
acccgtgccatctatggttg

SEQ ID NO: 43511 - DNA, 20 bp, Artificial Sequence
  Description of Artificial Sequence: Synthetic oligonucleotide
  Target: ATXN1; (-) strand; PAM type: NRG; PAM sequence: TGG
ggctttacccgtgccatcta

SEQ ID NO: 43512 - DNA, 20 bp, Artificial Sequence
  Description of Artificial Sequence: Synthetic oligonucleotide
  Target: ATXN1; (-) strand; PAM type: NRG; PAM sequence: TGG
ttgcagcaggatttcaactg

SEQ ID NO: 43513 - DNA, 20 bp, Artificial Sequence
  Description of Artificial Sequence: Synthetic oligonucleotide
  Target: ATXN1; (-) strand; PAM type: NRG; PAM sequence: AGG
ttcccacgtgcctttgcagc

SEQ ID NO: 43514 - DNA, 20 bp, Artificial Sequence
  Description of Artificial Sequence: Synthetic oligonucleotide
  Target: ATXN1; (-) strand; PAM type: NRG; PAM sequence: CAG
cttcccacgtgcctttgcag

SEQ ID NO: 43515 - DNA, 20 bp, Artificial Sequence
  Description of Artificial Sequence: Synthetic oligonucleotide
  Target: ATXN1; (-) strand; PAM type: NRG; PAM sequence: CAG
atccttcccacgtgcctttg

SEQ ID NO: 43516 - DNA, 20 bp, Artificial Sequence
  Description of Artificial Sequence: Synthetic oligonucleotide
  Target: ATXN1; (-) strand; PAM type: NRG; PAM sequence: TAG
gcgcaactgatcactccccc

SEQ ID NO: 43517 - DNA, 20 bp, Artificial Sequence
  Description of Artificial Sequence: Synthetic oligonucleotide
  Target: ATXN1; (-) strand; PAM type: NRG; PAM sequence: CAG
gttactcatctgcttgcctc

SEQ ID NO: 43518 - DNA, 20 bp, Artificial Sequence
  Description of Artificial Sequence: Synthetic oligonucleotide
  Target: ATXN1; (-) strand; PAM type: NRG; PAM sequence: CAG
gcactcattcccagttgtct

SEQ ID NO: 43519 - DNA, 20 bp, Artificial Sequence
  Description of Artificial Sequence: Synthetic oligonucleotide
  Target: ATXN1; (-) strand; PAM type: NRG; PAM sequence: CAG
ttccccagggcactcattcc

SEQ ID NO: 43520 - DNA, 20 bp, Artificial Sequence
  Description of Artificial Sequence: Synthetic oligonucleotide
  Target: ATXN1; (-) strand; PAM type: NRG; PAM sequence: GGG
gctttttctgttcttcccca

SEQ ID NO: 43521 - DNA, 20 bp, Artificial Sequence
  Description of Artificial Sequence: Synthetic oligonucleotide
  Target: ATXN1; (-) strand; PAM type: NRG; PAM sequence: AGG
agctttttctgttcttcccc

SEQ ID NO: 43522 - DNA, 20 bp, Artificial Sequence
  Description of Artificial Sequence: Synthetic oligonucleotide
  Target: ATXN1; (-) strand; PAM type: NRG; PAM sequence: CAG
cagctttttctgttcttccc

SEQ ID NO: 43523 - DNA, 20 bp, Artificial Sequence
  Description of Artificial Sequence: Synthetic oligonucleotide
  Target: ATXN1; (-) strand; PAM type: NRG; PAM sequence: CAG
ctcattgcttcctaatgctg

SEQ ID NO: 43524 - DNA, 20 bp, Artificial Sequence
  Description of Artificial Sequence: Synthetic oligonucleotide
  Target: ATXN1; (-) strand; PAM type: NRG; PAM sequence: CAG
ccctgactcatgaggcagcc

SEQ ID NO: 43525 - DNA, 20 bp, Artificial Sequence
  Description of Artificial Sequence: Synthetic oligonucleotide
  Target: ATXN1; (-) strand; PAM type: NRG; PAM sequence: CAG
gagatccctgactcatgagg

SEQ ID NO: 43526 - DNA, 20 bp, Artificial Sequence
  Description of Artificial Sequence: Synthetic oligonucleotide
  Target: ATXN1; (-) strand; PAM type: NRG; PAM sequence: AGG
ccagagatccctgactcatg

SEQ ID NO: 43527 - DNA, 20 bp, Artificial Sequence
  Description of Artificial Sequence: Synthetic oligonucleotide
  Target: ATXN1; (-) strand; PAM type: NRG; PAM sequence: GAG
cccagagatccctgactcat

SEQ ID NO: 43528 - DNA, 20 bp, Artificial Sequence
  Description of Artificial Sequence: Synthetic oligonucleotide
  Target: ATXN1; (-) strand; PAM type: NRG; PAM sequence: GAG
ctgacccttggggtgaccca

SEQ ID NO: 43529 - DNA, 20 bp, Artificial Sequence
  Description of Artificial Sequence: Synthetic oligonucleotide
  Target: ATXN1; (-) strand; PAM type: NRG; PAM sequence: CAG
tcctgacccttggggtgacc

SEQ ID NO: 43530 - DNA, 20 bp, Artificial Sequence
  Description of Artificial Sequence: Synthetic oligonucleotide
  Target: ATXN1; (-) strand; PAM type: NRG; PAM sequence: GGG
agtttctatcctgacccttg

SEQ ID NO: 43531 - DNA, 20 bp, Artificial Sequence
  Description of Artificial Sequence: Synthetic oligonucleotide
  Target: ATXN1; (-) strand; PAM type: NRG; PAM sequence: GGG
gagtttctatcctgaccctt

SEQ ID NO: 43532 - DNA, 20 bp, Artificial Sequence
  Description of Artificial Sequence: Synthetic oligonucleotide
  Target: ATXN1; (-) strand; PAM type: NRG; PAM sequence: TGG
tgagtttctatcctgaccct

SEQ ID NO: 43533 - DNA, 20 bp, Artificial Sequence
  Description of Artificial Sequence: Synthetic oligonucleotide
  Target: ATXN1; (-) strand; PAM type: NRG; PAM sequence: GAG
gacccctaccccatatccct

SEQ ID NO: 43534 - DNA, 20 bp, Artificial Sequence
  Description of Artificial Sequence: Synthetic oligonucleotide
  Target: ATXN1; (-) strand; PAM type: NRG; PAM sequence: GGG
tcgaacacccaaccagggca

SEQ ID NO: 43535 - DNA, 20 bp, Artificial Sequence
  Description of Artificial Sequence: Synthetic oligonucleotide
  Target: ATXN1; (-) strand; PAM type: NRG; PAM sequence: AGG
ttcgaacacccaaccagggc

SEQ ID NO: 43536 - DNA, 20 bp, Artificial Sequence
  Description of Artificial Sequence: Synthetic oligonucleotide
  Target: ATXN1; (-) strand; PAM type: NRG; PAM sequence: CAG
gttcgaacacccaaccaggg

SEQ ID NO: 43537 - DNA, 20 bp, Artificial Sequence
  Description of Artificial Sequence: Synthetic oligonucleotide
  Target: ATXN1; (-) strand; PAM type: NRG; PAM sequence: GGG
gtagttcgaacacccaacca

SEQ ID NO: 43538 - DNA, 20 bp, Artificial Sequence
  Description of Artificial Sequence: Synthetic oligonucleotide
  Target: ATXN1; (-) strand; PAM type: NRG; PAM sequence: AGG
agtagttcgaacacccaacc

SEQ ID NO: 43539 - DNA, 20 bp, Artificial Sequence
  Description of Artificial Sequence: Synthetic oligonucleotide
  Target: ATXN1; (-) strand; PAM type: NRG; PAM sequence: CAG
aagtagttcgaacacccaac

SEQ ID NO: 43540 - DNA, 20 bp, Artificial Sequence
  Description of Artificial Sequence: Synthetic oligonucleotide
  Target: ATXN1; (-) strand; PAM type: NRG; PAM sequence: TAG
gcaaaaaaatgtagagtaag

SEQ ID NO: 43541 - DNA, 20 bp, Artificial Sequence
  Description of Artificial Sequence: Synthetic oligonucleotide
  Target: ATXN1; (-) strand; PAM type: NRG; PAM sequence: AAG
atggcaaaaaaatgtagagt

SEQ ID NO: 43542 - DNA, 20 bp, Artificial Sequence
  Description of Artificial Sequence: Synthetic oligonucleotide
  Target: ATXN1; (-) strand; PAM type: NRG; PAM sequence: GAG
cctaatggcaaaaaaatgta

SEQ ID NO: 43543 - DNA, 20 bp, Artificial Sequence
  Description of Artificial Sequence: Synthetic oligonucleotide
  Target: ATXN1; (-) strand; PAM type: NRG; PAM sequence: TAG
ttcctaatggcaaaaaaatg

SEQ ID NO: 43544 - DNA, 20 bp, Artificial Sequence
  Description of Artificial Sequence: Synthetic oligonucleotide
  Target: ATXN1; (-) strand; PAM type: NRG; PAM sequence: TGG
cagtctcagaatgttcctaa

SEQ ID NO: 43545 - DNA, 20 bp, Artificial Sequence
  Description of Artificial Sequence: Synthetic oligonucleotide
  Target: ATXN1; (-) strand; PAM type: NRG; PAM sequence: CAG
acagagtggaatcacagtct

SEQ ID NO: 43546 - DNA, 20 bp, Artificial Sequence
  Description of Artificial Sequence: Synthetic oligonucleotide
  Target: ATXN1; (-) strand; PAM type: NRG; PAM sequence: CAG
cttgacacagagtggaatca

SEQ ID NO: 43547 - DNA, 20 bp, Artificial Sequence
  Description of Artificial Sequence: Synthetic oligonucleotide
  Target: ATXN1; (-) strand; PAM type: NRG; PAM sequence: TGG
ccagccaccttgacacagag

SEQ ID NO: 43548 - DNA, 20 bp, Artificial Sequence
  Description of Artificial Sequence: Synthetic oligonucleotide
  Target: ATXN1; (-) strand; PAM type: NRG; PAM sequence: GAG
aagccagccaccttgacaca

SEQ ID NO: 43549 - DNA, 20 bp, Artificial Sequence
  Description of Artificial Sequence: Synthetic oligonucleotide
  Target: ATXN1; (-) strand; PAM type: NRG; PAM sequence: CAG
acaagccagccaccttgaca

SEQ ID NO: 43550 - DNA, 20 bp, Artificial Sequence
  Description of Artificial Sequence: Synthetic oligonucleotide
  Target: ATXN1; (-) strand; PAM type: NRG; PAM sequence: CAG
agtagactgggatgacaagc

SEQ ID NO: 43551 - DNA, 20 bp, Artificial Sequence
  Description of Artificial Sequence: Synthetic oligonucleotide
  Target: ATXN1; (-) strand; PAM type: NRG; PAM sequence: AAG
tgacagtagactgggatgac

SEQ ID NO: 43552 - DNA, 20 bp, Artificial Sequence
  Description of Artificial Sequence: Synthetic oligonucleotide
  Target: ATXN1; (-) strand; PAM type: NRG; PAM sequence: GGG
agaaattgtgacagtagact

SEQ ID NO: 43553 - DNA, 20 bp, Artificial Sequence
  Description of Artificial Sequence: Synthetic oligonucleotide
  Target: ATXN1; (-) strand; PAM type: NRG; PAM sequence: TGG
aagaaattgtgacagtagac

SEQ ID NO: 43554 - DNA, 20 bp, Artificial Sequence
  Description of Artificial Sequence: Synthetic oligonucleotide
  Target: ATXN1; (-) strand; PAM type: NRG; PAM sequence: TAG
gcaagaagaaattgtgacag

SEQ ID NO: 43555 - DNA, 20 bp, Artificial Sequence
  Description of Artificial Sequence: Synthetic oligonucleotide
  Target: ATXN1; (-) strand; PAM type: NRG; PAM sequence: CAG
acagcaagaagaaattgtga

SEQ ID NO: 43556 - DNA, 20 bp, Artificial Sequence
  Description of Artificial Sequence: Synthetic oligonucleotide
  Target: ATXN1; (-) strand; PAM type: NRG; PAM sequence: AAG
tccactgaggacacagcaag

SEQ ID NO: 43557 - DNA, 20 bp, Artificial Sequence
  Description of Artificial Sequence: Synthetic oligonucleotide
  Target: ATXN1; (-) strand; PAM type: NRG; PAM sequence: AAG
gtttccactgaggacacagc

SEQ ID NO: 43558 - DNA, 20 bp, Artificial Sequence
  Description of Artificial Sequence: Synthetic oligonucleotide
  Target: ATXN1; (-) strand; PAM type: NRG; PAM sequence: CAG
gtcagtttccactgaggaca

SEQ ID NO: 43559 - DNA, 20 bp, Artificial Sequence
  Description of Artificial Sequence: Synthetic oligonucleotide
  Target: ATXN1; (-) strand; PAM type: NRG; PAM sequence: AGG
tcaatagtcagtttccactg

SEQ ID NO: 43560 - DNA, 20 bp, Artificial Sequence
  Description of Artificial Sequence: Synthetic oligonucleotide
  Target: ATXN1; (-) strand; PAM type: NRG; PAM sequence: GAG
gtcaatagtcagtttccact

SEQ ID NO: 43561 - DNA, 20 bp, Artificial Sequence
  Description of Artificial Sequence: Synthetic oligonucleotide
  Target: ATXN1; (-) strand; PAM type: NRG; PAM sequence: CAG
tggaagagaaggtcaatagt

SEQ ID NO: 43562 - DNA, 20 bp, Artificial Sequence
  Description of Artificial Sequence: Synthetic oligonucleotide
  Target: ATXN1; (-) strand; PAM type: NRG; PAM sequence: TAG
gacatggaagagaaggtcaa

SEQ ID NO: 43563 - DNA, 20 bp, Artificial Sequence
  Description of Artificial Sequence: Synthetic oligonucleotide
  Target: ATXN1; (-) strand; PAM type: NRG; PAM sequence: AGG
ttagatagacatggaagaga

SEQ ID NO: 43564 - DNA, 20 bp, Artificial Sequence
  Description of Artificial Sequence: Synthetic oligonucleotide
  Target: ATXN1; (-) strand; PAM type: NRG; PAM sequence: AAG
cttagatagacatggaagag

SEQ ID NO: 43565 - DNA, 20 bp, Artificial Sequence
  Description of Artificial Sequence: Synthetic oligonucleotide
  Target: ATXN1; (-) strand; PAM type: NRG; PAM sequence: GAG
acgcttagatagacatggaa

SEQ ID NO: 43566 - DNA, 20 bp, Artificial Sequence
  Description of Artificial Sequence: Synthetic oligonucleotide
  Target: ATXN1; (-) strand; PAM type: NRG; PAM sequence: AAG
ccacgcttagatagacatgg

SEQ ID NO: 43567 - DNA, 20 bp, Artificial Sequence
  Description of Artificial Sequence: Synthetic oligonucleotide
  Target: ATXN1; (-) strand; PAM type: NRG; PAM sequence: TGG
gctccacgcttagatagaca

SEQ ID NO: 43568 - DNA, 20 bp, Artificial Sequence
  Description of Artificial Sequence: Synthetic oligonucleotide
  Target: ATXN1; (-) strand; PAM type: NRG; PAM sequence: TAG
catgaagctccacgcttaga

SEQ ID NO: 43569 - DNA, 20 bp, Artificial Sequence
  Description of Artificial Sequence: Synthetic oligonucleotide
  Target: ATXN1; (-) strand; PAM type: NRG; PAM sequence: TAG
gccccatgaagctccacgct

SEQ ID NO: 43570 - DNA, 20 bp, Artificial Sequence
  Description of Artificial Sequence: Synthetic oligonucleotide
  Target: ATXN1; (-) strand; PAM type: NRG; PAM sequence: AAG
gccaagaggcctgccccatg

SEQ ID NO: 43571 - DNA, 20 bp, Artificial Sequence
  Description of Artificial Sequence: Synthetic oligonucleotide
  Target: ATXN1; (-) strand; PAM type: NRG; PAM sequence: AGG
cctcctcattttgggccaag

SEQ ID NO: 43572 - DNA, 20 bp, Artificial Sequence
  Description of Artificial Sequence: Synthetic oligonucleotide
  Target: ATXN1; (-) strand; PAM type: NRG; PAM sequence: GAG
gcctcctcattttgggccaa

SEQ ID NO: 43573 - DNA, 20 bp, Artificial Sequence
  Description of Artificial Sequence: Synthetic oligonucleotide
  Target: ATXN1; (-) strand; PAM type: NRG; PAM sequence: AAG
gagcctcctcattttgggcc

SEQ ID NO: 43574 - DNA, 20 bp, Artificial Sequence
  Description of Artificial Sequence: Synthetic oligonucleotide
  Target: ATXN1; (-) strand; PAM type: NRG; PAM sequence: GGG
ttcaggagcctcctcatttt

SEQ ID NO: 43575 - DNA, 20 bp, Artificial Sequence
  Description of Artificial Sequence: Synthetic oligonucleotide
  Target: ATXN1; (-) strand; PAM type: NRG; PAM sequence: TGG
cttcaggagcctcctcattt

SEQ ID NO: 43576 - DNA, 20 bp, Artificial Sequence
  Description of Artificial Sequence: Synthetic oligonucleotide
  Target: ATXN1; (-) strand; PAM type: NRG; PAM sequence: GAG
gggccttcagtccccttcag

SEQ ID NO: 43577 - DNA, 20 bp, Artificial Sequence
  Description of Artificial Sequence: Synthetic oligonucleotide
  Target: ATXN1; (-) strand; PAM type: NRG; PAM sequence: AGG
cagggccttcagtccccttc

SEQ ID NO: 43578 - DNA, 20 bp, Artificial Sequence
  Description of Artificial Sequence: Synthetic oligonucleotide
  Target: ATXN1; (-) strand; PAM type: NRG; PAM sequence: CAG
acagggccttcagtcccctt

SEQ ID NO: 43579 - DNA, 20 bp, Artificial Sequence
  Description of Artificial Sequence: Synthetic oligonucleotide
  Target: ATXN1; (-) strand; PAM type: NRG; PAM sequence: CAG
atgtctctagacagggcctt

SEQ ID NO: 43580 - DNA, 20 bp, Artificial Sequence
  Description of Artificial Sequence: Synthetic oligonucleotide
  Target: ATXN1; (-) strand; PAM type: NRG; PAM sequence: GGG
ggcctggatgtctctagaca

SEQ ID NO: 43581 - DNA, 20 bp, Artificial Sequence
  Description of Artificial Sequence: Synthetic oligonucleotide
  Target: ATXN1; (-) strand; PAM type: NRG; PAM sequence: AGG
tggcctggatgtctctagac

SEQ ID NO: 43582 - DNA, 20 bp, Artificial Sequence
  Description of Artificial Sequence: Synthetic oligonucleotide
  Target: ATXN1; (-) strand; PAM type: NRG; PAM sequence: CAG
ctggcctggatgtctctaga

SEQ ID NO: 43583 - DNA, 20 bp, Artificial Sequence
  Description of Artificial Sequence: Synthetic oligonucleotide
  Target: ATXN1; (-) strand; PAM type: NRG; PAM sequence: TAG
gtttctggcctggatgtctc

SEQ ID NO: 43584 - DNA, 20 bp, Artificial Sequence
  Description of Artificial Sequence: Synthetic oligonucleotide
  Target: ATXN1; (-) strand; PAM type: NRG; PAM sequence: TGG
ctctctggtggtttctggcc

SEQ ID NO: 43585 - DNA, 20 bp, Artificial Sequence
  Description of Artificial Sequence: Synthetic oligonucleotide
  Target: ATXN1; (-) strand; PAM type: NRG; PAM sequence: TGG
ctcgcctctctggtggtttc

SEQ ID NO: 43586 - DNA, 20 bp, Artificial Sequence
  Description of Artificial Sequence: Synthetic oligonucleotide
  Target: ATXN1; (-) strand; PAM type: NRG; PAM sequence: TGG
gtcccagctcgcctctctgg

SEQ ID NO: 43587 - DNA, 20 bp, Artificial Sequence
  Description of Artificial Sequence: Synthetic oligonucleotide
  Target: ATXN1; (-) strand; PAM type: NRG; PAM sequence: TGG
caggtcccagctcgcctctc

SEQ ID NO: 43588 - DNA, 20 bp, Artificial Sequence
  Description of Artificial Sequence: Synthetic oligonucleotide
  Target: ATXN1; (-) strand; PAM type: NRG; PAM sequence: CAG
tacaaagttgtgccaggtcc

SEQ ID NO: 43589 - DNA, 20 bp, Artificial Sequence
  Description of Artificial Sequence: Synthetic oligonucleotide
  Target: ATXN1; (-) strand; PAM type: NRG; PAM sequence: AGG
atcttctacaaagttgtgcc

SEQ ID NO: 43590 - DNA, 20 bp, Artificial Sequence
  Description of Artificial Sequence: Synthetic oligonucleotide
  Target: ATXN1; (-) strand; PAM type: NRG; PAM sequence: CAG
catcttctacaaagttgtgc

SEQ ID NO: 43591 - DNA, 20 bp, Artificial Sequence
  Description of Artificial Sequence: Synthetic oligonucleotide
  Target: ATXN1; (-) strand; PAM type: NRG; PAM sequence: AAG
ctcagacagcatcttctaca

SEQ ID NO: 43592 - DNA, 20 bp, Artificial Sequence
  Description of Artificial Sequence: Synthetic oligonucleotide
  Target: ATXN1; (-) strand; PAM type: NRG; PAM sequence: CAG
gttggggcgaggctctcaga

SEQ ID NO: 43593 - DNA, 20 bp, Artificial Sequence
  Description of Artificial Sequence: Synthetic oligonucleotide
  Target: ATXN1; (-) strand; PAM type: NRG; PAM sequence: CAG
gcgcgttggggcgaggctct

SEQ ID NO: 43594 - DNA, 20 bp, Artificial Sequence
  Description of Artificial Sequence: Synthetic oligonucleotide
  Target: ATXN1; (-) strand; PAM type: NRG; PAM sequence: AGG
aacccgagcgcgttggggcg

SEQ ID NO: 43595 - DNA, 20 bp, Artificial Sequence
  Description of Artificial Sequence: Synthetic oligonucleotide
  Target: ATXN1; (-) strand; PAM type: NRG; PAM sequence: GAG
aaacccgagcgcgttggggc

SEQ ID NO: 43596 - DNA, 20 bp, Artificial Sequence
  Description of Artificial Sequence: Synthetic oligonucleotide
  Target: ATXN1; (-) strand; PAM type: NRG; PAM sequence: GGG
agggaaacccgagcgcgttg

SEQ ID NO: 43597 - DNA, 20 bp, Artificial Sequence
  Description of Artificial Sequence: Synthetic oligonucleotide
  Target: ATXN1; (-) strand; PAM type: NRG; PAM sequence: GGG
aagggaaacccgagcgcgtt

SEQ ID NO: 43598 - DNA, 20 bp, Artificial Sequence
  Description of Artificial Sequence: Synthetic oligonucleotide
  Target: ATXN1; (-) strand; PAM type: NRG; PAM sequence: TGG
gaagggaaacccgagcgcgt

SEQ ID NO: 43599 - DNA, 20 bp, Artificial Sequence
  Description of Artificial Sequence: Synthetic oligonucleotide
  Target: ATXN1; (-) strand; PAM type: NRG; PAM sequence: GAG
agagccgagaagggaaaccc

SEQ ID NO: 43600 - DNA, 20 bp, Artificial Sequence
  Description of Artificial Sequence: Synthetic oligonucleotide
  Target: ATXN1; (-) strand; PAM type: NRG; PAM sequence: GGG
caggggtgcagagccgagaa

SEQ ID NO: 43601 - DNA, 20 bp, Artificial Sequence
  Description of Artificial Sequence: Synthetic oligonucleotide
  Target: ATXN1; (-) strand; PAM type: NRG; PAM sequence: AGG
ccaggggtgcagagccgaga

SEQ ID NO: 43602 - DNA, 20 bp, Artificial Sequence
  Description of Artificial Sequence: Synthetic oligonucleotide
  Target: ATXN1; (-) strand; PAM type: NRG; PAM sequence: AAG
cccaggggtgcagagccgag

SEQ ID NO: 43603 - DNA, 20 bp, Artificial Sequence
  Description of Artificial Sequence: Synthetic oligonucleotide
  Target: ATXN1; (-) strand; PAM type: NRG; PAM sequence: GAG
tgtcccaggggtgcagagcc

SEQ ID NO: 43604 - DNA, 20 bp, Artificial Sequence
  Description of Artificial Sequence: Synthetic oligonucleotide
  Target: ATXN1; (-) strand; PAM type: NRG; PAM sequence: GAG
tcccatgtcccaggggtgca

SEQ ID NO: 43605 - DNA, 20 bp, Artificial Sequence
  Description of Artificial Sequence: Synthetic oligonucleotide
  Target: ATXN1; (-) strand; PAM type: NRG; PAM sequence: CAG
gatcccatgtcccaggggtg

SEQ ID NO: 43606 - DNA, 20 bp, Artificial Sequence
  Description of Artificial Sequence: Synthetic oligonucleotide
  Target: ATXN1; (-) strand; PAM type: NRG; PAM sequence: GGG
agcaagatcccatgtcccag

SEQ ID NO: 43607 - DNA, 20 bp, Artificial Sequence
  Description of Artificial Sequence: Synthetic oligonucleotide
  Target: ATXN1; (-) strand; PAM type: NRG; PAM sequence: GGG
gagcaagatcccatgtccca

SEQ ID NO: 43608 - DNA, 20 bp, Artificial Sequence
  Description of Artificial Sequence: Synthetic oligonucleotide
  Target: ATXN1; (-) strand; PAM type: NRG; PAM sequence: AGG
agagcaagatcccatgtccc

SEQ ID NO: 43609 - DNA, 20 bp, Artificial Sequence
  Description of Artificial Sequence: Synthetic oligonucleotide
  Target: ATXN1; (-) strand; PAM type: NRG; PAM sequence: CAG
aagagcaagatcccatgtcc

SEQ ID NO: 43610 - DNA, 20 bp, Artificial Sequence
  Description of Artificial Sequence: Synthetic oligonucleotide
  Target: ATXN1; (-) strand; PAM type: NRG; PAM sequence: AAG
actacacttccgtgaagagc

SEQ ID NO: 43611 - DNA, 20 bp, Artificial Sequence
  Description of Artificial Sequence: Synthetic oligonucleotide
  Target: ATXN1; (-) strand; PAM type: NRG; PAM sequence: GAG
actcactacacttccgtgaa

SEQ ID NO: 43612 - DNA, 20 bp, Artificial Sequence
  Description of Artificial Sequence: Synthetic oligonucleotide
  Target: ATXN1; (-) strand; PAM type: NRG; PAM sequence: AAG
tcactcactacacttccgtg

SEQ ID NO: 43613 - DNA, 20 bp, Artificial Sequence
  Description of Artificial Sequence: Synthetic oligonucleotide
  Target: ATXN1; (-) strand; PAM type: NRG; PAM sequence: GAG
ctccttctagcttggattac

SEQ ID NO: 43614 - DNA, 20 bp, Artificial Sequence
  Description of Artificial Sequence: Synthetic oligonucleotide
  Target: ATXN1; (-) strand; PAM type: NRG; PAM sequence: TGG
cgtgtggactccttctagct

SEQ ID NO: 43615 - DNA, 20 bp, Artificial Sequence
  Description of Artificial Sequence: Synthetic oligonucleotide
  Target: ATXN1; (-) strand; PAM type: NRG; PAM sequence: TAG
gccctcgtgtggactccttc

SEQ ID NO: 43616 - DNA, 20 bp, Artificial Sequence
  Description of Artificial Sequence: Synthetic oligonucleotide
  Target: ATXN1; (-) strand; PAM type: NRG; PAM sequence: TGG
tatgtccttaggccctcgtg

SEQ ID NO: 43617 - DNA, 20 bp, Artificial Sequence
  Description of Artificial Sequence: Synthetic oligonucleotide
  Target: ATXN1; (-) strand; PAM type: NRG; PAM sequence: AGG
tatttattttttatgtcctt

SEQ ID NO: 43618 - DNA, 20 bp, Artificial Sequence
  Description of Artificial Sequence: Synthetic oligonucleotide
  Target: ATXN1; (-) strand; PAM type: NRG; PAM sequence: TAG
ttatttattttttatgtcct

SEQ ID NO: 43619 - DNA, 20 bp, Artificial Sequence
  Description of Artificial Sequence: Synthetic oligonucleotide
  Target: ATXN1; (-) strand; PAM type: NRG; PAM sequence: AAG
ccttattcatgataaaaatt

SEQ ID NO: 43620 - DNA, 20 bp, Artificial Sequence
  Description of Artificial Sequence: Synthetic oligonucleotide
  Target: ATXN1; (-) strand; PAM type: NRG; PAM sequence: GGG
ctgagtgggcataactttta

SEQ ID NO: 43621 - DNA, 20 bp, Artificial Sequence
  Description of Artificial Sequence: Synthetic oligonucleotide
  Target: ATXN1; (-) strand; PAM type: NRG; PAM sequence: AGG
tctgagtgggcataactttt

SEQ ID NO: 43622 - DNA, 20 bp, Artificial Sequence
  Description of Artificial Sequence: Synthetic oligonucleotide
  Target: ATXN1; (-) strand; PAM type: NRG; PAM sequence: TAG
ttctgagtgggcataacttt

SEQ ID NO: 43623 - DNA, 20 bp, Artificial Sequence
  Description of Artificial Sequence: Synthetic oligonucleotide
  Target: ATXN1; (-) strand; PAM type: NRG; PAM sequence: GGG
gccattcccaggttctgagt

SEQ ID NO: 43624 - DNA, 20 bp, Artificial Sequence
  Description of Artificial Sequence: Synthetic oligonucleotide
  Target: ATXN1; (-) strand; PAM type: NRG; PAM sequence: TGG
agccattcccaggttctgag

SEQ ID NO: 43625 - DNA, 20 bp, Artificial Sequence
  Description of Artificial Sequence: Synthetic oligonucleotide
  Target: ATXN1; (-) strand; PAM type: NRG; PAM sequence: GAG
taaagccattcccaggttct

SEQ ID NO: 43626 - DNA, 20 bp, Artificial Sequence
  Description of Artificial Sequence: Synthetic oligonucleotide
  Target: ATXN1; (-) strand; PAM type: NRG; PAM sequence: AGG
ttccaaataaagccattccc

SEQ ID NO: 43627 - DNA, 20 bp, Artificial Sequence
  Description of Artificial Sequence: Synthetic oligonucleotide
  Target: ATXN1; (-) strand; PAM type: NRG; PAM sequence: CAG
tttccaaataaagccattcc

SEQ ID NO: 43628 - DNA, 20 bp, Artificial Sequence
  Description of Artificial Sequence: Synthetic oligonucleotide
  Target: ATXN1; (-) strand; PAM type: NRG; PAM sequence: AAG
aaagaccctttttccaaata

SEQ ID NO: 43629 - DNA, 20 bp, Artificial Sequence
  Description of Artificial Sequence: Synthetic oligonucleotide
  Target: ATXN1; (-) strand; PAM type: NRG; PAM sequence: AAG
aatccataattacatctgca

SEQ ID NO: 43630 - DNA, 20 bp, Artificial Sequence
  Description of Artificial Sequence: Synthetic oligonucleotide
  Target: ATXN1; (-) strand; PAM type: NRG; PAM sequence: CAG
gagggcccacctggatcatc

SEQ ID NO: 43631 - DNA, 20 bp, Artificial Sequence
  Description of Artificial Sequence: Synthetic oligonucleotide
  Target: ATXN1; (-) strand; PAM type: NRG; PAM sequence: TGG
ctttgaattgagggcccacc

SEQ ID NO: 43632 - DNA, 20 bp, Artificial Sequence
  Description of Artificial Sequence: Synthetic oligonucleotide
  Target: ATXN1; (-) strand; PAM type: NRG; PAM sequence: GGG
gacatttgtctttgaattga

SEQ ID NO: 43633 - DNA, 20 bp, Artificial Sequence
  Description of Artificial Sequence: Synthetic oligonucleotide
  Target: ATXN1; (-) strand; PAM type: NRG; PAM sequence: AGG
ggacatttgtctttgaattg

SEQ ID NO: 43634 - DNA, 20 bp, Artificial Sequence
  Description of Artificial Sequence: Synthetic oligonucleotide
  Target: ATXN1; (-) strand; PAM type: NRG; PAM sequence: GAG
aggacatttgtctttgaatt

SEQ ID NO: 43635 - DNA, 20 bp, Artificial Sequence
  Description of Artificial Sequence: Synthetic oligonucleotide
  Target: ATXN1; (-) strand; PAM type: NRG; PAM sequence: AGG
ttctctgcctttctcttata

SEQ ID NO: 43636 - DNA, 20 bp, Artificial Sequence
  Description of Artificial Sequence: Synthetic oligonucleotide
  Target: ATXN1; (-) strand; PAM type: NRG; PAM sequence: AAG
tttctctgcctttctcttat

SEQ ID NO: 43637 - DNA, 20 bp, Artificial Sequence
  Description of Artificial Sequence: Synthetic oligonucleotide
  Target: ATXN1; (-) strand; PAM type: NRG; PAM sequence: GGG
tctctgcctctgcctccaca

SEQ ID NO: 43638 - DNA, 20 bp, Artificial Sequence
  Description of Artificial Sequence: Synthetic oligonucleotide
  Target: ATXN1; (-) strand; PAM type: NRG; PAM sequence: AGG
ctctctgcctctgcctccac

SEQ ID NO: 43639 - DNA, 20 bp, Artificial Sequence
  Description of Artificial Sequence: Synthetic oligonucleotide
  Target: ATXN1; (-) strand; PAM type: NRG; PAM sequence: CAG
tctctctgcctctgcctcca

SEQ ID NO: 43640 - DNA, 20 bp, Artificial Sequence
  Description of Artificial Sequence: Synthetic oligonucleotide
  Target: ATXN1; (-) strand; PAM type: NRG; PAM sequence: CAG
ggcttgggactgcgtcattc

SEQ ID NO: 43641 - DNA, 20 bp, Artificial Sequence
  Description of Artificial Sequence: Synthetic oligonucleotide
  Target: ATXN1; (-) strand; PAM type: NRG; PAM sequence: GGG
cttcgggtgatccttggctt

SEQ ID NO: 43642 - DNA, 20 bp, Artificial Sequence
  Description of Artificial Sequence: Synthetic oligonucleotide
  Target: ATXN1; (-) strand; PAM type: NRG; PAM sequence: TGG
gcttcgggtgatccttggct

SEQ ID NO: 43643 - DNA, 20 bp, Artificial Sequence
  Description of Artificial Sequence: Synthetic oligonucleotide
  Target: ATXN1; (-) strand; PAM type: NRG; PAM sequence: TGG
tagtagcttcgggtgatcct

SEQ ID NO: 43644 - DNA, 20 bp, Artificial Sequence
  Description of Artificial Sequence: Synthetic oligonucleotide
  Target: ATXN1; (-) strand; PAM type: NRG; PAM sequence: GGG
ttgctgcttctagtagcttc

SEQ ID NO: 43645 - DNA, 20 bp, Artificial Sequence
  Description of Artificial Sequence: Synthetic oligonucleotide
  Target: ATXN1; (-) strand; PAM type: NRG; PAM sequence: CGG
cttgctgcttctagtagctt

SEQ ID NO: 43646 - DNA, 20 bp, Artificial Sequence
  Description of Artificial Sequence: Synthetic oligonucleotide
  Target: ATXN1; (-) strand; PAM type: NRG; PAM sequence: TAG
ttgcttcttgctgcttctag

SEQ ID NO: 43647 - DNA, 20 bp, Artificial Sequence
  Description of Artificial Sequence: Synthetic oligonucleotide
  Target: ATXN1; (-) strand; PAM type: NRG; PAM sequence: TAG
tccttgcttcttgctgcttc

SEQ ID NO: 43648 - DNA, 20 bp, Artificial Sequence
  Description of Artificial Sequence: Synthetic oligonucleotide
  Target: ATXN1; (-) strand; PAM type: NRG; PAM sequence: GGG
gttcccttcataggctctag

SEQ ID NO: 43649 - DNA, 20 bp, Artificial Sequence
  Description of Artificial Sequence: Synthetic oligonucleotide
  Target: ATXN1; (-) strand; PAM type: NRG; PAM sequence: GGG
tgttcccttcataggctcta

SEQ ID NO: 43650 - DNA, 20 bp, Artificial Sequence
  Description of Artificial Sequence: Synthetic oligonucleotide
  Target: ATXN1; (-) strand; PAM type: NRG; PAM sequence: AGG
atgttcccttcataggctct

SEQ ID NO: 43651 - DNA, 20 bp, Artificial Sequence
  Description of Artificial Sequence: Synthetic oligonucleotide
  Target: ATXN1; (-) strand; PAM type: NRG; PAM sequence: TAG
catgttcccttcataggctc

SEQ ID NO: 43652 - DNA, 20 bp, Artificial Sequence
  Description of Artificial Sequence: Synthetic oligonucleotide
  Target: ATXN1; (-) strand; PAM type: NRG; PAM sequence: AGG
tggagccatgttcccttcat

SEQ ID NO: 43653 - DNA, 20 bp, Artificial Sequence
  Description of Artificial Sequence: Synthetic oligonucleotide
  Target: ATXN1; (-) strand; PAM type: NRG; PAM sequence: TAG
gtggagccatgttcccttca

SEQ ID NO: 43654 - DNA, 20 bp, Artificial Sequence
  Description of Artificial Sequence: Synthetic oligonucleotide
  Target: ATXN1; (-) strand; PAM type: NRG; PAM sequence: GAG
ctaaaattaaggtgctggtg

SEQ ID NO: 43655 - DNA, 20 bp, Artificial Sequence
  Description of Artificial Sequence: Synthetic oligonucleotide
  Target: ATXN1; (-) strand; PAM type: NRG; PAM sequence: TGG
gtctaaaattaaggtgctgg

SEQ ID NO: 43656 - DNA, 20 bp, Artificial Sequence
  Description of Artificial Sequence: Synthetic oligonucleotide
  Target: ATXN1; (-) strand; PAM type: NRG; PAM sequence: TGG
gaagtctaaaattaaggtgc

SEQ ID NO: 43657 - DNA, 20 bp, Artificial Sequence
  Description of Artificial Sequence: Synthetic oligonucleotide
  Target: ATXN1; (-) strand; PAM type: NRG; PAM sequence: AGG
aggcttgaagtctaaaatta

SEQ ID NO: 43658 - DNA, 20 bp, Artificial Sequence
  Description of Artificial Sequence: Synthetic oligonucleotide
  Target: ATXN1; (-) strand; PAM type: NRG; PAM sequence: AAG
gaggcttgaagtctaaaatt

SEQ ID NO: 43659 - DNA, 20 bp, Artificial Sequence
  Description of Artificial Sequence: Synthetic oligonucleotide
  Target: ATXN1; (-) strand; PAM type: NRG; PAM sequence: AAG
ctaacactcctggaggcttg

SEQ ID NO: 43660 - DNA, 20 bp, Artificial Sequence
  Description of Artificial Sequence: Synthetic oligonucleotide
  Target: ATXN1; (-) strand; PAM type: NRG; PAM sequence: AGG
gtattctctaacactcctgg

SEQ ID NO: 43661 - DNA, 20 bp, Artificial Sequence
  Description of Artificial Sequence: Synthetic oligonucleotide
  Target: ATXN1; (-) strand; PAM type: NRG; PAM sequence: GAG
agtattctctaacactcctg

SEQ ID NO: 43662 - DNA, 20 bp, Artificial Sequence
  Description of Artificial Sequence: Synthetic oligonucleotide
  Target: ATXN1; (-) strand; PAM type: NRG; PAM sequence: TGG
aaagtattctctaacactcc

SEQ ID NO: 43663 - DNA, 20 bp, Artificial Sequence
  Description of Artificial Sequence: Synthetic oligonucleotide
  Target: ATXN1; (-) strand; PAM type: NRG; PAM sequence: AAG
cgtggcttaaaacaacagaa

SEQ ID NO: 43664 - DNA, 20 bp, Artificial Sequence
  Description of Artificial Sequence: Synthetic oligonucleotide
  Target: ATXN1; (-) strand; PAM type: NRG; PAM sequence: CAG
catatcgtggcttaaaacaa

SEQ ID NO: 43665 - DNA, 20 bp, Artificial Sequence
  Description of Artificial Sequence: Synthetic oligonucleotide
  Target: ATXN1; (-) strand; PAM type: NRG; PAM sequence: TGG
taaattaccaaaacatatcg

SEQ ID NO: 43666 - DNA, 20 bp, Artificial Sequence
  Description of Artificial Sequence: Synthetic oligonucleotide
  Target: ATXN1; (-) strand; PAM type: NRG; PAM sequence: GGG
atatttggattggtttctta

SEQ ID NO: 43667 - DNA, 20 bp, Artificial Sequence
  Description of Artificial Sequence: Synthetic oligonucleotide
  Target: ATXN1; (-) strand; PAM type: NRG; PAM sequence: AGG
gatatttggattggtttctt

SEQ ID NO: 43668 - DNA, 20 bp, Artificial Sequence
  Description of Artificial Sequence: Synthetic oligonucleotide
  Target: ATXN1; (-) strand; PAM type: NRG; PAM sequence: TAG
agatatttggattggtttct

SEQ ID NO: 43669 - DNA, 20 bp, Artificial Sequence
  Description of Artificial Sequence: Synthetic oligonucleotide
  Target: ATXN1; (-) strand; PAM type: NRG; PAM sequence: TGG
taaatggaagatatttggat

SEQ ID NO: 43670 - DNA, 20 bp, Artificial Sequence
  Description of Artificial Sequence: Synthetic oligonucleotide
  Target: ATXN1; (-) strand; PAM type: NRG; PAM sequence: TGG
atcaataaatggaagatatt

SEQ ID NO: 43671 - DNA, 20 bp, Artificial Sequence
  Description of Artificial Sequence: Synthetic oligonucleotide
  Target: ATXN1; (-) strand; PAM type: NRG; PAM sequence: AAG
aataagtaatcaataaatgg

SEQ ID NO: 43672 - DNA, 20 bp, Artificial Sequence
  Description of Artificial Sequence: Synthetic oligonucleotide
  Target: ATXN1; (-) strand; PAM type: NRG; PAM sequence: TGG
tataataagtaatcaataaa

SEQ ID NO: 43673 - DNA, 20 bp, Artificial Sequence
  Description of Artificial Sequence: Synthetic oligonucleotide
  Target: ATXN1; (-) strand; PAM type: NRG; PAM sequence: AAG
aggttcttggcatgtataat

SEQ ID NO: 43674 - DNA, 20 bp, Artificial Sequence
  Description of Artificial Sequence: Synthetic oligonucleotide
  Target: ATXN1; (-) strand; PAM type: NRG; PAM sequence: TGG
agatatttaagtaaggttct

SEQ ID NO: 43675 - DNA, 20 bp, Artificial Sequence
  Description of Artificial Sequence: Synthetic oligonucleotide
  Target: ATXN1; (-) strand; PAM type: NRG; PAM sequence: AGG
gtaaatgagatatttaagta

SEQ ID NO: 43676 - DNA, 20 bp, Artificial Sequence
  Description of Artificial Sequence: Synthetic oligonucleotide
  Target: ATXN1; (-) strand; PAM type: NRG; PAM sequence: AAG
agtaaatgagatatttaagt

SEQ ID NO: 43677 - DNA, 20 bp, Artificial Sequence
  Description of Artificial Sequence: Synthetic oligonucleotide
  Target: ATXN1; (-) strand; PAM type: NRG; PAM sequence: AAG
gaagagtaaatgagatattt

SEQ ID NO: 43678 - DNA, 20 bp, Artificial Sequence
  Description of Artificial Sequence: Synthetic oligonucleotide
  Target: ATXN1; (-) strand; PAM type: NRG; PAM sequence: GAG
atttgttatgaagagtaaat

SEQ ID NO: 43679 - DNA, 20 bp, Artificial Sequence
  Description of Artificial Sequence: Synthetic oligonucleotide
  Target: ATXN1; (-) strand; PAM type: NRG; PAM sequence: GAG
cctcacaaatttgttatgaa

SEQ ID NO: 43680 - DNA, 20 bp, Artificial Sequence
  Description of Artificial Sequence: Synthetic oligonucleotide
  Target: ATXN1; (-) strand; PAM type: NRG; PAM sequence: AAG
aacctcacaaatttgttatg

SEQ ID NO: 43681 - DNA, 20 bp, Artificial Sequence
  Description of Artificial Sequence: Synthetic oligonucleotide
  Target: ATXN1; (-) strand; PAM type: NRG; PAM sequence: GAG
gtgtccttatctggaaaatg

SEQ ID NO: 43682 - DNA, 20 bp, Artificial Sequence
  Description of Artificial Sequence: Synthetic oligonucleotide
  Target: ATXN1; (-) strand; PAM type: NRG; PAM sequence: TGG
cagtgtccttatctggaaaa

SEQ ID NO: 43683 - DNA, 20 bp, Artificial Sequence
  Description of Artificial Sequence: Synthetic oligonucleotide
  Target: ATXN1; (-) strand; PAM type: NRG; PAM sequence: TGG
aaaacctcagtgtccttatc

SEQ ID NO: 43684 - DNA, 20 bp, Artificial Sequence
  Description of Artificial Sequence: Synthetic oligonucleotide
  Target: ATXN1; (-) strand; PAM type: NRG; PAM sequence: CAG
gtatggccttgggaaaacct

SEQ ID NO: 43685 - DNA, 20 bp, Artificial Sequence
  Description of Artificial Sequence: Synthetic oligonucleotide
  Target: ATXN1; (-) strand; PAM type: NRG; PAM sequence: GGG
acctctgactgtatggcctt

SEQ ID NO: 43686 - DNA, 20 bp, Artificial Sequence
  Description of Artificial Sequence: Synthetic oligonucleotide
  Target: ATXN1; (-) strand; PAM type: NRG; PAM sequence: TGG
tacctctgactgtatggcct

SEQ ID NO: 43687 - DNA, 20 bp, Artificial Sequence
  Description of Artificial Sequence: Synthetic oligonucleotide
  Target: ATXN1; (-) strand; PAM type: NRG; PAM sequence: TGG
tagttctacctctgactgta

SEQ ID NO: 43688 - DNA, 20 bp, Artificial Sequence
  Description of Artificial Sequence: Synthetic oligonucleotide
  Target: ATXN1; (-) strand; PAM type: NRG; PAM sequence: TAG
aagaaagtgatttccagtgc

SEQ ID NO: 43689 - DNA, 20 bp, Artificial Sequence
  Description of Artificial Sequence: Synthetic oligonucleotide
  Target: ATXN1; (-) strand; PAM type: NRG; PAM sequence: CAG
tagactaagaaagtgatttc

SEQ ID NO: 43690 - DNA, 20 bp, Artificial Sequence
  Description of Artificial Sequence: Synthetic oligonucleotide
  Target: ATXN1; (-) strand; PAM type: NRG; PAM sequence: AAG
catggttgggtagactaaga

SEQ ID NO: 43691 - DNA, 20 bp, Artificial Sequence
  Description of Artificial Sequence: Synthetic oligonucleotide
  Target: ATXN1; (-) strand; PAM type: NRG; PAM sequence: AAG
gcatcatggttgggtagact

SEQ ID NO: 43692 - DNA, 20 bp, Artificial Sequence
  Description of Artificial Sequence: Synthetic oligonucleotide
  Target: ATXN1; (-) strand; PAM type: NRG; PAM sequence: TAG
taacccgcatcatggttggg

SEQ ID NO: 43693 - DNA, 20 bp, Artificial Sequence
  Description of Artificial Sequence: Synthetic oligonucleotide
  Target: ATXN1; (-) strand; PAM type: NRG; PAM sequence: GGG
gtgtaacccgcatcatggtt

SEQ ID NO: 43694 - DNA, 20 bp, Artificial Sequence
  Description of Artificial Sequence: Synthetic oligonucleotide
  Target: ATXN1; (-) strand; PAM type: NRG; PAM sequence: TGG
agtgtaacccgcatcatggt

SEQ ID NO: 43695 - DNA, 20 bp, Artificial Sequence
  Description of Artificial Sequence: Synthetic oligonucleotide
  Target: ATXN1; (-) strand; PAM type: NRG; PAM sequence: TGG
ggtgagtgtaacccgcatca

SEQ ID NO: 43696 - DNA, 20 bp, Artificial Sequence
  Description of Artificial Sequence: Synthetic oligonucleotide
  Target: ATXN1; (-) strand; PAM type: NRG; PAM sequence: GAG
catcgccatagccaggaggt

SEQ ID NO: 43697 - DNA, 20 bp, Artificial Sequence
  Description of Artificial Sequence: Synthetic oligonucleotide
  Target: ATXN1; (-) strand; PAM type: NRG; PAM sequence: AGG
ctgccatcgccatagccagg

SEQ ID NO: 43698 - DNA, 20 bp, Artificial Sequence
  Description of Artificial Sequence: Synthetic oligonucleotide
  Target: ATXN1; (-) strand; PAM type: NRG; PAM sequence: GAG
gctgccatcgccatagccag

SEQ ID NO: 43699 - DNA, 20 bp, Artificial Sequence
  Description of Artificial Sequence: Synthetic oligonucleotide
  Target: ATXN1; (-) strand; PAM type: NRG; PAM sequence: AGG
aggctgccatcgccatagcc

SEQ ID NO: 43700 - DNA, 20 bp, Artificial Sequence
  Description of Artificial Sequence: Synthetic oligonucleotide
  Target: ATXN1; (-) strand; PAM type: NRG; PAM sequence: CAG
gaggctgccatcgccatagc

SEQ ID NO: 43701 - DNA, 20 bp, Artificial Sequence
  Description of Artificial Sequence: Synthetic oligonucleotide
  Target: ATXN1; (-) strand; PAM type: NRG; PAM sequence: TAG
ctatgaggctgccatcgcca

SEQ ID NO: 43702 - DNA, 20 bp, Artificial Sequence
  Description of Artificial Sequence: Synthetic oligonucleotide
  Target: ATXN1; (-) strand; PAM type: NRG; PAM sequence: AGG
aaataggcatatttgctatg

SEQ ID NO: 43703 - DNA, 20 bp, Artificial Sequence
  Description of Artificial Sequence: Synthetic oligonucleotide
  Target: ATXN1; (-) strand; PAM type: NRG; PAM sequence: GAG
taaataggcatatttgctat

SEQ ID NO: 43704 - DNA, 20 bp, Artificial Sequence
  Description of Artificial Sequence: Synthetic oligonucleotide
  Target: ATXN1; (-) strand; PAM type: NRG; PAM sequence: AGG
tttctacatgaaaaataaat

SEQ ID NO: 43705 - DNA, 20 bp, Artificial Sequence
  Description of Artificial Sequence: Synthetic oligonucleotide
  Target: ATXN1; (-) strand; PAM type: NRG; PAM sequence: TAG
ttttctacatgaaaaataaa

SEQ ID NO: 43706 - DNA, 20 bp, Artificial Sequence
  Description of Artificial Sequence: Synthetic oligonucleotide
  Target: ATXN1; (-) strand; PAM type: NRG; PAM sequence: TAG
aacatggtgcagaggtcccc

SEQ ID NO: 43707 - DNA, 20 bp, Artificial Sequence
  Description of Artificial Sequence: Synthetic oligonucleotide
  Target: ATXN1; (-) strand; PAM type: NRG; PAM sequence: AGG
gattagtcaacatggtgcag

SEQ ID NO: 43708 - DNA, 20 bp, Artificial Sequence
  Description of Artificial Sequence: Synthetic oligonucleotide
  Target: ATXN1; (-) strand; PAM type: NRG; PAM sequence: GAG
tgattagtcaacatggtgca

SEQ ID NO: 43709 - DNA, 20 bp, Artificial Sequence
  Description of Artificial Sequence: Synthetic oligonucleotide
  Target: ATXN1; (-) strand; PAM type: NRG; PAM sequence: CAG
cttgattagtcaacatggtg

SEQ ID NO: 43710 - DNA, 20 bp, Artificial Sequence
  Description of Artificial Sequence: Synthetic oligonucleotide
  Target: ATXN1; (-) strand; PAM type: NRG; PAM sequence: TGG
cagttcttgattagtcaaca

SEQ ID NO: 43711 - DNA, 20 bp, Artificial Sequence
  Description of Artificial Sequence: Synthetic oligonucleotide
  Target: ATXN1; (-) strand; PAM type: NRG; PAM sequence: TAG
caccagctgcagttcttgat

SEQ ID NO: 43712 - DNA, 20 bp, Artificial Sequence
  Description of Artificial Sequence: Synthetic oligonucleotide
  Target: ATXN1; (-) strand; PAM type: NRG; PAM sequence: CAG
actgaacgtctcaccagctg

SEQ ID NO: 43713 - DNA, 20 bp, Artificial Sequence
  Description of Artificial Sequence: Synthetic oligonucleotide
  Target: ATXN1; (-) strand; PAM type: NRG; PAM sequence: CAG
ttccttactgaacgtctcac

SEQ ID NO: 43714 - DNA, 20 bp, Artificial Sequence
  Description of Artificial Sequence: Synthetic oligonucleotide
  Target: ATXN1; (-) strand; PAM type: NRG; PAM sequence: CAG
tctcttccttggtcactgat

SEQ ID NO: 43715 - DNA, 20 bp, Artificial Sequence
  Description of Artificial Sequence: Synthetic oligonucleotide
  Target: ATXN1; (-) strand; PAM type: NRG; PAM sequence: TGG
acatcctgacctctcttcct

SEQ ID NO: 43716 - DNA, 20 bp, Artificial Sequence
  Description of Artificial Sequence: Synthetic oligonucleotide
  Target: ATXN1; (-) strand; PAM type: NRG; PAM sequence: GGG
ggtcccctgcttgcttgcct

SEQ ID NO: 43717 - DNA, 20 bp, Artificial Sequence
  Description of Artificial Sequence: Synthetic oligonucleotide
  Target: ATXN1; (-) strand; PAM type: NRG; PAM sequence: TGG
aggtcccctgcttgcttgcc

SEQ ID NO: 43718 - DNA, 20 bp, Artificial Sequence
  Description of Artificial Sequence: Synthetic oligonucleotide
  Target: ATXN1; (-) strand; PAM type: NRG; PAM sequence: AGG
gaacttggctgctgagcctg

SEQ ID NO: 43719 - DNA, 20 bp, Artificial Sequence
  Description of Artificial Sequence: Synthetic oligonucleotide
  Target: ATXN1; (-) strand; PAM type: NRG; PAM sequence: GAG
tgaacttggctgctgagcct

SEQ ID NO: 43720 - DNA, 20 bp, Artificial Sequence
  Description of Artificial Sequence: Synthetic oligonucleotide
  Target: ATXN1; (-) strand; PAM type: NRG; PAM sequence: GAG
tggtcttgaacttggctgct

SEQ ID NO: 43721 - DNA, 20 bp, Artificial Sequence
  Description of Artificial Sequence: Synthetic oligonucleotide
  Target: ATXN1; (-) strand; PAM type: NRG; PAM sequence: TGG
tgggtgggtggtcttgaact

SEQ ID NO: 43722 - DNA, 20 bp, Artificial Sequence
  Description of Artificial Sequence: Synthetic oligonucleotide
  Target: ATXN1; (-) strand; PAM type: NRG; PAM sequence: TGG
ctggatcacaattgggtggg

SEQ ID NO: 43723 - DNA, 20 bp, Artificial Sequence
  Description of Artificial Sequence: Synthetic oligonucleotide
  Target: ATXN1; (-) strand; PAM type: NRG; PAM sequence: GGG
ggcctggatcacaattgggt

SEQ ID NO: 43724 - DNA, 20 bp, Artificial Sequence
  Description of Artificial Sequence: Synthetic oligonucleotide
  Target: ATXN1; (-) strand; PAM type: NRG; PAM sequence: TGG
tggcctggatcacaattggg

SEQ ID NO: 43725 - DNA, 20 bp, Artificial Sequence
  Description of Artificial Sequence: Synthetic oligonucleotide
  Target: ATXN1; (-) strand; PAM type: NRG; PAM sequence: GGG
ctatggcctggatcacaatt

SEQ ID NO: 43726 - DNA, 20 bp, Artificial Sequence
  Description of Artificial Sequence: Synthetic oligonucleotide
  Target: ATXN1; (-) strand; PAM type: NRG; PAM sequence: TGG
cctatggcctggatcacaat

SEQ ID NO: 43727 - DNA, 20 bp, Artificial Sequence
  Description of Artificial Sequence: Synthetic oligonucleotide
  Target: ATXN1; (-) strand; PAM type: NRG; PAM sequence: TGG
gtctcaccactcctatggcc

SEQ ID NO: 43728 - DNA, 20 bp, Artificial Sequence
  Description of Artificial Sequence: Synthetic oligonucleotide
  Target: ATXN1; (-) strand; PAM type: NRG; PAM sequence: TGG
ctgcagtctcaccactccta

SEQ ID NO: 43729 - DNA, 20 bp, Artificial Sequence
  Description of Artificial Sequence: Synthetic oligonucleotide
  Target: ATXN1; (-) strand; PAM type: NRG; PAM sequence: CAG
tgtgccagaggctccttctg

SEQ ID NO: 43730 - DNA, 20 bp, Artificial Sequence
  Description of Artificial Sequence: Synthetic oligonucleotide
  Target: ATXN1; (-) strand; PAM type: NRG; PAM sequence: AGG
tcacgtccgacctgtgccag

SEQ ID NO: 43731 - DNA, 20 bp, Artificial Sequence
  Description of Artificial Sequence: Synthetic oligonucleotide
  Target: ATXN1; (-) strand; PAM type: NRG; PAM sequence: GAG
ctcacgtccgacctgtgcca

SEQ ID NO: 43732 - DNA, 20 bp, Artificial Sequence
  Description of Artificial Sequence: Synthetic oligonucleotide
  Target: ATXN1; (-) strand; PAM type: NRG; PAM sequence: CAG
tcctcacgtccgacctgtgc

SEQ ID NO: 43733 - DNA, 20 bp, Artificial Sequence
  Description of Artificial Sequence: Synthetic oligonucleotide
  Target: ATXN1; (-) strand; PAM type: NRG; PAM sequence: CAG
caaaagcatgttagtgctct

SEQ ID NO: 43734 - DNA, 20 bp, Artificial Sequence
  Description of Artificial Sequence: Synthetic oligonucleotide
  Target: ATXN1; (-) strand; PAM type: NRG; PAM sequence: TAG
agcttgtttcaaaagcatgt

SEQ ID NO: 43735 - DNA, 20 bp, Artificial Sequence
  Description of Artificial Sequence: Synthetic oligonucleotide
  Target: ATXN1; (-) strand; PAM type: NRG; PAM sequence: AAG
agggagagagcttgtttcaa

SEQ ID NO: 43736 - DNA, 20 bp, Artificial Sequence
  Description of Artificial Sequence: Synthetic oligonucleotide
  Target: ATXN1; (-) strand; PAM type: NRG; PAM sequence: GAG
cttgtgacactagagggaga

SEQ ID NO: 43737 - DNA, 20 bp, Artificial Sequence
  Description of Artificial Sequence: Synthetic oligonucleotide
  Target: ATXN1; (-) strand; PAM type: NRG; PAM sequence: GAG
ttcttgtgacactagaggga

SEQ ID NO: 43738 - DNA, 20 bp, Artificial Sequence
  Description of Artificial Sequence: Synthetic oligonucleotide
  Target: ATXN1; (-) strand; PAM type: NRG; PAM sequence: GAG
gcttcttgtgacactagagg

SEQ ID NO: 43739 - DNA, 20 bp, Artificial Sequence
  Description of Artificial Sequence: Synthetic oligonucleotide
  Target: ATXN1; (-) strand; PAM type: NRG; PAM sequence: GGG
ttgcttcttgtgacactaga

SEQ ID NO: 43740 - DNA, 20 bp, Artificial Sequence
  Description of Artificial Sequence: Synthetic oligonucleotide
  Target: ATXN1; (-) strand; PAM type: NRG; PAM sequence: AGG
cttgcttcttgtgacactag

SEQ ID NO: 43741 - DNA, 20 bp, Artificial Sequence
  Description of Artificial Sequence: Synthetic oligonucleotide
  Target: ATXN1; (-) strand; PAM type: NRG; PAM sequence: GAG
acttgcttcttgtgacacta

SEQ ID NO: 43742 - DNA, 20 bp, Artificial Sequence
  Description of Artificial Sequence: Synthetic oligonucleotide
  Target: ATXN1; (-) strand; PAM type: NRG; PAM sequence: TAG
gaacttgcttcttgtgacac

SEQ ID NO: 43743 - DNA, 20 bp, Artificial Sequence
  Description of Artificial Sequence: Synthetic oligonucleotide
  Target: ATXN1; (-) strand; PAM type: NRG; PAM sequence: AGG
gggagcctgtgccaggttgc

SEQ ID NO: 43744 - DNA, 20 bp, Artificial Sequence
  Description of Artificial Sequence: Synthetic oligonucleotide
  Target: ATXN1; (-) strand; PAM type: NRG; PAM sequence: CAG
ggggagcctgtgccaggttg

SEQ ID NO: 43745 - DNA, 20 bp, Artificial Sequence
  Description of Artificial Sequence: Synthetic oligonucleotide
  Target: ATXN1; (-) strand; PAM type: NRG; PAM sequence: AGG
gactcaggggagcctgtgcc

SEQ ID NO: 43746 - DNA, 20 bp, Artificial Sequence
  Description of Artificial Sequence: Synthetic oligonucleotide
  Target: ATXN1; (-) strand; PAM type: NRG; PAM sequence: CAG
ggactcaggggagcctgtgc

SEQ ID NO: 43747 - DNA, 20 bp, Artificial Sequence
  Description of Artificial Sequence: Synthetic oligonucleotide
  Target: ATXN1; (-) strand; PAM type: NRG; PAM sequence: GAG
tggctgccacggactcaggg

SEQ ID NO: 43748 - DNA, 20 bp, Artificial Sequence
  Description of Artificial Sequence: Synthetic oligonucleotide
  Target: ATXN1; (-) strand; PAM type: NRG; PAM sequence: GGG
gctggctgccacggactcag

SEQ ID NO: 43749 - DNA, 20 bp, Artificial Sequence
  Description of Artificial Sequence: Synthetic oligonucleotide
  Target: ATXN1; (-) strand; PAM type: NRG; PAM sequence: GGG
tgctggctgccacggactca

SEQ ID NO: 43750 - DNA, 20 bp, Artificial Sequence
  Description of Artificial Sequence: Synthetic oligonucleotide
  Target: ATXN1; (-) strand; PAM type: NRG; PAM sequence: AGG
ctgctggctgccacggactc

SEQ ID NO: 43751 - DNA, 20 bp, Artificial Sequence
  Description of Artificial Sequence: Synthetic oligonucleotide
  Target: ATXN1; (-) strand; PAM type: NRG; PAM sequence: CAG
gctgctggctgccacggact

SEQ ID NO: 43752 - DNA, 20 bp, Artificial Sequence
  Description of Artificial Sequence: Synthetic oligonucleotide
  Target: ATXN1; (-) strand; PAM type: NRG; PAM sequence: CGG
gtgtgtgctgctggctgcca

SEQ ID NO: 43753 - DNA, 20 bp, Artificial Sequence
  Description of Artificial Sequence: Synthetic oligonucleotide
  Target: ATXN1; (-) strand; PAM type: NRG; PAM sequence: TGG
gaaaatgtggtgtgtgctgc

SEQ ID NO: 43754 - DNA, 20 bp, Artificial Sequence
  Description of Artificial Sequence: Synthetic oligonucleotide
  Target: ATXN1; (-) strand; PAM type: NRG; PAM sequence: TGG
cctcaaagaaaaggaaaatg

SEQ ID NO: 43755 - DNA, 20 bp, Artificial Sequence
  Description of Artificial Sequence: Synthetic oligonucleotide
  Target: ATXN1; (-) strand; PAM type: NRG; PAM sequence: AGG
aaggtcttgcctcaaagaaa

SEQ ID NO: 43756 - DNA, 20 bp, Artificial Sequence
  Description of Artificial Sequence: Synthetic oligonucleotide
  Target: ATXN1; (-) strand; PAM type: NRG; PAM sequence: AAG
gaaggtcttgcctcaaagaa

SEQ ID NO: 43757 - DNA, 20 bp, Artificial Sequence
  Description of Artificial Sequence: Synthetic oligonucleotide
  Target: ATXN1; (-) strand; PAM type: NRG; PAM sequence: AAG
cccaggaaggtcttgcctca

SEQ ID NO: 43758 - DNA, 20 bp, Artificial Sequence
  Description of Artificial Sequence: Synthetic oligonucleotide
  Target: ATXN1; (-) strand; PAM type: NRG; PAM sequence: AGG
tgacccaaccacccccagga

SEQ ID NO: 43759 - DNA, 20 bp, Artificial Sequence
  Description of Artificial Sequence: Synthetic oligonucleotide
  Target: ATXN1; (-) strand; PAM type: NRG; PAM sequence: AAG
ctgacccaaccacccccagg

SEQ ID NO: 43760 - DNA, 20 bp, Artificial Sequence
  Description of Artificial Sequence: Synthetic oligonucleotide
  Target: ATXN1; (-) strand; PAM type: NRG; PAM sequence: AGG
cccctgacccaaccaccccc

SEQ ID NO: 43761 - DNA, 20 bp, Artificial Sequence
  Description of Artificial Sequence: Synthetic oligonucleotide
  Target: ATXN1; (-) strand; PAM type: NRG; PAM sequence: CAG
tcccctgacccaaccacccc

SEQ ID NO: 43762 - DNA, 20 bp, Artificial Sequence
  Description of Artificial Sequence: Synthetic oligonucleotide
  Target: ATXN1; (-) strand; PAM type: NRG; PAM sequence: CAG
ccagctggcagtggtagtgg

SEQ ID NO: 43763 - DNA, 20 bp, Artificial Sequence
  Description of Artificial Sequence: Synthetic oligonucleotide
  Target: ATXN1; (-) strand; PAM type: NRG; PAM sequence: TGG
gtcccagctggcagtggtag

SEQ ID NO: 43764 - DNA, 20 bp, Artificial Sequence
  Description of Artificial Sequence: Synthetic oligonucleotide
  Target: ATXN1; (-) strand; PAM type: NRG; PAM sequence: TAG
gcagtcccagctggcagtgg

SEQ ID NO: 43765 - DNA, 20 bp, Artificial Sequence
  Description of Artificial Sequence: Synthetic oligonucleotide
  Target: ATXN1; (-) strand; PAM type: NRG; PAM sequence: TGG
actgcagtcccagctggcag

SEQ ID NO: 43766 - DNA, 20 bp, Artificial Sequence
  Description of Artificial Sequence: Synthetic oligonucleotide
  Target: ATXN1; (-) strand; PAM type: NRG; PAM sequence: CAG
cccactgcagtcccagctgg

SEQ ID NO: 43767 - DNA, 20 bp, Artificial Sequence
  Description of Artificial Sequence: Synthetic oligonucleotide
  Target: ATXN1; (-) strand; PAM type: NRG; PAM sequence: TGG
tgacccactgcagtcccagc

SEQ ID NO: 43768 - DNA, 20 bp, Artificial Sequence
  Description of Artificial Sequence: Synthetic oligonucleotide
  Target: ATXN1; (-) strand; PAM type: NRG; PAM sequence: CAG
tgcttgacccactgcagtcc

SEQ ID NO: 43769 - DNA, 20 bp, Artificial Sequence
  Description of Artificial Sequence: Synthetic oligonucleotide
  Target: ATXN1; (-) strand; PAM type: NRG; PAM sequence: CAG
tgcctttgcttgacccactg

SEQ ID NO: 43770 - DNA, 20 bp, Artificial Sequence
  Description of Artificial Sequence: Synthetic oligonucleotide
  Target: ATXN1; (-) strand; PAM type: NRG; PAM sequence: GGG
tgctgataatataagtagtg

SEQ ID NO: 43771 - DNA, 20 bp, Artificial Sequence
  Description of Artificial Sequence: Synthetic oligonucleotide
  Target: ATXN1; (-) strand; PAM type: NRG; PAM sequence: GGG
gtgctgataatataagtagt

SEQ ID NO: 43772 - DNA, 20 bp, Artificial Sequence
  Description of Artificial Sequence: Synthetic oligonucleotide
  Target: ATXN1; (-) strand; PAM type: NRG; PAM sequence: TGG
ggtgctgataatataagtag

SEQ ID NO: 43773 - DNA, 20 bp, Artificial Sequence
  Description of Artificial Sequence: Synthetic oligonucleotide
  Target: ATXN1; (-) strand; PAM type: NRG; PAM sequence: TAG
cgtggtgctgataatataag

SEQ ID NO: 43774 - DNA, 20 bp, Artificial Sequence
  Description of Artificial Sequence: Synthetic oligonucleotide
  Target: ATXN1; (-) strand; PAM type: NRG; PAM sequence: AAG
attcgtggtgctgataatat

SEQ ID NO: 43775 - DNA, 20 bp, Artificial Sequence
  Description of Artificial Sequence: Synthetic oligonucleotide
  Target: ATXN1; (-) strand; PAM type: NRG; PAM sequence: TGG
tcaaaaaacactactattcg

SEQ ID NO: 43776 - DNA, 20 bp, Artificial Sequence
  Description of Artificial Sequence: Synthetic oligonucleotide
  Target: ATXN1; (-) strand; PAM type: NRG; PAM sequence: GGG
aaaaagtctatagatgcatg

SEQ ID NO: 43777 - DNA, 20 bp, Artificial Sequence
  Description of Artificial Sequence: Synthetic oligonucleotide
  Target: ATXN1; (-) strand; PAM type: NRG; PAM sequence: GGG
caaaaagtctatagatgcat

SEQ ID NO: 43778 - DNA, 20 bp, Artificial Sequence
  Description of Artificial Sequence: Synthetic oligonucleotide
  Target: ATXN1; (-) strand; PAM type: NRG; PAM sequence: TGG
ccaaaaagtctatagatgca

SEQ ID NO: 43779 - DNA, 20 bp, Artificial Sequence
  Description of Artificial Sequence: Synthetic oligonucleotide
  Target: ATXN1; (-) strand; PAM type: NRG; PAM sequence: TAG
tccattgcccaaaaagtcta

SEQ ID NO: 43780 - DNA, 20 bp, Artificial Sequence
  Description of Artificial Sequence: Synthetic oligonucleotide
  Target: ATXN1; (-) strand; PAM type: NRG; PAM sequence: AAG
agtcgtatccattgcccaaa

SEQ ID NO: 43781 - DNA, 20 bp, Artificial Sequence
  Description of Artificial Sequence: Synthetic oligonucleotide
  Target: ATXN1; (-) strand; PAM type: NRG; PAM sequence: TAG
tttaatcattgcttcaagta

SEQ ID NO: 43782 - DNA, 20 bp, Artificial Sequence
  Description of Artificial Sequence: Synthetic oligonucleotide
  Target: ATXN1; (-) strand; PAM type: NRG; PAM sequence: AAG
aattttttaatcattgcttc

SEQ ID NO: 43783 - DNA, 20 bp, Artificial Sequence
  Description of Artificial Sequence: Synthetic oligonucleotide
  Target: ATXN1; (-) strand; PAM type: NRG; PAM sequence: TGG
aatgagactattattttggg

SEQ ID NO: 43784 - DNA, 20 bp, Artificial Sequence
  Description of Artificial Sequence: Synthetic oligonucleotide
  Target: ATXN1; (-) strand; PAM type: NRG; PAM sequence: GGG
ccgaatgagactattatttt

SEQ ID NO: 43785 - DNA, 20 bp, Artificial Sequence
  Description of Artificial Sequence: Synthetic oligonucleotide
  Target: ATXN1; (-) strand; PAM type: NRG; PAM sequence: TGG
cccgaatgagactattattt

SEQ ID NO: 43786 - DNA, 20 bp, Artificial Sequence
  Description of Artificial Sequence: Synthetic oligonucleotide
  Target: ATXN1; (-) strand; PAM type: NRG; PAM sequence: GAG
aagccagcgaccacccgaat

SEQ ID NO: 43787 - DNA, 20 bp, Artificial Sequence
  Description of Artificial Sequence: Synthetic oligonucleotide
  Target: ATXN1; (-) strand; PAM type: NRG; PAM sequence: CAG
ggacgcagagctacccaagc

SEQ ID NO: 43788 - DNA, 20 bp, Artificial Sequence
  Description of Artificial Sequence: Synthetic oligonucleotide
  Target: ATXN1; (-) strand; PAM type: NRG; PAM sequence: AAG
cactggacgcagagctaccc

SEQ ID NO: 43789 - DNA, 20 bp, Artificial Sequence
  Description of Artificial Sequence: Synthetic oligonucleotide
  Target: ATXN1; (-) strand; PAM type: NRG; PAM sequence: GAG
acaactccccactggacgca

SEQ ID NO: 43790 - DNA, 20 bp, Artificial Sequence
  Description of Artificial Sequence: Synthetic oligonucleotide
  Target: ATXN1; (-) strand; PAM type: NRG; PAM sequence: CAG
gaacaactccccactggacg

SEQ ID NO: 43791 - DNA, 20 bp, Artificial Sequence
  Description of Artificial Sequence: Synthetic oligonucleotide
  Target: ATXN1; (-) strand; PAM type: NRG; PAM sequence: TGG
atcaaagaacaactccccac

SEQ ID NO: 43792 - DNA, 20 bp, Artificial Sequence
  Description of Artificial Sequence: Synthetic oligonucleotide
  Target: ATXN1; (-) strand; PAM type: NRG; PAM sequence: AAG
cccttcaaggcccttaatca

SEQ ID NO: 43793 - DNA, 20 bp, Artificial Sequence
  Description of Artificial Sequence: Synthetic oligonucleotide
  Target: ATXN1; (-) strand; PAM type: NRG; PAM sequence: AGG
tctttccagcctccccttca

SEQ ID NO: 43794 - DNA, 20 bp, Artificial Sequence
  Description of Artificial Sequence: Synthetic oligonucleotide
  Target: ATXN1; (-) strand; PAM type: NRG; PAM sequence: AAG
ttctttccagcctccccttc

SEQ ID NO: 43795 - DNA, 20 bp, Artificial Sequence
  Description of Artificial Sequence: Synthetic oligonucleotide
  Target: ATXN1; (-) strand; PAM type: NRG; PAM sequence: CAG
gtgtcttgaggaattctttc

SEQ ID NO: 43796 - DNA, 20 bp, Artificial Sequence
  Description of Artificial Sequence: Synthetic oligonucleotide
  Target: ATXN1; (-) strand; PAM type: NRG; PAM sequence: AGG
cagtgcagctgtgtgtcttg

SEQ ID NO: 43797 - DNA, 20 bp, Artificial Sequence
  Description of Artificial Sequence: Synthetic oligonucleotide
  Target: ATXN1; (-) strand; PAM type: NRG; PAM sequence: GAG
ccagtgcagctgtgtgtctt

SEQ ID NO: 43798 - DNA, 20 bp, Artificial Sequence
  Description of Artificial Sequence: Synthetic oligonucleotide
  Target: ATXN1; (-) strand; PAM type: NRG; PAM sequence: CAG
cagcagaatggcagccagtg

SEQ ID NO: 43799 - DNA, 20 bp, Artificial Sequence
  Description of Artificial Sequence: Synthetic oligonucleotide
  Target: ATXN1; (-) strand; PAM type: NRG; PAM sequence: CAG
aagttcagcagaatggcagc

SEQ ID NO: 43800 - DNA, 20 bp, Artificial Sequence
  Description of Artificial Sequence: Synthetic oligonucleotide
  Target: ATXN1; (-) strand; PAM type: NRG; PAM sequence: CAG
agacaagttcagcagaatgg

SEQ ID NO: 43801 - DNA, 20 bp, Artificial Sequence
  Description of Artificial Sequence: Synthetic oligonucleotide
  Target: ATXN1; (-) strand; PAM type: NRG; PAM sequence: TGG
agcagacaagttcagcagaa

SEQ ID NO: 43802 - DNA, 20 bp, Artificial Sequence
  Description of Artificial Sequence: Synthetic oligonucleotide
  Target: ATXN1; (-) strand; PAM type: NRG; PAM sequence: CAG
tgccaagcagacaagttcag

SEQ ID NO: 43803 - DNA, 20 bp, Artificial Sequence
  Description of Artificial Sequence: Synthetic oligonucleotide
  Target: ATXN1; (-) strand; PAM type: NRG; PAM sequence: CAG
acgtgccaagcagacaagtt

SEQ ID NO: 43804 - DNA, 20 bp, Artificial Sequence
  Description of Artificial Sequence: Synthetic oligonucleotide
  Target: ATXN1; (-) strand; PAM type: NRG; PAM sequence: AAG
taaccacgtgccaagcagac

SEQ ID NO: 43805 - DNA, 20 bp, Artificial Sequence
  Description of Artificial Sequence: Synthetic oligonucleotide
  Target: ATXN1; (-) strand; PAM type: NRG; PAM sequence: CAG
caacttaaccacgtgccaag

SEQ ID NO: 43806 - DNA, 20 bp, Artificial Sequence
  Description of Artificial Sequence: Synthetic oligonucleotide
  Target: ATXN1; (-) strand; PAM type: NRG; PAM sequence: AAG
cagcaacttaaccacgtgcc

SEQ ID NO: 43807 - DNA, 20 bp, Artificial Sequence
  Description of Artificial Sequence: Synthetic oligonucleotide
  Target: ATXN1; (-) strand; PAM type: NRG; PAM sequence: CAG
ccacttagggataagggaga

SEQ ID NO: 43808 - DNA, 20 bp, Artificial Sequence
  Description of Artificial Sequence: Synthetic oligonucleotide
  Target: ATXN1; (-) strand; PAM type: NRG; PAM sequence: GAG
agccccacttagggataagg

SEQ ID NO: 43809 - DNA, 20 bp, Artificial Sequence
  Description of Artificial Sequence: Synthetic oligonucleotide
  Target: ATXN1; (-) strand; PAM type: NRG; PAM sequence: GGG
tcagccccacttagggataa

SEQ ID NO: 43810 - DNA, 20 bp, Artificial Sequence
  Description of Artificial Sequence: Synthetic oligonucleotide
  Target: ATXN1; (-) strand; PAM type: NRG; PAM sequence: AGG
ctcagccccacttagggata

SEQ ID NO: 43811 - DNA, 20 bp, Artificial Sequence
  Description of Artificial Sequence: Synthetic oligonucleotide
  Target: ATXN1; (-) strand; PAM type: NRG; PAM sequence: AAG
actcagccccacttagggat

SEQ ID NO: 43812 - DNA, 20 bp, Artificial Sequence
  Description of Artificial Sequence: Synthetic oligonucleotide
  Target: ATXN1; (-) strand; PAM type: NRG; PAM sequence: GGG
aaatcactcagccccactta

SEQ ID NO: 43813 - DNA, 20 bp, Artificial Sequence
  Description of Artificial Sequence: Synthetic oligonucleotide
  Target: ATXN1; (-) strand; PAM type: NRG; PAM sequence: AGG
caaatcactcagccccactt

SEQ ID NO: 43814 - DNA, 20 bp, Artificial Sequence
  Description of Artificial Sequence: Synthetic oligonucleotide
  Target: ATXN1; (-) strand; PAM type: NRG; PAM sequence: TAG
gcaaatcactcagccccact

SEQ ID NO: 43815 - DNA, 20 bp, Artificial Sequence
  Description of Artificial Sequence: Synthetic oligonucleotide
  Target: ATXN1; (-) strand; PAM type: NRG; PAM sequence: CAG
acaggtagtagcaaatcact

SEQ ID NO: 43816 - DNA, 20 bp, Artificial Sequence
  Description of Artificial Sequence: Synthetic oligonucleotide
  Target: ATXN1; (-) strand; PAM type: NRG; PAM sequence: TAG
tccattatgtggacaggtag

SEQ ID NO: 43817 - DNA, 20 bp, Artificial Sequence
  Description of Artificial Sequence: Synthetic oligonucleotide
  Target: ATXN1; (-) strand; PAM type: NRG; PAM sequence: TAG
ccctccattatgtggacagg

SEQ ID NO: 43818 - DNA, 20 bp, Artificial Sequence
  Description of Artificial Sequence: Synthetic oligonucleotide
  Target: ATXN1; (-) strand; PAM type: NRG; PAM sequence: AGG
tggccctccattatgtggac

SEQ ID NO: 43819 - DNA, 20 bp, Artificial Sequence
  Description of Artificial Sequence: Synthetic oligonucleotide
  Target: ATXN1; (-) strand; PAM type: NRG; PAM sequence: CAG
ctggccctccattatgtgga

SEQ ID NO: 43820 - DNA, 20 bp, Artificial Sequence
  Description of Artificial Sequence: Synthetic oligonucleotide
  Target: ATXN1; (-) strand; PAM type: NRG; PAM sequence: TGG
aagcctggccctccattatg

SEQ ID NO: 43821 - DNA, 20 bp, Artificial Sequence
  Description of Artificial Sequence: Synthetic oligonucleotide
  Target: ATXN1; (-) strand; PAM type: NRG; PAM sequence: TGG
atctaagaattgatgaagcc

SEQ ID NO: 43822 - DNA, 20 bp, Artificial Sequence
  Description of Artificial Sequence: Synthetic oligonucleotide
  Target: ATXN1; (-) strand; PAM type: NRG; PAM sequence: AAG
caggaatctaagaattgatg

SEQ ID NO: 43823 - DNA, 20 bp, Artificial Sequence
  Description of Artificial Sequence: Synthetic oligonucleotide
  Target: ATXN1; (-) strand; PAM type: NRG; PAM sequence: AAG
atggcagaagccaggaatct

SEQ ID NO: 43824 - DNA, 20 bp, Artificial Sequence
  Description of Artificial Sequence: Synthetic oligonucleotide
  Target: ATXN1; (-) strand; PAM type: NRG; PAM sequence: AGG
gaatagcaatggcagaagcc

SEQ ID NO: 43825 - DNA, 20 bp, Artificial Sequence
  Description of Artificial Sequence: Synthetic oligonucleotide
  Target: ATXN1; (-) strand; PAM type: NRG; PAM sequence: CAG
cgaatagcaatggcagaagc

SEQ ID NO: 43826 - DNA, 20 bp, Artificial Sequence
  Description of Artificial Sequence: Synthetic oligonucleotide
  Target: ATXN1; (-) strand; PAM type: NRG; PAM sequence: AAG
actacgaatagcaatggcag

SEQ ID NO: 43827 - DNA, 20 bp, Artificial Sequence
  Description of Artificial Sequence: Synthetic oligonucleotide
  Target: ATXN1; (-) strand; PAM type: NRG; PAM sequence: CAG
ctcactacgaatagcaatgg

SEQ ID NO: 43828 - DNA, 20 bp, Artificial Sequence
  Description of Artificial Sequence: Synthetic oligonucleotide
  Target: ATXN1; (-) strand; PAM type: NRG; PAM sequence: TGG
ctgctcactacgaatagcaa

SEQ ID NO: 43829 - DNA, 20 bp, Artificial Sequence
  Description of Artificial Sequence: Synthetic oligonucleotide
  Target: ATXN1; (-) strand; PAM type: NRG; PAM sequence: TAG
tgtcatctgctcactacgaa

SEQ ID NO: 43830 - DNA, 20 bp, Artificial Sequence
  Description of Artificial Sequence: Synthetic oligonucleotide
  Target: ATXN1; (-) strand; PAM type: NRG; PAM sequence: CAG
gagctcactaactgcacccc

SEQ ID NO: 43831 - DNA, 20 bp, Artificial Sequence
  Description of Artificial Sequence: Synthetic oligonucleotide
  Target: ATXN1; (-) strand; PAM type: NRG; PAM sequence: GAG
tgatgtttccaggggtggca

SEQ ID NO: 43832 - DNA, 20 bp, Artificial Sequence
  Description of Artificial Sequence: Synthetic oligonucleotide
  Target: ATXN1; (-) strand; PAM type: NRG; PAM sequence: CAG
cctgatgtttccaggggtgg

SEQ ID NO: 43833 - DNA, 20 bp, Artificial Sequence
  Description of Artificial Sequence: Synthetic oligonucleotide
  Target: ATXN1; (-) strand; PAM type: NRG; PAM sequence: TGG
tgtcctgatgtttccagggg

SEQ ID NO: 43834 - DNA, 20 bp, Artificial Sequence
  Description of Artificial Sequence: Synthetic oligonucleotide
  Target: ATXN1; (-) strand; PAM type: NRG; PAM sequence: GGG
cgatgtcctgatgtttccag

SEQ ID NO: 43835 - DNA, 20 bp, Artificial Sequence
  Description of Artificial Sequence: Synthetic oligonucleotide
  Target: ATXN1; (-) strand; PAM type: NRG; PAM sequence: GGG
ccgatgtcctgatgtttcca

SEQ ID NO: 43836 - DNA, 20 bp, Artificial Sequence
  Description of Artificial Sequence: Synthetic oligonucleotide
  Target: ATXN1; (-) strand; PAM type: NRG; PAM sequence: AGG
gccgatgtcctgatgtttcc

SEQ ID NO: 43837 - DNA, 20 bp, Artificial Sequence
  Description of Artificial Sequence: Synthetic oligonucleotide
  Target: ATXN1; (-) strand; PAM type: NRG; PAM sequence: CAG
ggccgatgtcctgatgtttc

SEQ ID NO: 43838 - DNA, 20 bp, Artificial Sequence
  Description of Artificial Sequence: Synthetic oligonucleotide
  Target: ATXN1; (-) strand; PAM type: NRG; PAM sequence: TGG
gcagggggaccccagccaca

SEQ ID NO: 43839 - DNA, 20 bp, Artificial Sequence
  Description of Artificial Sequence: Synthetic oligonucleotide
  Target: ATXN1; (-) strand; PAM type: NRG; PAM sequence: CAG
tgagccacgcagggggaccc

SEQ ID NO: 43840 - DNA, 20 bp, Artificial Sequence
  Description of Artificial Sequence: Synthetic oligonucleotide
  Target: ATXN1; (-) strand; PAM type: NRG; PAM sequence: GGG
tgtgccatgagccacgcagg

SEQ ID NO: 43841 - DNA, 20 bp, Artificial Sequence
  Description of Artificial Sequence: Synthetic oligonucleotide
  Target: ATXN1; (-) strand; PAM type: NRG; PAM sequence: GGG
atgtgccatgagccacgcag

SEQ ID NO: 43842 - DNA, 20 bp, Artificial Sequence
  Description of Artificial Sequence: Synthetic oligonucleotide
  Target: ATXN1; (-) strand; PAM type: NRG; PAM sequence: GGG
catgtgccatgagccacgca

SEQ ID NO: 43843 - DNA, 20 bp, Artificial Sequence
  Description of Artificial Sequence: Synthetic oligonucleotide
  Target: ATXN1; (-) strand; PAM type: NRG; PAM sequence: AGG
acatgtgccatgagccacgc

SEQ ID NO: 43844 - DNA, 20 bp, Artificial Sequence
  Description of Artificial Sequence: Synthetic oligonucleotide
  Target: ATXN1; (-) strand; PAM type: NRG; PAM sequence: CAG
gacatgtgccatgagccacg

SEQ ID NO: 43845 - DNA, 20 bp, Artificial Sequence
  Description of Artificial Sequence: Synthetic oligonucleotide
  Target: ATXN1; (-) strand; PAM type: NRG; PAM sequence: GAG
ctctcacggacatgtgccat

SEQ ID NO: 43846 - DNA, 20 bp, Artificial Sequence
  Description of Artificial Sequence: Synthetic oligonucleotide
  Target: ATXN1; (-) strand; PAM type: NRG; PAM sequence: CGG
ggctgatcctccagctctca

SEQ ID NO: 43847 - DNA, 20 bp, Artificial Sequence
  Description of Artificial Sequence: Synthetic oligonucleotide
  Target: ATXN1; (-) strand; PAM type: NRG; PAM sequence: CAG
cctcatccaggctgatcctc

SEQ ID NO: 43848 - DNA, 20 bp, Artificial Sequence
  Description of Artificial Sequence: Synthetic oligonucleotide
  Target: ATXN1; (-) strand; PAM type: NRG; PAM sequence: AGG
cccctcctccttcctcatcc

SEQ ID NO: 43849 - DNA, 20 bp, Artificial Sequence
  Description of Artificial Sequence: Synthetic oligonucleotide
  Target: ATXN1; (-) strand; PAM type: NRG; PAM sequence: CAG
gcccctcctccttcctcatc

SEQ ID NO: 43850 - DNA, 20 bp, Artificial Sequence
  Description of Artificial Sequence: Synthetic oligonucleotide
  Target: ATXN1; (-) strand; PAM type: NRG; PAM sequence: TGG
gggatggcccagccaagctg

SEQ ID NO: 43851 - DNA, 20 bp, Artificial Sequence
  Description of Artificial Sequence: Synthetic oligonucleotide
  Target: ATXN1; (-) strand; PAM type: NRG; PAM sequence: AAG
cttctagggatggcccagcc

SEQ ID NO: 43852 - DNA, 20 bp, Artificial Sequence
  Description of Artificial Sequence: Synthetic oligonucleotide
  Target: ATXN1; (-) strand; PAM type: NRG; PAM sequence: CAG
gccggcttctagggatggcc

SEQ ID NO: 43853 - DNA, 20 bp, Artificial Sequence
  Description of Artificial Sequence: Synthetic oligonucleotide
  Target: ATXN1; (-) strand; PAM type: NRG; PAM sequence: TGG
tgtgagccggcttctaggga

SEQ ID NO: 43854 - DNA, 20 bp, Artificial Sequence
  Description of Artificial Sequence: Synthetic oligonucleotide
  Target: ATXN1; (-) strand; PAM type: NRG; PAM sequence: GGG
tccatgtgagccggcttcta

SEQ ID NO: 43855 - DNA, 20 bp, Artificial Sequence
  Description of Artificial Sequence: Synthetic oligonucleotide
  Target: ATXN1; (-) strand; PAM type: NRG; PAM sequence: AGG
ttccatgtgagccggcttct

SEQ ID NO: 43856 - DNA, 20 bp, Artificial Sequence
  Description of Artificial Sequence: Synthetic oligonucleotide
  Target: ATXN1; (-) strand; PAM type: NRG; PAM sequence: TAG
tttccatgtgagccggcttc

SEQ ID NO: 43857 - DNA, 20 bp, Artificial Sequence
  Description of Artificial Sequence: Synthetic oligonucleotide
  Target: ATXN1; (-) strand; PAM type: NRG; PAM sequence: CGG
agcgcgttttccatgtgagc

SEQ ID NO: 43858 - DNA, 20 bp, Artificial Sequence
  Description of Artificial Sequence: Synthetic oligonucleotide
  Target: ATXN1; (-) strand; PAM type: NRG; PAM sequence: GAG
ctgcagcgcgttttccatgt

SEQ ID NO: 43859 - DNA, 20 bp, Artificial Sequence
  Description of Artificial Sequence: Synthetic oligonucleotide
  Target: ATXN1; (-) strand; PAM type: NRG; PAM sequence: CAG
cactggctacacagccactg

SEQ ID NO: 43860 - DNA, 20 bp, Artificial Sequence
  Description of Artificial Sequence: Synthetic oligonucleotide
  Target: ATXN1; (-) strand; PAM type: NRG; PAM sequence: CAG
cgccagagacactggctaca

SEQ ID NO: 43861 - DNA, 20 bp, Artificial Sequence
  Description of Artificial Sequence: Synthetic oligonucleotide
  Target: ATXN1; (-) strand; PAM type: NRG; PAM sequence: TGG
gggcaggccgccagagacac

SEQ ID NO: 43862 - DNA, 20 bp, Artificial Sequence
  Description of Artificial Sequence: Synthetic oligonucleotide
  Target: ATXN1; (-) strand; PAM type: NRG; PAM sequence: GAG
ccggcatgggcaggccgcca

SEQ ID NO: 43863 - DNA, 20 bp, Artificial Sequence
  Description of Artificial Sequence: Synthetic oligonucleotide
  Target: ATXN1; (-) strand; PAM type: NRG; PAM sequence: CAG
ttccggcatgggcaggccgc

SEQ ID NO: 43864 - DNA, 20 bp, Artificial Sequence
  Description of Artificial Sequence: Synthetic oligonucleotide
  Target: ATXN1; (-) strand; PAM type: NRG; PAM sequence: AGG
ccaggaattccggcatgggc

SEQ ID NO: 43865 - DNA, 20 bp, Artificial Sequence
  Description of Artificial Sequence: Synthetic oligonucleotide
  Target: ATXN1; (-) strand; PAM type: NRG; PAM sequence: CAG
tccaggaattccggcatggg

SEQ ID NO: 43866 - DNA, 20 bp, Artificial Sequence
  Description of Artificial Sequence: Synthetic oligonucleotide
  Target: ATXN1; (-) strand; PAM type: NRG; PAM sequence: GGG
ctttccaggaattccggcat

SEQ ID NO: 43867 - DNA, 20 bp, Artificial Sequence
  Description of Artificial Sequence: Synthetic oligonucleotide
  Target: ATXN1; (-) strand; PAM type: NRG; PAM sequence: TGG
cctttccaggaattccggca

SEQ ID NO: 43868 - DNA, 20 bp, Artificial Sequence
  Description of Artificial Sequence: Synthetic oligonucleotide
  Target: ATXN1; (-) strand; PAM type: NRG; PAM sequence: CGG
ttgagcctttccaggaattc

SEQ ID NO: 43869 - DNA, 20 bp, Artificial Sequence
  Description of Artificial Sequence: Synthetic oligonucleotide
  Target: ATXN1; (-) strand; PAM type: NRG; PAM sequence: AGG
tttccatcttgagcctttcc

SEQ ID NO: 43870 - DNA, 20 bp, Artificial Sequence
  Description of Artificial Sequence: Synthetic oligonucleotide
  Target: ATXN1; (-) strand; PAM type: NRG; PAM sequence: CAG
ttttccatcttgagcctttc

SEQ ID NO: 43871 - DNA, 20 bp, Artificial Sequence
  Description of Artificial Sequence: Synthetic oligonucleotide
  Target: ATXN1; (-) strand; PAM type: NRG; PAM sequence: GAG
gatggttatttttccatctt

SEQ ID NO: 43872 - DNA, 20 bp, Artificial Sequence
  Description of Artificial Sequence: Synthetic oligonucleotide
  Target: ATXN1; (-) strand; PAM type: NRG; PAM sequence: TGG
gggaccagcttggatccaga

SEQ ID NO: 43873 - DNA, 20 bp, Artificial Sequence
  Description of Artificial Sequence: Synthetic oligonucleotide
  Target: ATXN1; (-) strand; PAM type: NRG; PAM sequence: CAG
atttgggaccagcttggatc

SEQ ID NO: 43874 - DNA, 20 bp, Artificial Sequence
  Description of Artificial Sequence: Synthetic oligonucleotide
  Target: ATXN1; (-) strand; PAM type: NRG; PAM sequence: TGG
caattcatttgggaccagct

SEQ ID NO: 43875 - DNA, 20 bp, Artificial Sequence
  Description of Artificial Sequence: Synthetic oligonucleotide
  Target: ATXN1; (-) strand; PAM type: NRG; PAM sequence: CAG
tcagacaattcatttgggac

SEQ ID NO: 43876 - DNA, 20 bp, Artificial Sequence
  Description of Artificial Sequence: Synthetic oligonucleotide
  Target: ATXN1; (-) strand; PAM type: NRG; PAM sequence: GGG
ctctgtcagacaattcattt

SEQ ID NO: 43877 - DNA, 20 bp, Artificial Sequence
  Description of Artificial Sequence: Synthetic oligonucleotide
  Target: ATXN1; (-) strand; PAM type: NRG; PAM sequence: TGG
cctctgtcagacaattcatt

SEQ ID NO: 43878 - DNA, 20 bp, Artificial Sequence
  Description of Artificial Sequence: Synthetic oligonucleotide
  Target: ATXN1; (-) strand; PAM type: NRG; PAM sequence: CAG
aactccaactcaacctctgt

SEQ ID NO: 43879 - DNA, 20 bp, Artificial Sequence
  Description of Artificial Sequence: Synthetic oligonucleotide
  Target: ATXN1; (-) strand; PAM type: NRG; PAM sequence: CAG
tcttgacagaaaggcatttc

SEQ ID NO: 43880 - DNA, 20 bp, Artificial Sequence
  Description of Artificial Sequence: Synthetic oligonucleotide
  Target: ATXN1; (-) strand; PAM type: NRG; PAM sequence: AGG
caggaaaggtcttgacagaa

SEQ ID NO: 43881 - DNA, 20 bp, Artificial Sequence
  Description of Artificial Sequence: Synthetic oligonucleotide
  Target: ATXN1; (-) strand; PAM type: NRG; PAM sequence: AAG
tcaggaaaggtcttgacaga

SEQ ID NO: 43882 - DNA, 20 bp, Artificial Sequence
  Description of Artificial Sequence: Synthetic oligonucleotide
  Target: ATXN1; (-) strand; PAM type: NRG; PAM sequence: CAG
tgaatcaggaaaggtcttga

SEQ ID NO: 43883 - DNA, 20 bp, Artificial Sequence
  Description of Artificial Sequence: Synthetic oligonucleotide
  Target: ATXN1; (-) strand; PAM type: NRG; PAM sequence: AGG
cttctgtattgaatcaggaa

SEQ ID NO: 43884 - DNA, 20 bp, Artificial Sequence
  Description of Artificial Sequence: Synthetic oligonucleotide
  Target: ATXN1; (-) strand; PAM type: NRG; PAM sequence: AAG
gcttctgtattgaatcagga

SEQ ID NO: 43885 - DNA, 20 bp, Artificial Sequence
  Description of Artificial Sequence: Synthetic oligonucleotide
  Target: ATXN1; (-) strand; PAM type: NRG; PAM sequence: AGG
atttgcttctgtattgaatc

SEQ ID NO: 43886 - DNA, 20 bp, Artificial Sequence
  Description of Artificial Sequence: Synthetic oligonucleotide
  Target: ATXN1; (-) strand; PAM type: NRG; PAM sequence: CAG
tatttgcttctgtattgaat

SEQ ID NO: 43887 - DNA, 20 bp, Artificial Sequence
  Description of Artificial Sequence: Synthetic oligonucleotide
  Target: ATXN1; (-) strand; PAM type: NRG; PAM sequence: AAG
cactacgctttaaagcaaaa

SEQ ID NO: 43888 - DNA, 20 bp, Artificial Sequence
  Description of Artificial Sequence: Synthetic oligonucleotide
  Target: ATXN1; (-) strand; PAM type: NRG; PAM sequence: AAG
ctggaatgcactacgcttta

SEQ ID NO: 43889 - DNA, 20 bp, Artificial Sequence
  Description of Artificial Sequence: Synthetic oligonucleotide
  Target: ATXN1; (-) strand; PAM type: NRG; PAM sequence: TGG
gtgcccccgggtagctaacc

SEQ ID NO: 43890 - DNA, 20 bp, Artificial Sequence
  Description of Artificial Sequence: Synthetic oligonucleotide
  Target: ATXN1; (-) strand; PAM type: NRG; PAM sequence: TAG
gaaacgtgggtgcccccggg

SEQ ID NO: 43891 - DNA, 20 bp, Artificial Sequence
  Description of Artificial Sequence: Synthetic oligonucleotide
  Target: ATXN1; (-) strand; PAM type: NRG; PAM sequence: GGG
acagaaacgtgggtgccccc

SEQ ID NO: 43892 - DNA, 20 bp, Artificial Sequence
  Description of Artificial Sequence: Synthetic oligonucleotide
  Target: ATXN1; (-) strand; PAM type: NRG; PAM sequence: CGG
aacagaaacgtgggtgcccc

SEQ ID NO: 43893 - DNA, 20 bp, Artificial Sequence
  Description of Artificial Sequence: Synthetic oligonucleotide
  Target: ATXN1; (-) strand; PAM type: NRG; PAM sequence: GGG
tggtggataaacagaaacgt

SEQ ID NO: 43894 - DNA, 20 bp, Artificial Sequence
  Description of Artificial Sequence: Synthetic oligonucleotide
  Target: ATXN1; (-) strand; PAM type: NRG; PAM sequence: TGG
gtggtggataaacagaaacg

SEQ ID NO: 43895 - DNA, 20 bp, Artificial Sequence
  Description of Artificial Sequence: Synthetic oligonucleotide
  Target: ATXN1; (-) strand; PAM type: NRG; PAM sequence: CAG
caaccagagtggtggataaa

SEQ ID NO: 43896 - DNA, 20 bp, Artificial Sequence
  Description of Artificial Sequence: Synthetic oligonucleotide
  Target: ATXN1; (-) strand; PAM type: NRG; PAM sequence: TGG
ccagccttcaaccagagtgg

SEQ ID NO: 43897 - DNA, 20 bp, Artificial Sequence
  Description of Artificial Sequence: Synthetic oligonucleotide
  Target: ATXN1; (-) strand; PAM type: NRG; PAM sequence: TGG
ttcccagccttcaaccagag

SEQ ID NO: 43898 - DNA, 20 bp, Artificial Sequence
  Description of Artificial Sequence: Synthetic oligonucleotide
  Target: ATXN1; (-) strand; PAM type: NRG; PAM sequence: GAG
ctgttcccagccttcaacca

SEQ ID NO: 43899 - DNA, 20 bp, Artificial Sequence
  Description of Artificial Sequence: Synthetic oligonucleotide
  Target: ATXN1; (-) strand; PAM type: NRG; PAM sequence: CAG
aactgttcccagccttcaac

SEQ ID NO: 43900 - DNA, 20 bp, Artificial Sequence
  Description of Artificial Sequence: Synthetic oligonucleotide
  Target: ATXN1; (-) strand; PAM type: NRG; PAM sequence: CAG
agcatctgtgtaactgttcc

SEQ ID NO: 43901 - DNA, 20 bp, Artificial Sequence
  Description of Artificial Sequence: Synthetic oligonucleotide
  Target: ATXN1; (-) strand; PAM type: NRG; PAM sequence: AAG
ctaactccaggcagcgtgga

SEQ ID NO: 43902 - DNA, 20 bp, Artificial Sequence
  Description of Artificial Sequence: Synthetic oligonucleotide
  Target: ATXN1; (-) strand; PAM type: NRG; PAM sequence: TGG
accactaactccaggcagcg

SEQ ID NO: 43903 - DNA, 20 bp, Artificial Sequence
  Description of Artificial Sequence: Synthetic oligonucleotide
  Target: ATXN1; (-) strand; PAM type: NRG; PAM sequence: CAG
tgagaaccactaactccagg

SEQ ID NO: 43904 - DNA, 20 bp, Artificial Sequence
  Description of Artificial Sequence: Synthetic oligonucleotide
  Target: ATXN1; (-) strand; PAM type: NRG; PAM sequence: AGG
ggatgagaaccactaactcc

SEQ ID NO: 43905 - DNA, 20 bp, Artificial Sequence
  Description of Artificial Sequence: Synthetic oligonucleotide
  Target: ATXN1; (-) strand; PAM type: NRG; PAM sequence: CAG
gggatgagaaccactaactc

SEQ ID NO: 43906 - DNA, 20 bp, Artificial Sequence
  Description of Artificial Sequence: Synthetic oligonucleotide
  Target: ATXN1; (-) strand; PAM type: NRG; PAM sequence: GAG
aagttagtctggactgggat

SEQ ID NO: 43907 - DNA, 20 bp, Artificial Sequence
  Description of Artificial Sequence: Synthetic oligonucleotide
  Target: ATXN1; (-) strand; PAM type: NRG; PAM sequence: GGG
gaaacaagttagtctggact

SEQ ID NO: 43908 - DNA, 20 bp, Artificial Sequence
  Description of Artificial Sequence: Synthetic oligonucleotide
  Target: ATXN1; (-) strand; PAM type: NRG; PAM sequence: TGG
tgaaacaagttagtctggac

SEQ ID NO: 43909 - DNA, 20 bp, Artificial Sequence
  Description of Artificial Sequence: Synthetic oligonucleotide
  Target: ATXN1; (-) strand; PAM type: NRG; PAM sequence: TGG
cactttgaaacaagttagtc

SEQ ID NO: 43910 - DNA, 20 bp, Artificial Sequence
  Description of Artificial Sequence: Synthetic oligonucleotide
  Target: ATXN1; (-) strand; PAM type: NRG; PAM sequence: TAG
cctctcactttgaaacaagt

SEQ ID NO: 43911 - DNA, 20 bp, Artificial Sequence
  Description of Artificial Sequence: Synthetic oligonucleotide
  Target: ATXN1; (-) strand; PAM type: NRG; PAM sequence: AAG
acttcctctcactttgaaac

SEQ ID NO: 43912 - DNA, 20 bp, Artificial Sequence
  Description of Artificial Sequence: Synthetic oligonucleotide
  Target: ATXN1; (-) strand; PAM type: NRG; PAM sequence: GGG
ttgaaataagataatgaaga

SEQ ID NO: 43913 - DNA, 20 bp, Artificial Sequence
  Description of Artificial Sequence: Synthetic oligonucleotide
  Target: ATXN1; (-) strand; PAM type: NRG; PAM sequence: AGG
cttgaaataagataatgaag

SEQ ID NO: 43914 - DNA, 20 bp, Artificial Sequence
  Description of Artificial Sequence: Synthetic oligonucleotide
  Target: ATXN1; (-) strand; PAM type: NRG; PAM sequence: GAG
ccttgaaataagataatgaa

SEQ ID NO: 43915 - DNA, 20 bp, Artificial Sequence
  Description of Artificial Sequence: Synthetic oligonucleotide
  Target: ATXN1; (-) strand; PAM type: NRG; PAM sequence: AAG
gtccttgaaataagataatg

SEQ ID NO: 43916 - DNA, 20 bp, Artificial Sequence
  Description of Artificial Sequence: Synthetic oligonucleotide
  Target: ATXN1; (-) strand; PAM type: NRG; PAM sequence: AAG
cttgcatcagtccttgaaat

SEQ ID NO: 43917 - DNA, 20 bp, Artificial Sequence
  Description of Artificial Sequence: Synthetic oligonucleotide
  Target: ATXN1; (-) strand; PAM type: NRG; PAM sequence: CAG
tacttttcatcttcttgcat

SEQ ID NO: 43918 - DNA, 20 bp, Artificial Sequence
  Description of Artificial Sequence: Synthetic oligonucleotide
  Target: ATXN1; (-) strand; PAM type: NRG; PAM sequence: TGG
cagttcttactgtgttacct

SEQ ID NO: 43919 - DNA, 20 bp, Artificial Sequence
  Description of Artificial Sequence: Synthetic oligonucleotide
  Target: ATXN1; (-) strand; PAM type: NRG; PAM sequence: CAG
ggttctcatcctcctgaccc

SEQ ID NO: 43920 - DNA, 20 bp, Artificial Sequence
  Description of Artificial Sequence: Synthetic oligonucleotide
  Target: ATXN1; (-) strand; PAM type: NRG; PAM sequence: AGG
caagtgagagtcaaagtgac

SEQ ID NO: 43921 - DNA, 20 bp, Artificial Sequence
  Description of Artificial Sequence: Synthetic oligonucleotide
  Target: ATXN1; (-) strand; PAM type: NRG; PAM sequence: CAG
tcaagtgagagtcaaagtga

SEQ ID NO: 43922 - DNA, 20 bp, Artificial Sequence
  Description of Artificial Sequence: Synthetic oligonucleotide
  Target: ATXN1; (-) strand; PAM type: NRG; PAM sequence: AAG
aaacattcaagtgagagtca

SEQ ID NO: 43923 - DNA, 20 bp, Artificial Sequence
  Description of Artificial Sequence: Synthetic oligonucleotide
  Target: ATXN1; (-) strand; PAM type: NRG; PAM sequence: GAG
ggtaagaaacattcaagtga

SEQ ID NO: 43924 - DNA, 20 bp, Artificial Sequence
  Description of Artificial Sequence: Synthetic oligonucleotide
  Target: ATXN1; (-) strand; PAM type: NRG; PAM sequence: GAG
gtggtaagaaacattcaagt

SEQ ID NO: 43925 - DNA, 20 bp, Artificial Sequence
  Description of Artificial Sequence: Synthetic oligonucleotide
  Target: ATXN1; (-) strand; PAM type: NRG; PAM sequence: AAG
agtggtggtaagaaacattc

SEQ ID NO: 43926 - DNA, 20 bp, Artificial Sequence
  Description of Artificial Sequence: Synthetic oligonucleotide
  Target: ATXN1; (-) strand; PAM type: NRG; PAM sequence: AAG
agatctatcacagtggtggt

SEQ ID NO: 43927 - DNA, 20 bp, Artificial Sequence
  Description of Artificial Sequence: Synthetic oligonucleotide
  Target: ATXN1; (-) strand; PAM type: NRG; PAM sequence: TGG
agtgagatctatcacagtgg

SEQ ID NO: 43928 - DNA, 20 bp, Artificial Sequence
  Description of Artificial Sequence: Synthetic oligonucleotide
  Target: ATXN1; (-) strand; PAM type: NRG; PAM sequence: TGG
ggtagtgagatctatcacag

SEQ ID NO: 43929 - DNA, 20 bp, Artificial Sequence
  Description of Artificial Sequence: Synthetic oligonucleotide
  Target: ATXN1; (-) strand; PAM type: NRG; PAM sequence: CAG
tcgggtagtgagatctatca

SEQ ID NO: 43930 - DNA, 20 bp, Artificial Sequence
  Description of Artificial Sequence: Synthetic oligonucleotide
  Target: ATXN1; (-) strand; PAM type: NRG; PAM sequence: GAG
tgcttcatgcatcgggtagt

SEQ ID NO: 43931 - DNA, 20 bp, Artificial Sequence
  Description of Artificial Sequence: Synthetic oligonucleotide
  Target: ATXN1; (-) strand; PAM type: NRG; PAM sequence: TAG
tgaatgcttcatgcatcggg

SEQ ID NO: 43932 - DNA, 20 bp, Artificial Sequence
  Description of Artificial Sequence: Synthetic oligonucleotide
  Target: ATXN1; (-) strand; PAM type: NRG; PAM sequence: GGG
atgtgaatgcttcatgcatc

SEQ ID NO: 43933 - DNA, 20 bp, Artificial Sequence
  Description of Artificial Sequence: Synthetic oligonucleotide
  Target: ATXN1; (-) strand; PAM type: NRG; PAM sequence: CGG
gatgtgaatgcttcatgcat

SEQ ID NO: 43934 - DNA, 20 bp, Artificial Sequence
  Description of Artificial Sequence: Synthetic oligonucleotide
  Target: ATXN1; (-) strand; PAM type: NRG; PAM sequence: TGG
tgatattctaaataggacag

SEQ ID NO: 43935 - DNA, 20 bp, Artificial Sequence
  Description of Artificial Sequence: Synthetic oligonucleotide
  Target: ATXN1; (-) strand; PAM type: NRG; PAM sequence: CAG
tcttgatattctaaatagga

SEQ ID NO: 43936 - DNA, 20 bp, Artificial Sequence
  Description of Artificial Sequence: Synthetic oligonucleotide
  Target: ATXN1; (-) strand; PAM type: NRG; PAM sequence: AGG
tttatcttgatattctaaat

SEQ ID NO: 43937 - DNA, 20 bp, Artificial Sequence
  Description of Artificial Sequence: Synthetic oligonucleotide
  Target: ATXN1; (-) strand; PAM type: NRG; PAM sequence: TAG
atttatcttgatattctaaa

SEQ ID NO: 43938 - DNA, 20 bp, Artificial Sequence
  Description of Artificial Sequence: Synthetic oligonucleotide
  Target: ATXN1; (-) strand; PAM type: NRG; PAM sequence: TAG
tgatctattatcatcattgt

SEQ ID NO: 43939 - DNA, 20 bp, Artificial Sequence
  Description of Artificial Sequence: Synthetic oligonucleotide
  Target: ATXN1; (-) strand; PAM type: NRG; PAM sequence: TGG
gtccttagtagtaatagcag

SEQ ID NO: 43940 - DNA, 20 bp, Artificial Sequence
  Description of Artificial Sequence: Synthetic oligonucleotide
  Target: ATXN1; (-) strand; PAM type: NRG; PAM sequence: CAG
tgtgtccttagtagtaatag

SEQ ID NO: 43941 - DNA, 20 bp, Artificial Sequence
  Description of Artificial Sequence: Synthetic oligonucleotide
  Target: ATXN1; (-) strand; PAM type: NRG; PAM sequence: TAG
ctgtgtgtccttagtagtaa

SEQ ID NO: 43942 - DNA, 20 bp, Artificial Sequence
  Description of Artificial Sequence: Synthetic oligonucleotide
  Target: ATXN1; (-) strand; PAM type: NRG; PAM sequence: TAG
acaattctgtgtgtccttag

SEQ ID NO: 43943 - DNA, 20 bp, Artificial Sequence
  Description of Artificial Sequence: Synthetic oligonucleotide
  Target: ATXN1; (-) strand; PAM type: NRG; PAM sequence: TAG
actacaattctgtgtgtcct

SEQ ID NO: 43944 - DNA, 20 bp, Artificial Sequence
  Description of Artificial Sequence: Synthetic oligonucleotide
  Target: ATXN1; (-) strand; PAM type: NRG; PAM sequence: TAG
ctgttctctaccttacggcg

SEQ ID NO: 43945 - DNA, 20 bp, Artificial Sequence
  Description of Artificial Sequence: Synthetic oligonucleotide
  Target: ATXN1; (-) strand; PAM type: NRG; PAM sequence: CGG
tgaacctgttctctacctta

SEQ ID NO: 43946 - DNA, 20 bp, Artificial Sequence
  Description of Artificial Sequence: Synthetic oligonucleotide
  Target: ATXN1; (-) strand; PAM type: NRG; PAM sequence: AGG
ggtggtttggggtaaagcca

SEQ ID NO: 43947 - DNA, 20 bp, Artificial Sequence
  Description of Artificial Sequence: Synthetic oligonucleotide
  Target: ATXN1; (-) strand; PAM type: NRG; PAM sequence: AAG
aggtggtttggggtaaagcc

SEQ ID NO: 43948 - DNA, 20 bp, Artificial Sequence
  Description of Artificial Sequence: Synthetic oligonucleotide
  Target: ATXN1; (-) strand; PAM type: NRG; PAM sequence: AAG
aacataggtggtttggggta

SEQ ID NO: 43949 - DNA, 20 bp, Artificial Sequence
  Description of Artificial Sequence: Synthetic oligonucleotide
  Target: ATXN1; (-) strand; PAM type: NRG; PAM sequence: GGG
tggataacataggtggtttg

SEQ ID NO: 43950 - DNA, 20 bp, Artificial Sequence
  Description of Artificial Sequence: Synthetic oligonucleotide
  Target: ATXN1; (-) strand; PAM type: NRG; PAM sequence: GGG
atggataacataggtggttt

SEQ ID NO: 43951 - DNA, 20 bp, Artificial Sequence
  Description of Artificial Sequence: Synthetic oligonucleotide
  Target: ATXN1; (-) strand; PAM type: NRG; PAM sequence: TGG
aatggataacataggtggtt

SEQ ID NO: 43952 - DNA, 20 bp, Artificial Sequence
  Description of Artificial Sequence: Synthetic oligonucleotide
  Target: ATXN1; (-) strand; PAM type: NRG; PAM sequence: TGG
ttaaaaatggataacatagg

SEQ ID NO: 43953 - DNA, 20 bp, Artificial Sequence
  Description of Artificial Sequence: Synthetic oligonucleotide
  Target: ATXN1; (-) strand; PAM type: NRG; PAM sequence: AGG
tttttaaaaatggataacat

SEQ ID NO: 43954 - DNA, 20 bp, Artificial Sequence
  Description of Artificial Sequence: Synthetic oligonucleotide
  Target: ATXN1; (-) strand; PAM type: NRG; PAM sequence: TAG
atttttaaaaatggataaca

SEQ ID NO: 43955 - DNA, 20 bp, Artificial Sequence
  Description of Artificial Sequence: Synthetic oligonucleotide
  Target: ATXN1; (-) strand; PAM type: NRG; PAM sequence: TGG
caaaattatatttttaaaaa

SEQ ID NO: 43956 - DNA, 20 bp, Artificial Sequence
  Description of Artificial Sequence: Synthetic oligonucleotide
  Target: ATXN1; (-) strand; PAM type: NRG; PAM sequence: CGG
caggcatgagccaccacgcc

SEQ ID NO: 43957 - DNA, 20 bp, Artificial Sequence
  Description of Artificial Sequence: Synthetic oligonucleotide
  Target: ATXN1; (-) strand; PAM type: NRG; PAM sequence: GAG
agtgctgggtttgcaggcat

SEQ ID NO: 43958 - DNA, 20 bp, Artificial Sequence
  Description of Artificial Sequence: Synthetic oligonucleotide
  Target: ATXN1; (-) strand; PAM type: NRG; PAM sequence: AGG
tcctaaagtgctgggtttgc

SEQ ID NO: 43959 - DNA, 20 bp, Artificial Sequence
  Description of Artificial Sequence: Synthetic oligonucleotide
  Target: ATXN1; (-) strand; PAM type: NRG; PAM sequence: CAG
ctcctaaagtgctgggtttg

SEQ ID NO: 43960 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctaaagtgct

SEQ ID NO: 43961 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctaaagtgc

SEQ ID NO: 43962 - DNA, 20 bp, Artificial Sequence
  Description of Artificial Sequence: Synthetic oligonucleotide
  Target: ATXN1; (-) strand; PAM type: NRG; PAM sequence: AAG
ccgcccgcctcagcctccta

SEQ ID NO: 43963 - DNA, 20 bp, Artificial Sequence
  Description of Artificial Sequence: Synthetic oligonucleotide
  Target: ATXN1; (-) strand; PAM type: NRG; PAM sequence: CAG
acctcgcaatccgcccgcct

SEQ ID NO: 43964 - DNA, 20 bp, Artificial Sequence
  Description of Artificial Sequence: Synthetic oligonucleotide
  Target: ATXN1; (-) strand; PAM type: NRG; PAM sequence: TGG
tttcactgtgttatccagga

SEQ ID NO: 43965 - DNA, 20 bp, Artificial Sequence
  Description of Artificial Sequence: Synthetic oligonucleotide
  Target: ATXN1; (-) strand; PAM type: NRG; PAM sequence: AGG
aggatttcactgtgttatcc

SEQ ID NO: 43966 - DNA, 20 bp, Artificial Sequence
  Description of Artificial Sequence: Synthetic oligonucleotide
  Target: ATXN1; (-) strand; PAM type: NRG; PAM sequence: CAG
caggatttcactgtgttatc

SEQ ID NO: 43967 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagagac

SEQ ID NO: 43968 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 43969 - DNA, 20 bp, Artificial Sequence
  Description of Artificial Sequence: Synthetic oligonucleotide
  Target: ATXN1; (-) strand; PAM type: NRG; PAM sequence: GAG
cattttttgtatttttagta

SEQ ID NO: 43970 - DNA, 20 bp, Artificial Sequence
  Description of Artificial Sequence: Synthetic oligonucleotide
  Target: ATXN1; (-) strand; PAM type: NRG; PAM sequence: TAG
ctcattttttgtatttttag

SEQ ID NO: 43971 - DNA, 20 bp, Artificial Sequence
  Description of Artificial Sequence: Synthetic oligonucleotide
  Target: ATXN1; (-) strand; PAM type: NRG; PAM sequence: TAG
tggctcattttttgtatttt

SEQ ID NO: 43972 - DNA, 20 bp, Artificial Sequence
  Description of Artificial Sequence: Synthetic oligonucleotide
  Target: ATXN1; (-) strand; PAM type: NRG; PAM sequence: TGG
caggcgcctgccaccacgcc

SEQ ID NO: 43973 - DNA, 20 bp, Artificial Sequence
  Description of Artificial Sequence: Synthetic oligonucleotide
  Target: ATXN1; (-) strand; PAM type: NRG; PAM sequence: AGG
tccctcgtagctgggactac

SEQ ID NO: 43974 - DNA, 20 bp, Artificial Sequence
  Description of Artificial Sequence: Synthetic oligonucleotide
  Target: ATXN1; (-) strand; PAM type: NRG; PAM sequence: CAG
ctccctcgtagctgggacta

SEQ ID NO: 43975 - DNA, 20 bp, Artificial Sequence
  Description of Artificial Sequence: Synthetic oligonucleotide
  Target: ATXN1; (-) strand; PAM type: NRG; PAM sequence: GGG
ccttagcctccctcgtagct

SEQ ID NO: 43976 - DNA, 20 bp, Artificial Sequence
  Description of Artificial Sequence: Synthetic oligonucleotide
  Target: ATXN1; (-) strand; PAM type: NRG; PAM sequence: TGG
gccttagcctccctcgtagc

SEQ ID NO: 43977 - DNA, 20 bp, Artificial Sequence
  Description of Artificial Sequence: Synthetic oligonucleotide
  Target: ATXN1; (-) strand; PAM type: NRG; PAM sequence: TAG
tcctgccttagcctccctcg

SEQ ID NO: 43978 - DNA, 20 bp, Artificial Sequence
  Description of Artificial Sequence: Synthetic oligonucleotide
  Target: ATXN1; (-) strand; PAM type: NRG; PAM sequence: TAG
ttcaagcgattctcctgcct

SEQ ID NO: 43979 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcctgggttc

SEQ ID NO: 43980 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccgcctcct

SEQ ID NO: 43981 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctccgcctcc

SEQ ID NO: 43982 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggtgtgatct

SEQ ID NO: 43983 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcag

SEQ ID NO: 43984 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcccaggctggagtg

SEQ ID NO: 43985 - DNA, 20 bp, Artificial Sequence
  Description of Artificial Sequence: Synthetic oligonucleotide
  Target: ATXN1; (-) strand; PAM type: NRG; PAM sequence: GAG
tcgctctgtcgcccaggctg

SEQ ID NO: 43986 - DNA, 20 bp, Artificial Sequence
  Description of Artificial Sequence: Synthetic oligonucleotide
  Target: ATXN1; (-) strand; PAM type: NRG; PAM sequence: TGG
tctcgctctgtcgcccaggc

SEQ ID NO: 43987 - DNA, 20 bp, Artificial Sequence
  Description of Artificial Sequence: Synthetic oligonucleotide
  Target: ATXN1; (-) strand; PAM type: NRG; PAM sequence: AGG
ggagtctcgctctgtcgccc

SEQ ID NO: 43988 - DNA, 20 bp, Artificial Sequence
  Description of Artificial Sequence: Synthetic oligonucleotide
  Target: ATXN1; (-) strand; PAM type: NRG; PAM sequence: CAG
tggagtctcgctctgtcgcc

SEQ ID NO: 43989 - DNA, 20 bp, Artificial Sequence
  Description of Artificial Sequence: Synthetic oligonucleotide
  Target: ATXN1; (-) strand; PAM type: NRG; PAM sequence: GAG
aaaattattattttgagatg

SEQ ID NO: 43990 - DNA, 20 bp, Artificial Sequence
  Description of Artificial Sequence: Synthetic oligonucleotide
  Target: ATXN1; (-) strand; PAM type: NRG; PAM sequence: TGG
ttaaaattattattttgaga

SEQ ID NO: 43991 - DNA, 20 bp, Artificial Sequence
  Description of Artificial Sequence: Synthetic oligonucleotide
  Target: ATXN1; (-) strand; PAM type: NRG; PAM sequence: GAG
aaaattaaaattattatttt

SEQ ID NO: 43992 - DNA, 20 bp, Artificial Sequence
  Description of Artificial Sequence: Synthetic oligonucleotide
  Target: ATXN1; (-) strand; PAM type: NRG; PAM sequence: AAG
ttgggcacatgtataatcgc

SEQ ID NO: 43993 - DNA, 20 bp, Artificial Sequence
  Description of Artificial Sequence: Synthetic oligonucleotide
  Target: ATXN1; (-) strand; PAM type: NRG; PAM sequence: GGG
atttttgcctcattaaactt

SEQ ID NO: 43994 - DNA, 20 bp, Artificial Sequence
  Description of Artificial Sequence: Synthetic oligonucleotide
  Target: ATXN1; (-) strand; PAM type: NRG; PAM sequence: TGG
aatttttgcctcattaaact

SEQ ID NO: 43995 - DNA, 20 bp, Artificial Sequence
  Description of Artificial Sequence: Synthetic oligonucleotide
  Target: ATXN1; (-) strand; PAM type: NRG; PAM sequence: GAG
tcttccccattttaaaggca

SEQ ID NO: 43996 - DNA, 20 bp, Artificial Sequence
  Description of Artificial Sequence: Synthetic oligonucleotide
  Target: ATXN1; (-) strand; PAM type: NRG; PAM sequence: CAG
attcttccccattttaaagg

SEQ ID NO: 43997 - DNA, 20 bp, Artificial Sequence
  Description of Artificial Sequence: Synthetic oligonucleotide
  Target: ATXN1; (-) strand; PAM type: NRG; PAM sequence: AGG
ttaattcttccccattttaa

SEQ ID NO: 43998 - DNA, 20 bp, Artificial Sequence
  Description of Artificial Sequence: Synthetic oligonucleotide
  Target: ATXN1; (-) strand; PAM type: NRG; PAM sequence: AAG
gttaattcttccccatttta

SEQ ID NO: 43999 - DNA, 20 bp, Artificial Sequence
  Description of Artificial Sequence: Synthetic oligonucleotide
  Target: ATXN1; (-) strand; PAM type: NRG; PAM sequence: AGG
tactgagtgtgtgttatact

SEQ ID NO: 44000 - DNA, 20 bp, Artificial Sequence
  Description of Artificial Sequence: Synthetic oligonucleotide
  Target: ATXN1; (-) strand; PAM type: NRG; PAM sequence: TAG
gtactgagtgtgtgttatac

SEQ ID NO: 44001 - DNA, 20 bp, Artificial Sequence
  Description of Artificial Sequence: Synthetic oligonucleotide
  Target: ATXN1; (-) strand; PAM type: NRG; PAM sequence: GAG
tacgatggcgaccatgtact

SEQ ID NO: 44002 - DNA, 20 bp, Artificial Sequence
  Description of Artificial Sequence: Synthetic oligonucleotide
  Target: ATXN1; (-) strand; PAM type: NRG; PAM sequence: TGG
ttattgaattataactacga

SEQ ID NO: 44003 - DNA, 20 bp, Artificial Sequence
  Description of Artificial Sequence: Synthetic oligonucleotide
  Target: ATXN1; (-) strand; PAM type: NRG; PAM sequence: AGG
gtgatcactgagaattcatg

SEQ ID NO: 44004 - DNA, 20 bp, Artificial Sequence
  Description of Artificial Sequence: Synthetic oligonucleotide
  Target: ATXN1; (-) strand; PAM type: NRG; PAM sequence: GAG
ggtgatcactgagaattcat

SEQ ID NO: 44005 - DNA, 20 bp, Artificial Sequence
  Description of Artificial Sequence: Synthetic oligonucleotide
  Target: ATXN1; (-) strand; PAM type: NRG; PAM sequence: GAG
gataagtgtgggtgatcact

SEQ ID NO: 44006 - DNA, 20 bp, Artificial Sequence
  Description of Artificial Sequence: Synthetic oligonucleotide
  Target: ATXN1; (-) strand; PAM type: NRG; PAM sequence: GGG
gatgagcaacagataagtgt

SEQ ID NO: 44007 - DNA, 20 bp, Artificial Sequence
  Description of Artificial Sequence: Synthetic oligonucleotide
  Target: ATXN1; (-) strand; PAM type: NRG; PAM sequence: TGG
agatgagcaacagataagtg

SEQ ID NO: 44008 - DNA, 20 bp, Artificial Sequence
  Description of Artificial Sequence: Synthetic oligonucleotide
  Target: ATXN1; (-) strand; PAM type: NRG; PAM sequence: AAG
aggagagatgagcaacagat

SEQ ID NO: 44009 - DNA, 20 bp, Artificial Sequence
  Description of Artificial Sequence: Synthetic oligonucleotide
  Target: ATXN1; (-) strand; PAM type: NRG; PAM sequence: CAG
tggccaggagagatgagcaa

SEQ ID NO: 44010 - DNA, 20 bp, Artificial Sequence
  Description of Artificial Sequence: Synthetic oligonucleotide
  Target: ATXN1; (-) strand; PAM type: NRG; PAM sequence: GAG
acatcatggccaggagagat

SEQ ID NO: 44011 - DNA, 20 bp, Artificial Sequence
  Description of Artificial Sequence: Synthetic oligonucleotide
  Target: ATXN1; (-) strand; PAM type: NRG; PAM sequence: GAG
tgattacatcatggccagga

SEQ ID NO: 44012 - DNA, 20 bp, Artificial Sequence
  Description of Artificial Sequence: Synthetic oligonucleotide
  Target: ATXN1; (-) strand; PAM type: NRG; PAM sequence: GAG
attgattacatcatggccag

SEQ ID NO: 44013 - DNA, 20 bp, Artificial Sequence
  Description of Artificial Sequence: Synthetic oligonucleotide
  Target: ATXN1; (-) strand; PAM type: NRG; PAM sequence: AGG
gtattgattacatcatggcc

SEQ ID NO: 44014 - DNA, 20 bp, Artificial Sequence
  Description of Artificial Sequence: Synthetic oligonucleotide
  Target: ATXN1; (-) strand; PAM type: NRG; PAM sequence: CAG
tgtattgattacatcatggc

SEQ ID NO: 44015 - DNA, 20 bp, Artificial Sequence
  Description of Artificial Sequence: Synthetic oligonucleotide
  Target: ATXN1; (-) strand; PAM type: NRG; PAM sequence: TGG
gtgttgtattgattacatca

SEQ ID NO: 44016 - DNA, 20 bp, Artificial Sequence
  Description of Artificial Sequence: Synthetic oligonucleotide
  Target: ATXN1; (-) strand; PAM type: NRG; PAM sequence: AGG
tgaaagaattgatagtttga

SEQ ID NO: 44017 - DNA, 20 bp, Artificial Sequence
  Description of Artificial Sequence: Synthetic oligonucleotide
  Target: ATXN1; (-) strand; PAM type: NRG; PAM sequence: AAG
ttgaaagaattgatagtttg

SEQ ID NO: 44018 - DNA, 20 bp, Artificial Sequence
  Description of Artificial Sequence: Synthetic oligonucleotide
  Target: ATXN1; (-) strand; PAM type: NRG; PAM sequence: TAG
cagatgtttgaaagaattga

SEQ ID NO: 44019 - DNA, 20 bp, Artificial Sequence
  Description of Artificial Sequence: Synthetic oligonucleotide
  Target: ATXN1; (-) strand; PAM type: NRG; PAM sequence: AAG
aggaaaaaacagatgtttga

SEQ ID NO: 44020 - DNA, 20 bp, Artificial Sequence
  Description of Artificial Sequence: Synthetic oligonucleotide
  Target: ATXN1; (-) strand; PAM type: NRG; PAM sequence: CAG
tcacagatgtgaggaaaaaa

SEQ ID NO: 44021 - DNA, 20 bp, Artificial Sequence
  Description of Artificial Sequence: Synthetic oligonucleotide
  Target: ATXN1; (-) strand; PAM type: NRG; PAM sequence: AGG
ctttttctatcacagatgtg

SEQ ID NO: 44022 - DNA, 20 bp, Artificial Sequence
  Description of Artificial Sequence: Synthetic oligonucleotide
  Target: ATXN1; (-) strand; PAM type: NRG; PAM sequence: GAG
tctttttctatcacagatgt

SEQ ID NO: 44023 - DNA, 20 bp, Artificial Sequence
  Description of Artificial Sequence: Synthetic oligonucleotide
  Target: ATXN1; (-) strand; PAM type: NRG; PAM sequence: CAG
cacttcctctttttctatca

SEQ ID NO: 44024 - DNA, 20 bp, Artificial Sequence
  Description of Artificial Sequence: Synthetic oligonucleotide
  Target: ATXN1; (-) strand; PAM type: NRG; PAM sequence: AAG
attatcccacctatcaagtg

SEQ ID NO: 44025 - DNA, 20 bp, Artificial Sequence
  Description of Artificial Sequence: Synthetic oligonucleotide
  Target: ATXN1; (-) strand; PAM type: NRG; PAM sequence: AAG
taaatattatcccacctatc

SEQ ID NO: 44026 - DNA, 20 bp, Artificial Sequence
  Description of Artificial Sequence: Synthetic oligonucleotide
  Target: ATXN1; (-) strand; PAM type: NRG; PAM sequence: GGG
tgcataggggtctgcacatt

SEQ ID NO: 44027 - DNA, 20 bp, Artificial Sequence
  Description of Artificial Sequence: Synthetic oligonucleotide
  Target: ATXN1; (-) strand; PAM type: NRG; PAM sequence: TGG
gtgcataggggtctgcacat

SEQ ID NO: 44028 - DNA, 20 bp, Artificial Sequence
  Description of Artificial Sequence: Synthetic oligonucleotide
  Target: ATXN1; (-) strand; PAM type: NRG; PAM sequence: GGG
cttcttgttggtgtgcatag

SEQ ID NO: 44029 - DNA, 20 bp, Artificial Sequence
  Description of Artificial Sequence: Synthetic oligonucleotide
  Target: ATXN1; (-) strand; PAM type: NRG; PAM sequence: GGG
ccttcttgttggtgtgcata

SEQ ID NO: 44030 - DNA, 20 bp, Artificial Sequence
  Description of Artificial Sequence: Synthetic oligonucleotide
  Target: ATXN1; (-) strand; PAM type: NRG; PAM sequence: AGG
tccttcttgttggtgtgcat

SEQ ID NO: 44031 - DNA, 20 bp, Artificial Sequence
  Description of Artificial Sequence: Synthetic oligonucleotide
  Target: ATXN1; (-) strand; PAM type: NRG; PAM sequence: TAG
ttccttcttgttggtgtgca

SEQ ID NO: 44032 - DNA, 20 bp, Artificial Sequence
  Description of Artificial Sequence: Synthetic oligonucleotide
  Target: ATXN1; (-) strand; PAM type: NRG; PAM sequence: TGG
tgaattgccttccttcttgt

SEQ ID NO: 44033 - DNA, 20 bp, Artificial Sequence
  Description of Artificial Sequence: Synthetic oligonucleotide
  Target: ATXN1; (-) strand; PAM type: NRG; PAM sequence: GAG
catccttgagtttagcgtct

SEQ ID NO: 44034 - DNA, 20 bp, Artificial Sequence
  Description of Artificial Sequence: Synthetic oligonucleotide
  Target: ATXN1; (-) strand; PAM type: NRG; PAM sequence: TAG
ggaaatgccatccttgagtt

SEQ ID NO: 44035 - DNA, 20 bp, Artificial Sequence
  Description of Artificial Sequence: Synthetic oligonucleotide
  Target: ATXN1; (-) strand; PAM type: NRG; PAM sequence: GAG
tccctggaaatgccatcctt

SEQ ID NO: 44036 - DNA, 20 bp, Artificial Sequence
  Description of Artificial Sequence: Synthetic oligonucleotide
  Target: ATXN1; (-) strand; PAM type: NRG; PAM sequence: TGG
cattgcacttaacccttccc

SEQ ID NO: 44037 - DNA, 20 bp, Artificial Sequence
  Description of Artificial Sequence: Synthetic oligonucleotide
  Target: ATXN1; (-) strand; PAM type: NRG; PAM sequence: AGG
gcaggcagagtgaaacacgg

SEQ ID NO: 44038 - DNA, 20 bp, Artificial Sequence
  Description of Artificial Sequence: Synthetic oligonucleotide
  Target: ATXN1; (-) strand; PAM type: NRG; PAM sequence: GAG
agcaggcagagtgaaacacg

SEQ ID NO: 44039 - DNA, 20 bp, Artificial Sequence
  Description of Artificial Sequence: Synthetic oligonucleotide
  Target: ATXN1; (-) strand; PAM type: NRG; PAM sequence: CGG
aaagcaggcagagtgaaaca

SEQ ID NO: 44040 - DNA, 20 bp, Artificial Sequence
  Description of Artificial Sequence: Synthetic oligonucleotide
  Target: ATXN1; (-) strand; PAM type: NRG; PAM sequence: GAG
gtattgtggaaaagcaggca

SEQ ID NO: 44041 - DNA, 20 bp, Artificial Sequence
  Description of Artificial Sequence: Synthetic oligonucleotide
  Target: ATXN1; (-) strand; PAM type: NRG; PAM sequence: CAG
aagtattgtggaaaagcagg

SEQ ID NO: 44042 - DNA, 20 bp, Artificial Sequence
  Description of Artificial Sequence: Synthetic oligonucleotide
  Target: ATXN1; (-) strand; PAM type: NRG; PAM sequence: AGG
aaaaagtattgtggaaaagc

SEQ ID NO: 44043 - DNA, 20 bp, Artificial Sequence
  Description of Artificial Sequence: Synthetic oligonucleotide
  Target: ATXN1; (-) strand; PAM type: NRG; PAM sequence: CAG
caaaaagtattgtggaaaag

SEQ ID NO: 44044 - DNA, 20 bp, Artificial Sequence
  Description of Artificial Sequence: Synthetic oligonucleotide
  Target: ATXN1; (-) strand; PAM type: NRG; PAM sequence: AAG
atccaaaaagtattgtggaa

SEQ ID NO: 44045 - DNA, 20 bp, Artificial Sequence
  Description of Artificial Sequence: Synthetic oligonucleotide
  Target: ATXN1; (-) strand; PAM type: NRG; PAM sequence: TGG
tactcatccaaaaagtattg

SEQ ID NO: 44046 - DNA, 20 bp, Artificial Sequence
  Description of Artificial Sequence: Synthetic oligonucleotide
  Target: ATXN1; (-) strand; PAM type: NRG; PAM sequence: AAG
ttgggaattactcatccaaa

SEQ ID NO: 44047 - DNA, 20 bp, Artificial Sequence
  Description of Artificial Sequence: Synthetic oligonucleotide
  Target: ATXN1; (-) strand; PAM type: NRG; PAM sequence: GGG
atttccccaccatgcgtctt

SEQ ID NO: 44048 - DNA, 20 bp, Artificial Sequence
  Description of Artificial Sequence: Synthetic oligonucleotide
  Target: ATXN1; (-) strand; PAM type: NRG; PAM sequence: TGG
catttccccaccatgcgtct

SEQ ID NO: 44049 - DNA, 20 bp, Artificial Sequence
  Description of Artificial Sequence: Synthetic oligonucleotide
  Target: ATXN1; (-) strand; PAM type: NRG; PAM sequence: AGG
tccctgcgggatgtggaagg

SEQ ID NO: 44050 - DNA, 20 bp, Artificial Sequence
  Description of Artificial Sequence: Synthetic oligonucleotide
  Target: ATXN1; (-) strand; PAM type: NRG; PAM sequence: GAG
ttccctgcgggatgtggaag

SEQ ID NO: 44051 - DNA, 20 bp, Artificial Sequence
  Description of Artificial Sequence: Synthetic oligonucleotide
  Target: ATXN1; (-) strand; PAM type: NRG; PAM sequence: AGG
ccttccctgcgggatgtgga

SEQ ID NO: 44052 - DNA, 20 bp, Artificial Sequence
  Description of Artificial Sequence: Synthetic oligonucleotide
  Target: ATXN1; (-) strand; PAM type: NRG; PAM sequence: AAG
gccttccctgcgggatgtgg

SEQ ID NO: 44053 - DNA, 20 bp, Artificial Sequence
  Description of Artificial Sequence: Synthetic oligonucleotide
  Target: ATXN1; (-) strand; PAM type: NRG; PAM sequence: TGG
gcagccttccctgcgggatg

SEQ ID NO: 44054 - DNA, 20 bp, Artificial Sequence
  Description of Artificial Sequence: Synthetic oligonucleotide
  Target: ATXN1; (-) strand; PAM type: NRG; PAM sequence: GGG
cagctggcagccttccctgc

SEQ ID NO: 44055 - DNA, 20 bp, Artificial Sequence
  Description of Artificial Sequence: Synthetic oligonucleotide
  Target: ATXN1; (-) strand; PAM type: NRG; PAM sequence: CGG
acagctggcagccttccctg

SEQ ID NO: 44056 - DNA, 20 bp, Artificial Sequence
  Description of Artificial Sequence: Synthetic oligonucleotide
  Target: ATXN1; (-) strand; PAM type: NRG; PAM sequence: CAG
gtgtgcgggtagacagctgg

SEQ ID NO: 44057 - DNA, 20 bp, Artificial Sequence
  Description of Artificial Sequence: Synthetic oligonucleotide
  Target: ATXN1; (-) strand; PAM type: NRG; PAM sequence: TGG
tgtgtgtgcgggtagacagc

SEQ ID NO: 44058 - DNA, 20 bp, Artificial Sequence
  Description of Artificial Sequence: Synthetic oligonucleotide
  Target: ATXN1; (-) strand; PAM type: NRG; PAM sequence: CAG
tgagtgtgtgtgcgggtaga

SEQ ID NO: 44059 - DNA, 20 bp, Artificial Sequence
  Description of Artificial Sequence: Synthetic oligonucleotide
  Target: ATXN1; (-) strand; PAM type: NRG; PAM sequence: TAG
ctcgtgagtgtgtgtgcggg

SEQ ID NO: 44060 - DNA, 20 bp, Artificial Sequence
  Description of Artificial Sequence: Synthetic oligonucleotide
  Target: ATXN1; (-) strand; PAM type: NRG; PAM sequence: GGG
aagctcgtgagtgtgtgtgc

SEQ ID NO: 44061 - DNA, 20 bp, Artificial Sequence
  Description of Artificial Sequence: Synthetic oligonucleotide
  Target: ATXN1; (-) strand; PAM type: NRG; PAM sequence: CGG
gaagctcgtgagtgtgtgtg

SEQ ID NO: 44062 - DNA, 20 bp, Artificial Sequence
  Description of Artificial Sequence: Synthetic oligonucleotide
  Target: ATXN1; (-) strand; PAM type: NRG; PAM sequence: GAG
tgttgtgtggtgaagctcgt

SEQ ID NO: 44063 - DNA, 20 bp, Artificial Sequence
  Description of Artificial Sequence: Synthetic oligonucleotide
  Target: ATXN1; (-) strand; PAM type: NRG; PAM sequence: AAG
ttgcatcgtgttgtgtggtg

SEQ ID NO: 44064 - DNA, 20 bp, Artificial Sequence
  Description of Artificial Sequence: Synthetic oligonucleotide
  Target: ATXN1; (-) strand; PAM type: NRG; PAM sequence: TGG
gcgctttgcatcgtgttgtg

SEQ ID NO: 44065 - DNA, 20 bp, Artificial Sequence
  Description of Artificial Sequence: Synthetic oligonucleotide
  Target: ATXN1; (-) strand; PAM type: NRG; PAM sequence: TGG
aggcctcctggagcagttgc

SEQ ID NO: 44066 - DNA, 20 bp, Artificial Sequence
  Description of Artificial Sequence: Synthetic oligonucleotide
  Target: ATXN1; (-) strand; PAM type: NRG; PAM sequence: CAG
ccagcctaggcctcctggag

SEQ ID NO: 44067 - DNA, 20 bp, Artificial Sequence
  Description of Artificial Sequence: Synthetic oligonucleotide
  Target: ATXN1; (-) strand; PAM type: NRG; PAM sequence: GAG
gatccagcctaggcctcctg

SEQ ID NO: 44068 - DNA, 20 bp, Artificial Sequence
  Description of Artificial Sequence: Synthetic oligonucleotide
  Target: ATXN1; (-) strand; PAM type: NRG; PAM sequence: TGG
aggatccagcctaggcctcc

SEQ ID NO: 44069 - DNA, 20 bp, Artificial Sequence
  Description of Artificial Sequence: Synthetic oligonucleotide
  Target: ATXN1; (-) strand; PAM type: NRG; PAM sequence: AGG
tggctggcaggatccagcct

SEQ ID NO: 44070 - DNA, 20 bp, Artificial Sequence
  Description of Artificial Sequence: Synthetic oligonucleotide
  Target: ATXN1; (-) strand; PAM type: NRG; PAM sequence: TAG
gtggctggcaggatccagcc

SEQ ID NO: 44071 - DNA, 20 bp, Artificial Sequence
  Description of Artificial Sequence: Synthetic oligonucleotide
  Target: ATXN1; (-) strand; PAM type: NRG; PAM sequence: CAG
ccctggtggctggcaggatc

SEQ ID NO: 44072 - DNA, 20 bp, Artificial Sequence
  Description of Artificial Sequence: Synthetic oligonucleotide
  Target: ATXN1; (-) strand; PAM type: NRG; PAM sequence: AGG
ccagccccctggtggctggc

SEQ ID NO: 44073 - DNA, 20 bp, Artificial Sequence
  Description of Artificial Sequence: Synthetic oligonucleotide
  Target: ATXN1; (-) strand; PAM type: NRG; PAM sequence: CAG
cccagccccctggtggctgg

SEQ ID NO: 44074 - DNA, 20 bp, Artificial Sequence
  Description of Artificial Sequence: Synthetic oligonucleotide
  Target: ATXN1; (-) strand; PAM type: NRG; PAM sequence: TGG
aaacccagccccctggtggc

SEQ ID NO: 44075 - DNA, 20 bp, Artificial Sequence
  Description of Artificial Sequence: Synthetic oligonucleotide
  Target: ATXN1; (-) strand; PAM type: NRG; PAM sequence: TGG
ctggaaacccagccccctgg

SEQ ID NO: 44076 - DNA, 20 bp, Artificial Sequence
  Description of Artificial Sequence: Synthetic oligonucleotide
  Target: ATXN1; (-) strand; PAM type: NRG; PAM sequence: TGG
gtcctggaaacccagccccc

SEQ ID NO: 44077 - DNA, 20 bp, Artificial Sequence
  Description of Artificial Sequence: Synthetic oligonucleotide
  Target: ATXN1; (-) strand; PAM type: NRG; PAM sequence: CAG
tgtctaatgtcctggaaacc

SEQ ID NO: 44078 - DNA, 20 bp, Artificial Sequence
  Description of Artificial Sequence: Synthetic oligonucleotide
  Target: ATXN1; (-) strand; PAM type: NRG; PAM sequence: TGG
actggggctgtctaatgtcc

SEQ ID NO: 44079 - DNA, 20 bp, Artificial Sequence
  Description of Artificial Sequence: Synthetic oligonucleotide
  Target: ATXN1; (-) strand; PAM type: NRG; PAM sequence: GGG
atgttctctgttgtagactg

SEQ ID NO: 44080 - DNA, 20 bp, Artificial Sequence
  Description of Artificial Sequence: Synthetic oligonucleotide
  Target: ATXN1; (-) strand; PAM type: NRG; PAM sequence: GGG
tatgttctctgttgtagact

SEQ ID NO: 44081 - DNA, 20 bp, Artificial Sequence
  Description of Artificial Sequence: Synthetic oligonucleotide
  Target: ATXN1; (-) strand; PAM type: NRG; PAM sequence: TGG
ttatgttctctgttgtagac

SEQ ID NO: 44082 - DNA, 20 bp, Artificial Sequence
  Description of Artificial Sequence: Synthetic oligonucleotide
  Target: ATXN1; (-) strand; PAM type: NRG; PAM sequence: TAG
gagttttatgttctctgttg

SEQ ID NO: 44083 - DNA, 20 bp, Artificial Sequence
  Description of Artificial Sequence: Synthetic oligonucleotide
  Target: ATXN1; (-) strand; PAM type: NRG; PAM sequence: GAG
ctttttcctgacttgatgga

SEQ ID NO: 44084 - DNA, 20 bp, Artificial Sequence
  Description of Artificial Sequence: Synthetic oligonucleotide
  Target: ATXN1; (-) strand; PAM type: NRG; PAM sequence: GAG
acctttttcctgacttgatg

SEQ ID NO: 44085 - DNA, 20 bp, Artificial Sequence
  Description of Artificial Sequence: Synthetic oligonucleotide
  Target: ATXN1; (-) strand; PAM type: NRG; PAM sequence: TGG
agacctttttcctgacttga

SEQ ID NO: 44086 - DNA, 20 bp, Artificial Sequence
  Description of Artificial Sequence: Synthetic oligonucleotide
  Target: ATXN1; (-) strand; PAM type: NRG; PAM sequence: GAG
cagagtacctcagttcccac

SEQ ID NO: 44087 - DNA, 20 bp, Artificial Sequence
  Description of Artificial Sequence: Synthetic oligonucleotide
  Target: ATXN1; (-) strand; PAM type: NRG; PAM sequence: CAG
aagactctcccagagtacct

SEQ ID NO: 44088 - DNA, 20 bp, Artificial Sequence
  Description of Artificial Sequence: Synthetic oligonucleotide
  Target: ATXN1; (-) strand; PAM type: NRG; PAM sequence: GAG
atagttttaagactctccca

SEQ ID NO: 44089 - DNA, 20 bp, Artificial Sequence
  Description of Artificial Sequence: Synthetic oligonucleotide
  Target: ATXN1; (-) strand; PAM type: NRG; PAM sequence: CAG
gaatagttttaagactctcc

SEQ ID NO: 44090 - DNA, 20 bp, Artificial Sequence
  Description of Artificial Sequence: Synthetic oligonucleotide
  Target: ATXN1; (-) strand; PAM type: NRG; PAM sequence: AAG
caaggacagtgaatagtttt

SEQ ID NO: 44091 - DNA, 20 bp, Artificial Sequence
  Description of Artificial Sequence: Synthetic oligonucleotide
  Target: ATXN1; (-) strand; PAM type: NRG; PAM sequence: TAG
gccacaccaaggacagtgaa

SEQ ID NO: 44092 - DNA, 20 bp, Artificial Sequence
  Description of Artificial Sequence: Synthetic oligonucleotide
  Target: ATXN1; (-) strand; PAM type: NRG; PAM sequence: CAG
tcattcagccacaccaagga

SEQ ID NO: 44093 - DNA, 20 bp, Artificial Sequence
  Description of Artificial Sequence: Synthetic oligonucleotide
  Target: ATXN1; (-) strand; PAM type: NRG; PAM sequence: AGG
gctttcattcagccacacca

SEQ ID NO: 44094 - DNA, 20 bp, Artificial Sequence
  Description of Artificial Sequence: Synthetic oligonucleotide
  Target: ATXN1; (-) strand; PAM type: NRG; PAM sequence: AAG
tgctttcattcagccacacc

SEQ ID NO: 44095 - DNA, 20 bp, Artificial Sequence
  Description of Artificial Sequence: Synthetic oligonucleotide
  Target: ATXN1; (-) strand; PAM type: NRG; PAM sequence: CAG
gcattggctttgctttcatt

SEQ ID NO: 44096 - DNA, 20 bp, Artificial Sequence
  Description of Artificial Sequence: Synthetic oligonucleotide
  Target: ATXN1; (-) strand; PAM type: NRG; PAM sequence: TGG
tatgaattatctggaggcat

SEQ ID NO: 44097 - DNA, 20 bp, Artificial Sequence
  Description of Artificial Sequence: Synthetic oligonucleotide
  Target: ATXN1; (-) strand; PAM type: NRG; PAM sequence: AGG
ttagtttatgaattatctgg

SEQ ID NO: 44098 - DNA, 20 bp, Artificial Sequence
  Description of Artificial Sequence: Synthetic oligonucleotide
  Target: ATXN1; (-) strand; PAM type: NRG; PAM sequence: GAG
gttagtttatgaattatctg

SEQ ID NO: 44099 - DNA, 20 bp, Artificial Sequence
  Description of Artificial Sequence: Synthetic oligonucleotide
  Target: ATXN1; (-) strand; PAM type: NRG; PAM sequence: TGG
tggttagtttatgaattatc

SEQ ID NO: 44100 - DNA, 20 bp, Artificial Sequence
  Description of Artificial Sequence: Synthetic oligonucleotide
  Target: ATXN1; (-) strand; PAM type: NRG; PAM sequence: TAG
cacctggaggaacagctggt

SEQ ID NO: 44101 - DNA, 20 bp, Artificial Sequence
  Description of Artificial Sequence: Synthetic oligonucleotide
  Target: ATXN1; (-) strand; PAM type: NRG; PAM sequence: TGG
gtgacacctggaggaacagc

SEQ ID NO: 44102 - DNA, 20 bp, Artificial Sequence
  Description of Artificial Sequence: Synthetic oligonucleotide
  Target: ATXN1; (-) strand; PAM type: NRG; PAM sequence: CAG
gtgtgtgacacctggaggaa

SEQ ID NO: 44103 - DNA, 20 bp, Artificial Sequence
  Description of Artificial Sequence: Synthetic oligonucleotide
  Target: ATXN1; (-) strand; PAM type: NRG; PAM sequence: AGG
agccagtgtgtgacacctgg

SEQ ID NO: 44104 - DNA, 20 bp, Artificial Sequence
  Description of Artificial Sequence: Synthetic oligonucleotide
  Target: ATXN1; (-) strand; PAM type: NRG; PAM sequence: GAG
aagccagtgtgtgacacctg

SEQ ID NO: 44105 - DNA, 20 bp, Artificial Sequence
  Description of Artificial Sequence: Synthetic oligonucleotide
  Target: ATXN1; (-) strand; PAM type: NRG; PAM sequence: TGG
gtaagccagtgtgtgacacc

SEQ ID NO: 44106 - DNA, 20 bp, Artificial Sequence
  Description of Artificial Sequence: Synthetic oligonucleotide
  Target: ATXN1; (-) strand; PAM type: NRG; PAM sequence: CAG
aaccaccatagaaggtaagc

SEQ ID NO: 44107 - DNA, 20 bp, Artificial Sequence
  Description of Artificial Sequence: Synthetic oligonucleotide
  Target: ATXN1; (-) strand; PAM type: NRG; PAM sequence: AAG
ctgaaaccaccatagaaggt

SEQ ID NO: 44108 - DNA, 20 bp, Artificial Sequence
  Description of Artificial Sequence: Synthetic oligonucleotide
  Target: ATXN1; (-) strand; PAM type: NRG; PAM sequence: AGG
gtgactgaaaccaccataga

SEQ ID NO: 44109 - DNA, 20 bp, Artificial Sequence
  Description of Artificial Sequence: Synthetic oligonucleotide
  Target: ATXN1; (-) strand; PAM type: NRG; PAM sequence: AAG
agtgactgaaaccaccatag

SEQ ID NO: 44110 - DNA, 20 bp, Artificial Sequence
  Description of Artificial Sequence: Synthetic oligonucleotide
  Target: ATXN1; (-) strand; PAM type: NRG; PAM sequence: TAG
ctcagtgactgaaaccacca

SEQ ID NO: 44111 - DNA, 20 bp, Artificial Sequence
  Description of Artificial Sequence: Synthetic oligonucleotide
  Target: ATXN1; (-) strand; PAM type: NRG; PAM sequence: CAG
cattgaattgtgcagtgtct

SEQ ID NO: 44112 - DNA, 20 bp, Artificial Sequence
  Description of Artificial Sequence: Synthetic oligonucleotide
  Target: ATXN1; (-) strand; PAM type: NRG; PAM sequence: CAG
gttgagagcattgaattgtg

SEQ ID NO: 44113 - DNA, 20 bp, Artificial Sequence
  Description of Artificial Sequence: Synthetic oligonucleotide
  Target: ATXN1; (-) strand; PAM type: NRG; PAM sequence: GAG
cttggggtctttgcagttga

SEQ ID NO: 44114 - DNA, 20 bp, Artificial Sequence
  Description of Artificial Sequence: Synthetic oligonucleotide
  Target: ATXN1; (-) strand; PAM type: NRG; PAM sequence: GAG
gtcttggggtctttgcagtt

SEQ ID NO: 44115 - DNA, 20 bp, Artificial Sequence
  Description of Artificial Sequence: Synthetic oligonucleotide
  Target: ATXN1; (-) strand; PAM type: NRG; PAM sequence: CAG
gggaggtcttggggtctttg

SEQ ID NO: 44116 - DNA, 20 bp, Artificial Sequence
  Description of Artificial Sequence: Synthetic oligonucleotide
  Target: ATXN1; (-) strand; PAM type: NRG; PAM sequence: GGG
ctgggtcccgggaggtcttg

SEQ ID NO: 44117 - DNA, 20 bp, Artificial Sequence
  Description of Artificial Sequence: Synthetic oligonucleotide
  Target: ATXN1; (-) strand; PAM type: NRG; PAM sequence: GGG
cctgggtcccgggaggtctt

SEQ ID NO: 44118 - DNA, 20 bp, Artificial Sequence
  Description of Artificial Sequence: Synthetic oligonucleotide
  Target: ATXN1; (-) strand; PAM type: NRG; PAM sequence: TGG
gcctgggtcccgggaggtct

SEQ ID NO: 44119 - DNA, 20 bp, Artificial Sequence
  Description of Artificial Sequence: Synthetic oligonucleotide
  Target: ATXN1; (-) strand; PAM type: NRG; PAM sequence: AGG
tagagagcctgggtcccggg

SEQ ID NO: 44120 - DNA, 20 bp, Artificial Sequence
  Description of Artificial Sequence: Synthetic oligonucleotide
  Target: ATXN1; (-) strand; PAM type: NRG; PAM sequence: GAG
ttagagagcctgggtcccgg

SEQ ID NO: 44121 - DNA, 20 bp, Artificial Sequence
  Description of Artificial Sequence: Synthetic oligonucleotide
  Target: ATXN1; (-) strand; PAM type: NRG; PAM sequence: GGG
ccttagagagcctgggtccc

SEQ ID NO: 44122 - DNA, 20 bp, Artificial Sequence
  Description of Artificial Sequence: Synthetic oligonucleotide
  Target: ATXN1; (-) strand; PAM type: NRG; PAM sequence: CGG
gccttagagagcctgggtcc

SEQ ID NO: 44123 - DNA, 20 bp, Artificial Sequence
  Description of Artificial Sequence: Synthetic oligonucleotide
  Target: ATXN1; (-) strand; PAM type: NRG; PAM sequence: GGG
tgctgtgccttagagagcct

SEQ ID NO: 44124 - DNA, 20 bp, Artificial Sequence
  Description of Artificial Sequence: Synthetic oligonucleotide
  Target: ATXN1; (-) strand; PAM type: NRG; PAM sequence: TGG
ctgctgtgccttagagagcc

SEQ ID NO: 44125 - DNA, 20 bp, Artificial Sequence
  Description of Artificial Sequence: Synthetic oligonucleotide
  Target: ATXN1; (-) strand; PAM type: NRG; PAM sequence: GAG
cctgcctgctgtgccttaga

SEQ ID NO: 44126 - DNA, 20 bp, Artificial Sequence
  Description of Artificial Sequence: Synthetic oligonucleotide
  Target: ATXN1; (-) strand; PAM type: NRG; PAM sequence: GAG
gtcctgcctgctgtgcctta

SEQ ID NO: 44127 - DNA, 20 bp, Artificial Sequence
  Description of Artificial Sequence: Synthetic oligonucleotide
  Target: ATXN1; (-) strand; PAM type: NRG; PAM sequence: TAG
ttgtcctgcctgctgtgcct

SEQ ID NO: 44128 - DNA, 20 bp, Artificial Sequence
  Description of Artificial Sequence: Synthetic oligonucleotide
  Target: ATXN1; (-) strand; PAM type: NRG; PAM sequence: AAG
tgctgtagcctgcacaaatt

SEQ ID NO: 44129 - DNA, 20 bp, Artificial Sequence
  Description of Artificial Sequence: Synthetic oligonucleotide
  Target: ATXN1; (-) strand; PAM type: NRG; PAM sequence: TAG
ttatatgtaaagcattgctg

SEQ ID NO: 44130 - DNA, 20 bp, Artificial Sequence
  Description of Artificial Sequence: Synthetic oligonucleotide
  Target: ATXN1; (-) strand; PAM type: NRG; PAM sequence: AAG
ctagttgttatttatatgta

SEQ ID NO: 44131 - DNA, 20 bp, Artificial Sequence
  Description of Artificial Sequence: Synthetic oligonucleotide
  Target: ATXN1; (-) strand; PAM type: NRG; PAM sequence: TAG
gaaatggggtgatcatatgc

SEQ ID NO: 44132 - DNA, 20 bp, Artificial Sequence
  Description of Artificial Sequence: Synthetic oligonucleotide
  Target: ATXN1; (-) strand; PAM type: NRG; PAM sequence: GGG
atgtccttgtctttgaaatg

SEQ ID NO: 44133 - DNA, 20 bp, Artificial Sequence
  Description of Artificial Sequence: Synthetic oligonucleotide
  Target: ATXN1; (-) strand; PAM type: NRG; PAM sequence: GGG
aatgtccttgtctttgaaat

SEQ ID NO: 44134 - DNA, 20 bp, Artificial Sequence
  Description of Artificial Sequence: Synthetic oligonucleotide
  Target: ATXN1; (-) strand; PAM type: NRG; PAM sequence: TGG
caatgtccttgtctttgaaa

SEQ ID NO: 44135 - DNA, 20 bp, Artificial Sequence
  Description of Artificial Sequence: Synthetic oligonucleotide
  Target: ATXN1; (-) strand; PAM type: NRG; PAM sequence: GAG
aggcaagtgacttacactct

SEQ ID NO: 44136 - DNA, 20 bp, Artificial Sequence
  Description of Artificial Sequence: Synthetic oligonucleotide
  Target: ATXN1; (-) strand; PAM type: NRG; PAM sequence: AAG
ttagccatgtaatcttaggc

SEQ ID NO: 44137 - DNA, 20 bp, Artificial Sequence
  Description of Artificial Sequence: Synthetic oligonucleotide
  Target: ATXN1; (-) strand; PAM type: NRG; PAM sequence: AGG
ttttttagccatgtaatctt

SEQ ID NO: 44138 - DNA, 20 bp, Artificial Sequence
  Description of Artificial Sequence: Synthetic oligonucleotide
  Target: ATXN1; (-) strand; PAM type: NRG; PAM sequence: TAG
cttttttagccatgtaatct

SEQ ID NO: 44139 - DNA, 20 bp, Artificial Sequence
  Description of Artificial Sequence: Synthetic oligonucleotide
  Target: ATXN1; (-) strand; PAM type: NRG; PAM sequence: TAG
gtgttgtttctgcccttttt

SEQ ID NO: 44140 - DNA, 20 bp, Artificial Sequence
  Description of Artificial Sequence: Synthetic oligonucleotide
  Target: ATXN1; (-) strand; PAM type: NRG; PAM sequence: AGG
agatcccaagttttcatatt

SEQ ID NO: 44141 - DNA, 20 bp, Artificial Sequence
  Description of Artificial Sequence: Synthetic oligonucleotide
  Target: ATXN1; (-) strand; PAM type: NRG; PAM sequence: TAG
tagatcccaagttttcatat

SEQ ID NO: 44142 - DNA, 20 bp, Artificial Sequence
  Description of Artificial Sequence: Synthetic oligonucleotide
  Target: ATXN1; (-) strand; PAM type: NRG; PAM sequence: AAG
caacccaagaactagatccc

SEQ ID NO: 44143 - DNA, 20 bp, Artificial Sequence
  Description of Artificial Sequence: Synthetic oligonucleotide
  Target: ATXN1; (-) strand; PAM type: NRG; PAM sequence: TAG
ccactacacaacccaagaac

SEQ ID NO: 44144 - DNA, 20 bp, Artificial Sequence
  Description of Artificial Sequence: Synthetic oligonucleotide
  Target: ATXN1; (-) strand; PAM type: NRG; PAM sequence: AAG
aatgacccactacacaaccc

SEQ ID NO: 44145 - DNA, 20 bp, Artificial Sequence
  Description of Artificial Sequence: Synthetic oligonucleotide
  Target: ATXN1; (-) strand; PAM type: NRG; PAM sequence: AAG
agtgagactccgtctcaaaa

SEQ ID NO: 44146 - DNA, 20 bp, Artificial Sequence
  Description of Artificial Sequence: Synthetic oligonucleotide
  Target: ATXN1; (-) strand; PAM type: NRG; PAM sequence: GAG
ctacagcatggtgacagagt

SEQ ID NO: 44147 - DNA, 20 bp, Artificial Sequence
  Description of Artificial Sequence: Synthetic oligonucleotide
  Target: ATXN1; (-) strand; PAM type: NRG; PAM sequence: GAG
tgcactacagcatggtgaca

SEQ ID NO: 44148 - DNA, 20 bp, Artificial Sequence
  Description of Artificial Sequence: Synthetic oligonucleotide
  Target: ATXN1; (-) strand; PAM type: NRG; PAM sequence: CAG
actgcactacagcatggtga

SEQ ID NO: 44149 - DNA, 20 bp, Artificial Sequence
  Description of Artificial Sequence: Synthetic oligonucleotide
  Target: ATXN1; (-) strand; PAM type: NRG; PAM sequence: TGG
cacgccactgcactacagca

SEQ ID NO: 44150 - DNA, 20 bp, Artificial Sequence
  Description of Artificial Sequence: Synthetic oligonucleotide
  Target: ATXN1; (-) strand; PAM type: NRG; PAM sequence: CAG
gagatcacgccactgcacta

SEQ ID NO: 44151 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagcc

SEQ ID NO: 44152 - DNA, 20 bp, Artificial Sequence
  Description of Artificial Sequence: Synthetic oligonucleotide
  Target: ATXN1; (-) strand; PAM type: NRG; PAM sequence: GAG
caggaggcagaggttgcagt

SEQ ID NO: 44153 - DNA, 20 bp, Artificial Sequence
  Description of Artificial Sequence: Synthetic oligonucleotide
  Target: ATXN1; (-) strand; PAM type: NRG; PAM sequence: CAG
aacccaggaggcagaggttg

SEQ ID NO: 44154 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacccaggaggcag

SEQ ID NO: 44155 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccaggaggca

SEQ ID NO: 44156 - DNA, 20 bp, Artificial Sequence
  Description of Artificial Sequence: Synthetic oligonucleotide
  Target: ATXN1; (-) strand; PAM type: NRG; PAM sequence: CAG
aatcgcttgaacccaggagg

SEQ ID NO: 44157 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacccagg

SEQ ID NO: 44158 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaacccag

SEQ ID NO: 44159 - DNA, 20 bp, Artificial Sequence
  Description of Artificial Sequence: Synthetic oligonucleotide
  Target: ATXN1; (-) strand; PAM type: NRG; PAM sequence: AGG
caggagaatcgcttgaaccc

SEQ ID NO: 44160 - DNA, 20 bp, Artificial Sequence
  Description of Artificial Sequence: Synthetic oligonucleotide
  Target: ATXN1; (-) strand; PAM type: NRG; PAM sequence: CAG
gcaggagaatcgcttgaacc

SEQ ID NO: 44161 - DNA, 20 bp, Artificial Sequence
  Description of Artificial Sequence: Synthetic oligonucleotide
  Target: ATXN1; (-) strand; PAM type: NRG; PAM sequence: GAG
ttcttggaaggctgaggcag

SEQ ID NO: 44162 - DNA, 20 bp, Artificial Sequence
  Description of Artificial Sequence: Synthetic oligonucleotide
  Target: ATXN1; (-) strand; PAM type: NRG; PAM sequence: AGG
gcttcttggaaggctgaggc

SEQ ID NO: 44163 - DNA, 20 bp, Artificial Sequence
  Description of Artificial Sequence: Synthetic oligonucleotide
  Target: ATXN1; (-) strand; PAM type: NRG; PAM sequence: CAG
agcttcttggaaggctgagg

SEQ ID NO: 44164 - DNA, 20 bp, Artificial Sequence
  Description of Artificial Sequence: Synthetic oligonucleotide
  Target: ATXN1; (-) strand; PAM type: NRG; PAM sequence: AGG
cccagcttcttggaaggctg

SEQ ID NO: 44165 - DNA, 20 bp, Artificial Sequence
  Description of Artificial Sequence: Synthetic oligonucleotide
  Target: ATXN1; (-) strand; PAM type: NRG; PAM sequence: GAG
tcccagcttcttggaaggct

SEQ ID NO: 44166 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagcttcttgga

SEQ ID NO: 44167 - DNA, 20 bp, Artificial Sequence
  Description of Artificial Sequence: Synthetic oligonucleotide
  Target: ATXN1; (-) strand; PAM type: NRG; PAM sequence: AAG
ctgtagtcccagcttcttgg

SEQ ID NO: 44168 - DNA, 20 bp, Artificial Sequence
  Description of Artificial Sequence: Synthetic oligonucleotide
  Target: ATXN1; (-) strand; PAM type: NRG; PAM sequence: TGG
cgcctgtagtcccagcttct

SEQ ID NO: 44169 - DNA, 20 bp, Artificial Sequence
  Description of Artificial Sequence: Synthetic oligonucleotide
  Target: ATXN1; (-) strand; PAM type: NRG; PAM sequence: CAG
gtggcatgcgcctgtagtcc

SEQ ID NO: 44170 - DNA, 20 bp, Artificial Sequence
  Description of Artificial Sequence: Synthetic oligonucleotide
  Target: ATXN1; (-) strand; PAM type: NRG; PAM sequence: TAG
ggcatggtggcatgcgcctg

SEQ ID NO: 44171 - DNA, 20 bp, Artificial Sequence
  Description of Artificial Sequence: Synthetic oligonucleotide
  Target: ATXN1; (-) strand; PAM type: NRG; PAM sequence: TGG
caaaaattagctgggcatgg

SEQ ID NO: 44172 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagctgggca

SEQ ID NO: 44173 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaattagct

SEQ ID NO: 44174 - DNA, 20 bp, Artificial Sequence
  Description of Artificial Sequence: Synthetic oligonucleotide
  Target: ATXN1; (-) strand; PAM type: NRG; PAM sequence: TGG
ctaaaaatacaaaaattagc

SEQ ID NO: 44175 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatacaaaaat

SEQ ID NO: 44176 - DNA, 20 bp, Artificial Sequence
  Description of Artificial Sequence: Synthetic oligonucleotide
  Target: ATXN1; (-) strand; PAM type: NRG; PAM sequence: TGG
cgagaccatcctggccaaca

SEQ ID NO: 44177 - DNA, 20 bp, Artificial Sequence
  Description of Artificial Sequence: Synthetic oligonucleotide
  Target: ATXN1; (-) strand; PAM type: NRG; PAM sequence: TGG
tcaagagatcgagaccatcc

SEQ ID NO: 44178 - DNA, 20 bp, Artificial Sequence
  Description of Artificial Sequence: Synthetic oligonucleotide
  Target: ATXN1; (-) strand; PAM type: NRG; PAM sequence: GAG
gaccgcgaagtcaagagatc

SEQ ID NO: 44179 - DNA, 20 bp, Artificial Sequence
  Description of Artificial Sequence: Synthetic oligonucleotide
  Target: ATXN1; (-) strand; PAM type: NRG; PAM sequence: GAG
tgggcagaccgcgaagtcaa

SEQ ID NO: 44180 - DNA, 20 bp, Artificial Sequence
  Description of Artificial Sequence: Synthetic oligonucleotide
  Target: ATXN1; (-) strand; PAM type: NRG; PAM sequence: AAG
ggtgggcagaccgcgaagtc

SEQ ID NO: 44181 - DNA, 20 bp, Artificial Sequence
  Description of Artificial Sequence: Synthetic oligonucleotide
  Target: ATXN1; (-) strand; PAM type: NRG; PAM sequence: AAG
gccgaggtgggcagaccgcg

SEQ ID NO: 44182 - DNA, 20 bp, Artificial Sequence
  Description of Artificial Sequence: Synthetic oligonucleotide
  Target: ATXN1; (-) strand; PAM type: NRG; PAM sequence: CAG
ctttgggaggccgaggtggg

SEQ ID NO: 44183 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccgaggt

SEQ ID NO: 44184 - DNA, 20 bp, Artificial Sequence
  Description of Artificial Sequence: Synthetic oligonucleotide
  Target: ATXN1; (-) strand; PAM type: NRG; PAM sequence: TGG
agcactttgggaggccgagg

SEQ ID NO: 44185 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggccg

SEQ ID NO: 44186 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 44187 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 44188 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 44189 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagcacttt

SEQ ID NO: 44190 - DNA, 20 bp, Artificial Sequence
  Description of Artificial Sequence: Synthetic oligonucleotide
  Target: ATXN1; (-) strand; PAM type: NRG; PAM sequence: TGG
tacctgtaatcccagcactt

SEQ ID NO: 44191 - DNA, 20 bp, Artificial Sequence
  Description of Artificial Sequence: Synthetic oligonucleotide
  Target: ATXN1; (-) strand; PAM type: NRG; PAM sequence: CAG
gtggctcatacctgtaatcc

SEQ ID NO: 44192 - DNA, 20 bp, Artificial Sequence
  Description of Artificial Sequence: Synthetic oligonucleotide
  Target: ATXN1; (-) strand; PAM type: NRG; PAM sequence: TGG
ttcttcatggtcaggcgcgg

SEQ ID NO: 44193 - DNA, 20 bp, Artificial Sequence
  Description of Artificial Sequence: Synthetic oligonucleotide
  Target: ATXN1; (-) strand; PAM type: NRG; PAM sequence: CGG
aaattcttcatggtcaggcg

SEQ ID NO: 44194 - DNA, 20 bp, Artificial Sequence
  Description of Artificial Sequence: Synthetic oligonucleotide
  Target: ATXN1; (-) strand; PAM type: NRG; PAM sequence: AGG
aggttaaattcttcatggtc

SEQ ID NO: 44195 - DNA, 20 bp, Artificial Sequence
  Description of Artificial Sequence: Synthetic oligonucleotide
  Target: ATXN1; (-) strand; PAM type: NRG; PAM sequence: CAG
gaggttaaattcttcatggt

SEQ ID NO: 44196 - DNA, 20 bp, Artificial Sequence
  Description of Artificial Sequence: Synthetic oligonucleotide
  Target: ATXN1; (-) strand; PAM type: NRG; PAM sequence: TGG
gggtgaggttaaattcttca

SEQ ID NO: 44197 - DNA, 20 bp, Artificial Sequence
  Description of Artificial Sequence: Synthetic oligonucleotide
  Target: ATXN1; (-) strand; PAM type: NRG; PAM sequence: AGG
gccagacctgagtttgggtg

SEQ ID NO: 44198 - DNA, 20 bp, Artificial Sequence
  Description of Artificial Sequence: Synthetic oligonucleotide
  Target: ATXN1; (-) strand; PAM type: NRG; PAM sequence: GAG
ggccagacctgagtttgggt

SEQ ID NO: 44199 - DNA, 20 bp, Artificial Sequence
  Description of Artificial Sequence: Synthetic oligonucleotide
  Target: ATXN1; (-) strand; PAM type: NRG; PAM sequence: GGG
caaaggccagacctgagttt

SEQ ID NO: 44200 - DNA, 20 bp, Artificial Sequence
  Description of Artificial Sequence: Synthetic oligonucleotide
  Target: ATXN1; (-) strand; PAM type: NRG; PAM sequence: TGG
gcaaaggccagacctgagtt

SEQ ID NO: 44201 - DNA, 20 bp, Artificial Sequence
  Description of Artificial Sequence: Synthetic oligonucleotide
  Target: ATXN1; (-) strand; PAM type: NRG; PAM sequence: GAG
tgggggcaaaggccagacct

SEQ ID NO: 44202 - DNA, 20 bp, Artificial Sequence
  Description of Artificial Sequence: Synthetic oligonucleotide
  Target: ATXN1; (-) strand; PAM type: NRG; PAM sequence: CAG
ccacaggtgggggcaaaggc

SEQ ID NO: 44203 - DNA, 20 bp, Artificial Sequence
  Description of Artificial Sequence: Synthetic oligonucleotide
  Target: ATXN1; (-) strand; PAM type: NRG; PAM sequence: AGG
ctccccacaggtgggggcaa

SEQ ID NO: 44204 - DNA, 20 bp, Artificial Sequence
  Description of Artificial Sequence: Synthetic oligonucleotide
  Target: ATXN1; (-) strand; PAM type: NRG; PAM sequence: AAG
cctccccacaggtgggggca

SEQ ID NO: 44205 - DNA, 20 bp, Artificial Sequence
  Description of Artificial Sequence: Synthetic oligonucleotide
  Target: ATXN1; (-) strand; PAM type: NRG; PAM sequence: GGG
gatcacctccccacaggtgg

SEQ ID NO: 44206 - DNA, 20 bp, Artificial Sequence
  Description of Artificial Sequence: Synthetic oligonucleotide
  Target: ATXN1; (-) strand; PAM type: NRG; PAM sequence: GGG
agatcacctccccacaggtg

SEQ ID NO: 44207 - DNA, 20 bp, Artificial Sequence
  Description of Artificial Sequence: Synthetic oligonucleotide
  Target: ATXN1; (-) strand; PAM type: NRG; PAM sequence: GGG
gagatcacctccccacaggt

SEQ ID NO: 44208 - DNA, 20 bp, Artificial Sequence
  Description of Artificial Sequence: Synthetic oligonucleotide
  Target: ATXN1; (-) strand; PAM type: NRG; PAM sequence: TGG
agagatcacctccccacagg

SEQ ID NO: 44209 - DNA, 20 bp, Artificial Sequence
  Description of Artificial Sequence: Synthetic oligonucleotide
  Target: ATXN1; (-) strand; PAM type: NRG; PAM sequence: AGG
ccgagagatcacctccccac

SEQ ID NO: 44210 - DNA, 20 bp, Artificial Sequence
  Description of Artificial Sequence: Synthetic oligonucleotide
  Target: ATXN1; (-) strand; PAM type: NRG; PAM sequence: CAG
gccgagagatcacctcccca

SEQ ID NO: 44211 - DNA, 20 bp, Artificial Sequence
  Description of Artificial Sequence: Synthetic oligonucleotide
  Target: ATXN1; (-) strand; PAM type: NRG; PAM sequence: GAG
caggacattccagaggccga

SEQ ID NO: 44212 - DNA, 20 bp, Artificial Sequence
  Description of Artificial Sequence: Synthetic oligonucleotide
  Target: ATXN1; (-) strand; PAM type: NRG; PAM sequence: GAG
ggcaggacattccagaggcc

SEQ ID NO: 44213 - DNA, 20 bp, Artificial Sequence
  Description of Artificial Sequence: Synthetic oligonucleotide
  Target: ATXN1; (-) strand; PAM type: NRG; PAM sequence: AGG
tgtgaggcaggacattccag

SEQ ID NO: 44214 - DNA, 20 bp, Artificial Sequence
  Description of Artificial Sequence: Synthetic oligonucleotide
  Target: ATXN1; (-) strand; PAM type: NRG; PAM sequence: GAG
ctgtgaggcaggacattcca

SEQ ID NO: 44215 - DNA, 20 bp, Artificial Sequence
  Description of Artificial Sequence: Synthetic oligonucleotide
  Target: ATXN1; (-) strand; PAM type: NRG; PAM sequence: CAG
ttctgtgaggcaggacattc

SEQ ID NO: 44216 - DNA, 20 bp, Artificial Sequence
  Description of Artificial Sequence: Synthetic oligonucleotide
  Target: ATXN1; (-) strand; PAM type: NRG; PAM sequence: AGG
taaacatacttctgtgaggc

SEQ ID NO: 44217 - DNA, 20 bp, Artificial Sequence
  Description of Artificial Sequence: Synthetic oligonucleotide
  Target: ATXN1; (-) strand; PAM type: NRG; PAM sequence: CAG
ataaacatacttctgtgagg

SEQ ID NO: 44218 - DNA, 20 bp, Artificial Sequence
  Description of Artificial Sequence: Synthetic oligonucleotide
  Target: ATXN1; (-) strand; PAM type: NRG; PAM sequence: AGG
ccaataaacatacttctgtg

SEQ ID NO: 44219 - DNA, 20 bp, Artificial Sequence
  Description of Artificial Sequence: Synthetic oligonucleotide
  Target: ATXN1; (-) strand; PAM type: NRG; PAM sequence: GAG
gccaataaacatacttctgt

SEQ ID NO: 44220 - DNA, 20 bp, Artificial Sequence
  Description of Artificial Sequence: Synthetic oligonucleotide
  Target: ATXN1; (-) strand; PAM type: NRG; PAM sequence: TGG
cacattgttactccatccag

SEQ ID NO: 44221 - DNA, 20 bp, Artificial Sequence
  Description of Artificial Sequence: Synthetic oligonucleotide
  Target: ATXN1; (-) strand; PAM type: NRG; PAM sequence: CAG
aatcacattgttactccatc

SEQ ID NO: 44222 - DNA, 20 bp, Artificial Sequence
  Description of Artificial Sequence: Synthetic oligonucleotide
  Target: ATXN1; (-) strand; PAM type: NRG; PAM sequence: AAG
aacgtatacctcatggccca

SEQ ID NO: 44223 - DNA, 20 bp, Artificial Sequence
  Description of Artificial Sequence: Synthetic oligonucleotide
  Target: ATXN1; (-) strand; PAM type: NRG; PAM sequence: TGG
aggttggaacgtatacctca

SEQ ID NO: 44224 - DNA, 20 bp, Artificial Sequence
  Description of Artificial Sequence: Synthetic oligonucleotide
  Target: ATXN1; (-) strand; PAM type: NRG; PAM sequence: TGG
attattagttcctctgaggt

SEQ ID NO: 44225 - DNA, 20 bp, Artificial Sequence
  Description of Artificial Sequence: Synthetic oligonucleotide
  Target: ATXN1; (-) strand; PAM type: NRG; PAM sequence: AGG
tttcattattagttcctctg

SEQ ID NO: 44226 - DNA, 20 bp, Artificial Sequence
  Description of Artificial Sequence: Synthetic oligonucleotide
  Target: ATXN1; (-) strand; PAM type: NRG; PAM sequence: GAG
ctttcattattagttcctct

SEQ ID NO: 44227 - DNA, 20 bp, Artificial Sequence
  Description of Artificial Sequence: Synthetic oligonucleotide
  Target: ATXN1; (-) strand; PAM type: NRG; PAM sequence: TAG
aggcaaatatctttcattat

SEQ ID NO: 44228 - DNA, 20 bp, Artificial Sequence
  Description of Artificial Sequence: Synthetic oligonucleotide
  Target: ATXN1; (-) strand; PAM type: NRG; PAM sequence: AGG
cctaggccctcctggagatc

SEQ ID NO: 44229 - DNA, 20 bp, Artificial Sequence
  Description of Artificial Sequence: Synthetic oligonucleotide
  Target: ATXN1; (-) strand; PAM type: NRG; PAM sequence: CAG
ccctaggccctcctggagat

SEQ ID NO: 44230 - DNA, 20 bp, Artificial Sequence
  Description of Artificial Sequence: Synthetic oligonucleotide
  Target: ATXN1; (-) strand; PAM type: NRG; PAM sequence: GAG
ctagtccctaggccctcctg

SEQ ID NO: 44231 - DNA, 20 bp, Artificial Sequence
  Description of Artificial Sequence: Synthetic oligonucleotide
  Target: ATXN1; (-) strand; PAM type: NRG; PAM sequence: TGG
ctctagtccctaggccctcc

SEQ ID NO: 44232 - DNA, 20 bp, Artificial Sequence
  Description of Artificial Sequence: Synthetic oligonucleotide
  Target: ATXN1; (-) strand; PAM type: NRG; PAM sequence: AGG
atgactgacctctagtccct

SEQ ID NO: 44233 - DNA, 20 bp, Artificial Sequence
  Description of Artificial Sequence: Synthetic oligonucleotide
  Target: ATXN1; (-) strand; PAM type: NRG; PAM sequence: TAG
catgactgacctctagtccc

SEQ ID NO: 44234 - DNA, 20 bp, Artificial Sequence
  Description of Artificial Sequence: Synthetic oligonucleotide
  Target: ATXN1; (-) strand; PAM type: NRG; PAM sequence: TAG
ctgtcctcatgactgacctc

SEQ ID NO: 44235 - DNA, 20 bp, Artificial Sequence
  Description of Artificial Sequence: Synthetic oligonucleotide
  Target: ATXN1; (-) strand; PAM type: NRG; PAM sequence: GAG
agcatctagagtttttattg

SEQ ID NO: 44236 - DNA, 20 bp, Artificial Sequence
  Description of Artificial Sequence: Synthetic oligonucleotide
  Target: ATXN1; (-) strand; PAM type: NRG; PAM sequence: TGG
tcagcatctagagtttttat

SEQ ID NO: 44237 - DNA, 20 bp, Artificial Sequence
  Description of Artificial Sequence: Synthetic oligonucleotide
  Target: ATXN1; (-) strand; PAM type: NRG; PAM sequence: GAG
cacgcgaacctcagcatcta

SEQ ID NO: 44238 - DNA, 20 bp, Artificial Sequence
  Description of Artificial Sequence: Synthetic oligonucleotide
  Target: ATXN1; (-) strand; PAM type: NRG; PAM sequence: TAG
ctcacgcgaacctcagcatc

SEQ ID NO: 44239 - DNA, 20 bp, Artificial Sequence
  Description of Artificial Sequence: Synthetic oligonucleotide
  Target: ATXN1; (-) strand; PAM type: NRG; PAM sequence: CAG
agggaagctcacgcgaacct

SEQ ID NO: 44240 - DNA, 20 bp, Artificial Sequence
  Description of Artificial Sequence: Synthetic oligonucleotide
  Target: ATXN1; (-) strand; PAM type: NRG; PAM sequence: AAG
tgaagaatcaccaaccaggg

SEQ ID NO: 44241 - DNA, 20 bp, Artificial Sequence
  Description of Artificial Sequence: Synthetic oligonucleotide
  Target: ATXN1; (-) strand; PAM type: NRG; PAM sequence: GGG
atgtgaagaatcaccaacca

SEQ ID NO: 44242 - DNA, 20 bp, Artificial Sequence
  Description of Artificial Sequence: Synthetic oligonucleotide
  Target: ATXN1; (-) strand; PAM type: NRG; PAM sequence: AGG
gatgtgaagaatcaccaacc

SEQ ID NO: 44243 - DNA, 20 bp, Artificial Sequence
  Description of Artificial Sequence: Synthetic oligonucleotide
  Target: ATXN1; (-) strand; PAM type: NRG; PAM sequence: CAG
tgatgtgaagaatcaccaac

SEQ ID NO: 44244 - DNA, 20 bp, Artificial Sequence
  Description of Artificial Sequence: Synthetic oligonucleotide
  Target: ATXN1; (-) strand; PAM type: NRG; PAM sequence: AAG
ctcctcccagccatgatgtg

SEQ ID NO: 44245 - DNA, 20 bp, Artificial Sequence
  Description of Artificial Sequence: Synthetic oligonucleotide
  Target: ATXN1; (-) strand; PAM type: NRG; PAM sequence: CAG
tgaacagcattacctcctcc

SEQ ID NO: 44246 - DNA, 20 bp, Artificial Sequence
  Description of Artificial Sequence: Synthetic oligonucleotide
  Target: ATXN1; (-) strand; PAM type: NRG; PAM sequence: CAG
tctgcccatgaagtgatgaa

SEQ ID NO: 44247 - DNA, 20 bp, Artificial Sequence
  Description of Artificial Sequence: Synthetic oligonucleotide
  Target: ATXN1; (-) strand; PAM type: NRG; PAM sequence: AAG
tctgttgccctctgcccatg

SEQ ID NO: 44248 - DNA, 20 bp, Artificial Sequence
  Description of Artificial Sequence: Synthetic oligonucleotide
  Target: ATXN1; (-) strand; PAM type: NRG; PAM sequence: GGG
tctagaggggtccagacatg

SEQ ID NO: 44249 - DNA, 20 bp, Artificial Sequence
  Description of Artificial Sequence: Synthetic oligonucleotide
  Target: ATXN1; (-) strand; PAM type: NRG; PAM sequence: GGG
gtctagaggggtccagacat

SEQ ID NO: 44250 - DNA, 20 bp, Artificial Sequence
  Description of Artificial Sequence: Synthetic oligonucleotide
  Target: ATXN1; (-) strand; PAM type: NRG; PAM sequence: TGG
ggtctagaggggtccagaca

SEQ ID NO: 44251 - DNA, 20 bp, Artificial Sequence
  Description of Artificial Sequence: Synthetic oligonucleotide
  Target: ATXN1; (-) strand; PAM type: NRG; PAM sequence: CAG
aggagaggtctagaggggtc

SEQ ID NO: 44252 - DNA, 20 bp, Artificial Sequence
  Description of Artificial Sequence: Synthetic oligonucleotide
  Target: ATXN1; (-) strand; PAM type: NRG; PAM sequence: GGG
catataggagaggtctagag

SEQ ID NO: 44253 - DNA, 20 bp, Artificial Sequence
  Description of Artificial Sequence: Synthetic oligonucleotide
  Target: ATXN1; (-) strand; PAM type: NRG; PAM sequence: GGG
gcatataggagaggtctaga

SEQ ID NO: 44254 - DNA, 20 bp, Artificial Sequence
  Description of Artificial Sequence: Synthetic oligonucleotide
  Target: ATXN1; (-) strand; PAM type: NRG; PAM sequence: AGG
ggcatataggagaggtctag

SEQ ID NO: 44255 - DNA, 20 bp, Artificial Sequence
  Description of Artificial Sequence: Synthetic oligonucleotide
  Target: ATXN1; (-) strand; PAM type: NRG; PAM sequence: GAG
aggcatataggagaggtcta

SEQ ID NO: 44256 - DNA, 20 bp, Artificial Sequence
  Description of Artificial Sequence: Synthetic oligonucleotide
  Target: ATXN1; (-) strand; PAM type: NRG; PAM sequence: TAG
agaggcatataggagaggtc

SEQ ID NO: 44257 - DNA, 20 bp, Artificial Sequence
  Description of Artificial Sequence: Synthetic oligonucleotide
  Target: ATXN1; (-) strand; PAM type: NRG; PAM sequence: AGG
gggtaagaggcatataggag

SEQ ID NO: 44258 - DNA, 20 bp, Artificial Sequence
  Description of Artificial Sequence: Synthetic oligonucleotide
  Target: ATXN1; (-) strand; PAM type: NRG; PAM sequence: GAG
agggtaagaggcatatagga

SEQ ID NO: 44259 - DNA, 20 bp, Artificial Sequence
  Description of Artificial Sequence: Synthetic oligonucleotide
  Target: ATXN1; (-) strand; PAM type: NRG; PAM sequence: GAG
ccagggtaagaggcatatag

SEQ ID NO: 44260 - DNA, 20 bp, Artificial Sequence
  Description of Artificial Sequence: Synthetic oligonucleotide
  Target: ATXN1; (-) strand; PAM type: NRG; PAM sequence: AGG
agccagggtaagaggcatat

SEQ ID NO: 44261 - DNA, 20 bp, Artificial Sequence
  Description of Artificial Sequence: Synthetic oligonucleotide
  Target: ATXN1; (-) strand; PAM type: NRG; PAM sequence: TAG
tagccagggtaagaggcata

SEQ ID NO: 44262 - DNA, 20 bp, Artificial Sequence
  Description of Artificial Sequence: Synthetic oligonucleotide
  Target: ATXN1; (-) strand; PAM type: NRG; PAM sequence: AGG
ttaaacttagccagggtaag

SEQ ID NO: 44263 - DNA, 20 bp, Artificial Sequence
  Description of Artificial Sequence: Synthetic oligonucleotide
  Target: ATXN1; (-) strand; PAM type: NRG; PAM sequence: GAG
gttaaacttagccagggtaa

SEQ ID NO: 44264 - DNA, 20 bp, Artificial Sequence
  Description of Artificial Sequence: Synthetic oligonucleotide
  Target: ATXN1; (-) strand; PAM type: NRG; PAM sequence: AAG
aagttaaacttagccagggt

SEQ ID NO: 44265 - DNA, 20 bp, Artificial Sequence
  Description of Artificial Sequence: Synthetic oligonucleotide
  Target: ATXN1; (-) strand; PAM type: NRG; PAM sequence: GGG
atacaagttaaacttagcca

SEQ ID NO: 44266 - DNA, 20 bp, Artificial Sequence
  Description of Artificial Sequence: Synthetic oligonucleotide
  Target: ATXN1; (-) strand; PAM type: NRG; PAM sequence: AGG
gatacaagttaaacttagcc

SEQ ID NO: 44267 - DNA, 20 bp, Artificial Sequence
  Description of Artificial Sequence: Synthetic oligonucleotide
  Target: ATXN1; (-) strand; PAM type: NRG; PAM sequence: CAG
ggatacaagttaaacttagc

SEQ ID NO: 44268 - DNA, 20 bp, Artificial Sequence
  Description of Artificial Sequence: Synthetic oligonucleotide
  Target: ATXN1; (-) strand; PAM type: NRG; PAM sequence: TAG
gaaaggatacaagttaaact

SEQ ID NO: 44269 - DNA, 20 bp, Artificial Sequence
  Description of Artificial Sequence: Synthetic oligonucleotide
  Target: ATXN1; (-) strand; PAM type: NRG; PAM sequence: AAG
ttattacagggaaaggatac

SEQ ID NO: 44270 - DNA, 20 bp, Artificial Sequence
  Description of Artificial Sequence: Synthetic oligonucleotide
  Target: ATXN1; (-) strand; PAM type: NRG; PAM sequence: AGG
ctcatacttattacagggaa

SEQ ID NO: 44271 - DNA, 20 bp, Artificial Sequence
  Description of Artificial Sequence: Synthetic oligonucleotide
  Target: ATXN1; (-) strand; PAM type: NRG; PAM sequence: AAG
actcatacttattacaggga

SEQ ID NO: 44272 - DNA, 20 bp, Artificial Sequence
  Description of Artificial Sequence: Synthetic oligonucleotide
  Target: ATXN1; (-) strand; PAM type: NRG; PAM sequence: GGG
ttctactcatacttattaca

SEQ ID NO: 44273 - DNA, 20 bp, Artificial Sequence
  Description of Artificial Sequence: Synthetic oligonucleotide
  Target: ATXN1; (-) strand; PAM type: NRG; PAM sequence: AGG
gttctactcatacttattac

SEQ ID NO: 44274 - DNA, 20 bp, Artificial Sequence
  Description of Artificial Sequence: Synthetic oligonucleotide
  Target: ATXN1; (-) strand; PAM type: NRG; PAM sequence: CAG
tgttctactcatacttatta

SEQ ID NO: 44275 - DNA, 20 bp, Artificial Sequence
  Description of Artificial Sequence: Synthetic oligonucleotide
  Target: ATXN1; (-) strand; PAM type: NRG; PAM sequence: AAG
ggactcacagaactcactga

SEQ ID NO: 44276 - DNA, 20 bp, Artificial Sequence
  Description of Artificial Sequence: Synthetic oligonucleotide
  Target: ATXN1; (-) strand; PAM type: NRG; PAM sequence: CAG
taattcagtaaaaggactca

SEQ ID NO: 44277 - DNA, 20 bp, Artificial Sequence
  Description of Artificial Sequence: Synthetic oligonucleotide
  Target: ATXN1; (-) strand; PAM type: NRG; PAM sequence: AGG
cgttttgataattcagtaaa

SEQ ID NO: 44278 - DNA, 20 bp, Artificial Sequence
  Description of Artificial Sequence: Synthetic oligonucleotide
  Target: ATXN1; (-) strand; PAM type: NRG; PAM sequence: AAG
ccgttttgataattcagtaa

SEQ ID NO: 44279 - DNA, 20 bp, Artificial Sequence
  Description of Artificial Sequence: Synthetic oligonucleotide
  Target: ATXN1; (-) strand; PAM type: NRG; PAM sequence: CAG
caccctccgttttgataatt

SEQ ID NO: 44280 - DNA, 20 bp, Artificial Sequence
  Description of Artificial Sequence: Synthetic oligonucleotide
  Target: ATXN1; (-) strand; PAM type: NRG; PAM sequence: CAG
tgcaagttcagggggtttcc

SEQ ID NO: 44281 - DNA, 20 bp, Artificial Sequence
  Description of Artificial Sequence: Synthetic oligonucleotide
  Target: ATXN1; (-) strand; PAM type: NRG; PAM sequence: GGG
ccacgaattgcaagttcagg

SEQ ID NO: 44282 - DNA, 20 bp, Artificial Sequence
  Description of Artificial Sequence: Synthetic oligonucleotide
  Target: ATXN1; (-) strand; PAM type: NRG; PAM sequence: GGG
accacgaattgcaagttcag

SEQ ID NO: 44283 - DNA, 20 bp, Artificial Sequence
  Description of Artificial Sequence: Synthetic oligonucleotide
  Target: ATXN1; (-) strand; PAM type: NRG; PAM sequence: GGG
caccacgaattgcaagttca

SEQ ID NO: 44284 - DNA, 20 bp, Artificial Sequence
  Description of Artificial Sequence: Synthetic oligonucleotide
  Target: ATXN1; (-) strand; PAM type: NRG; PAM sequence: AGG
gcaccacgaattgcaagttc

SEQ ID NO: 44285 - DNA, 20 bp, Artificial Sequence
  Description of Artificial Sequence: Synthetic oligonucleotide
  Target: ATXN1; (-) strand; PAM type: NRG; PAM sequence: CAG
tgcaccacgaattgcaagtt

SEQ ID NO: 44286 - DNA, 20 bp, Artificial Sequence
  Description of Artificial Sequence: Synthetic oligonucleotide
  Target: ATXN1; (-) strand; PAM type: NRG; PAM sequence: AAG
gtgcctgcaccacgaattgc

SEQ ID NO: 44287 - DNA, 20 bp, Artificial Sequence
  Description of Artificial Sequence: Synthetic oligonucleotide
  Target: ATXN1; (-) strand; PAM type: NRG; PAM sequence: CAG
aactacaacgttagagagag

SEQ ID NO: 44288 - DNA, 20 bp, Artificial Sequence
  Description of Artificial Sequence: Synthetic oligonucleotide
  Target: ATXN1; (-) strand; PAM type: NRG; PAM sequence: GAG
accaactacaacgttagaga

SEQ ID NO: 44289 - DNA, 20 bp, Artificial Sequence
  Description of Artificial Sequence: Synthetic oligonucleotide
  Target: ATXN1; (-) strand; PAM type: NRG; PAM sequence: GAG
tgaccaactacaacgttaga

SEQ ID NO: 44290 - DNA, 20 bp, Artificial Sequence
  Description of Artificial Sequence: Synthetic oligonucleotide
  Target: ATXN1; (-) strand; PAM type: NRG; PAM sequence: GAG
ggtgaccaactacaacgtta

SEQ ID NO: 44291 - DNA, 20 bp, Artificial Sequence
  Description of Artificial Sequence: Synthetic oligonucleotide
  Target: ATXN1; (-) strand; PAM type: NRG; PAM sequence: TAG
aaggtgaccaactacaacgt

SEQ ID NO: 44292 - DNA, 20 bp, Artificial Sequence
  Description of Artificial Sequence: Synthetic oligonucleotide
  Target: ATXN1; (-) strand; PAM type: NRG; PAM sequence: AGG
aaccatcactagctataaga

SEQ ID NO: 44293 - DNA, 20 bp, Artificial Sequence
  Description of Artificial Sequence: Synthetic oligonucleotide
  Target: ATXN1; (-) strand; PAM type: NRG; PAM sequence: AAG
taaccatcactagctataag

SEQ ID NO: 44294 - DNA, 20 bp, Artificial Sequence
  Description of Artificial Sequence: Synthetic oligonucleotide
  Target: ATXN1; (-) strand; PAM type: NRG; PAM sequence: AAG
gtataaccatcactagctat

SEQ ID NO: 44295 - DNA, 20 bp, Artificial Sequence
  Description of Artificial Sequence: Synthetic oligonucleotide
  Target: ATXN1; (-) strand; PAM type: NRG; PAM sequence: TAG
tttaagtgtataaccatcac

SEQ ID NO: 44296 - DNA, 20 bp, Artificial Sequence
  Description of Artificial Sequence: Synthetic oligonucleotide
  Target: ATXN1; (-) strand; PAM type: NRG; PAM sequence: AAG
ttttattacttggcctattt

SEQ ID NO: 44297 - DNA, 20 bp, Artificial Sequence
  Description of Artificial Sequence: Synthetic oligonucleotide
  Target: ATXN1; (-) strand; PAM type: NRG; PAM sequence: TGG
cgttgttatattttattact

SEQ ID NO: 44298 - DNA, 20 bp, Artificial Sequence
  Description of Artificial Sequence: Synthetic oligonucleotide
  Target: ATXN1; (-) strand; PAM type: NRG; PAM sequence: TGG
ttcttatcactgaacgctga

SEQ ID NO: 44299 - DNA, 20 bp, Artificial Sequence
  Description of Artificial Sequence: Synthetic oligonucleotide
  Target: ATXN1; (-) strand; PAM type: NRG; PAM sequence: AGG
aacctaattattgtttcaca

SEQ ID NO: 44300 - DNA, 20 bp, Artificial Sequence
  Description of Artificial Sequence: Synthetic oligonucleotide
  Target: ATXN1; (-) strand; PAM type: NRG; PAM sequence: AAG
taacctaattattgtttcac

SEQ ID NO: 44301 - DNA, 20 bp, Artificial Sequence
  Description of Artificial Sequence: Synthetic oligonucleotide
  Target: ATXN1; (-) strand; PAM type: NRG; PAM sequence: TAG
cagtttggggtataccaatt

SEQ ID NO: 44302 - DNA, 20 bp, Artificial Sequence
  Description of Artificial Sequence: Synthetic oligonucleotide
  Target: ATXN1; (-) strand; PAM type: NRG; PAM sequence: GGG
tgttccctggccacagtttg

SEQ ID NO: 44303 - DNA, 20 bp, Artificial Sequence
  Description of Artificial Sequence: Synthetic oligonucleotide
  Target: ATXN1; (-) strand; PAM type: NRG; PAM sequence: GGG
ctgttccctggccacagttt

SEQ ID NO: 44304 - DNA, 20 bp, Artificial Sequence
  Description of Artificial Sequence: Synthetic oligonucleotide
  Target: ATXN1; (-) strand; PAM type: NRG; PAM sequence: TGG
cctgttccctggccacagtt

SEQ ID NO: 44305 - DNA, 20 bp, Artificial Sequence
  Description of Artificial Sequence: Synthetic oligonucleotide
  Target: ATXN1; (-) strand; PAM type: NRG; PAM sequence: CAG
atctgcctgttccctggcca

SEQ ID NO: 44306 - DNA, 20 bp, Artificial Sequence
  Description of Artificial Sequence: Synthetic oligonucleotide
  Target: ATXN1; (-) strand; PAM type: NRG; PAM sequence: TGG
ccacccatctgcctgttccc

SEQ ID NO: 44307 - DNA, 20 bp, Artificial Sequence
  Description of Artificial Sequence: Synthetic oligonucleotide
  Target: ATXN1; (-) strand; PAM type: NRG; PAM sequence: GAG
ggccctggtgacattacact

SEQ ID NO: 44308 - DNA, 20 bp, Artificial Sequence
  Description of Artificial Sequence: Synthetic oligonucleotide
  Target: ATXN1; (-) strand; PAM type: NRG; PAM sequence: TGG
tttctctgagcctttggccc

SEQ ID NO: 44309 - DNA, 20 bp, Artificial Sequence
  Description of Artificial Sequence: Synthetic oligonucleotide
  Target: ATXN1; (-) strand; PAM type: NRG; PAM sequence: TGG
ggaggctttctctgagcctt

SEQ ID NO: 44310 - DNA, 20 bp, Artificial Sequence
  Description of Artificial Sequence: Synthetic oligonucleotide
  Target: ATXN1; (-) strand; PAM type: NRG; PAM sequence: GAG
tccacagggaggctttctct

SEQ ID NO: 44311 - DNA, 20 bp, Artificial Sequence
  Description of Artificial Sequence: Synthetic oligonucleotide
  Target: ATXN1; (-) strand; PAM type: NRG; PAM sequence: AGG
ttggggagatttccacaggg

SEQ ID NO: 44312 - DNA, 20 bp, Artificial Sequence
  Description of Artificial Sequence: Synthetic oligonucleotide
  Target: ATXN1; (-) strand; PAM type: NRG; PAM sequence: GAG
attggggagatttccacagg

SEQ ID NO: 44313 - DNA, 20 bp, Artificial Sequence
  Description of Artificial Sequence: Synthetic oligonucleotide
  Target: ATXN1; (-) strand; PAM type: NRG; PAM sequence: GGG
ccattggggagatttccaca

SEQ ID NO: 44314 - DNA, 20 bp, Artificial Sequence
  Description of Artificial Sequence: Synthetic oligonucleotide
  Target: ATXN1; (-) strand; PAM type: NRG; PAM sequence: AGG
gccattggggagatttccac

SEQ ID NO: 44315 - DNA, 20 bp, Artificial Sequence
  Description of Artificial Sequence: Synthetic oligonucleotide
  Target: ATXN1; (-) strand; PAM type: NRG; PAM sequence: CAG
tgccattggggagatttcca

SEQ ID NO: 44316 - DNA, 20 bp, Artificial Sequence
  Description of Artificial Sequence: Synthetic oligonucleotide
  Target: ATXN1; (-) strand; PAM type: NRG; PAM sequence: GAG
tacatgtatgtgccattggg

SEQ ID NO: 44317 - DNA, 20 bp, Artificial Sequence
  Description of Artificial Sequence: Synthetic oligonucleotide
  Target: ATXN1; (-) strand; PAM type: NRG; PAM sequence: GGG
cttacatgtatgtgccattg

SEQ ID NO: 44318 - DNA, 20 bp, Artificial Sequence
  Description of Artificial Sequence: Synthetic oligonucleotide
  Target: ATXN1; (-) strand; PAM type: NRG; PAM sequence: GGG
tcttacatgtatgtgccatt

SEQ ID NO: 44319 - DNA, 20 bp, Artificial Sequence
  Description of Artificial Sequence: Synthetic oligonucleotide
  Target: ATXN1; (-) strand; PAM type: NRG; PAM sequence: TGG
ttcttacatgtatgtgccat

SEQ ID NO: 44320 - DNA, 20 bp, Artificial Sequence
  Description of Artificial Sequence: Synthetic oligonucleotide
  Target: ATXN1; (-) strand; PAM type: NRG; PAM sequence: CAG
accccaaaaattgatccact

SEQ ID NO: 44321 - DNA, 20 bp, Artificial Sequence
  Description of Artificial Sequence: Synthetic oligonucleotide
  Target: ATXN1; (-) strand; PAM type: NRG; PAM sequence: TAG
gatattaagacaccggaagt

SEQ ID NO: 44322 - DNA, 20 bp, Artificial Sequence
  Description of Artificial Sequence: Synthetic oligonucleotide
  Target: ATXN1; (-) strand; PAM type: NRG; PAM sequence: AAG
tgaggatattaagacaccgg

SEQ ID NO: 44323 - DNA, 20 bp, Artificial Sequence
  Description of Artificial Sequence: Synthetic oligonucleotide
  Target: ATXN1; (-) strand; PAM type: NRG; PAM sequence: CGG
ggctgaggatattaagacac

SEQ ID NO: 44324 - DNA, 20 bp, Artificial Sequence
  Description of Artificial Sequence: Synthetic oligonucleotide
  Target: ATXN1; (-) strand; PAM type: NRG; PAM sequence: AAG
ctcagtgggctgaggatatt

SEQ ID NO: 44325 - DNA, 20 bp, Artificial Sequence
  Description of Artificial Sequence: Synthetic oligonucleotide
  Target: ATXN1; (-) strand; PAM type: NRG; PAM sequence: AGG
caatttcactcagtgggctg

SEQ ID NO: 44326 - DNA, 20 bp, Artificial Sequence
  Description of Artificial Sequence: Synthetic oligonucleotide
  Target: ATXN1; (-) strand; PAM type: NRG; PAM sequence: GAG
tcaatttcactcagtgggct

SEQ ID NO: 44327 - DNA, 20 bp, Artificial Sequence
  Description of Artificial Sequence: Synthetic oligonucleotide
  Target: ATXN1; (-) strand; PAM type: NRG; PAM sequence: GGG
gtaagtcaatttcactcagt

SEQ ID NO: 44328 - DNA, 20 bp, Artificial Sequence
  Description of Artificial Sequence: Synthetic oligonucleotide
  Target: ATXN1; (-) strand; PAM type: NRG; PAM sequence: TGG
agtaagtcaatttcactcag

SEQ ID NO: 44329 - DNA, 20 bp, Artificial Sequence
  Description of Artificial Sequence: Synthetic oligonucleotide
  Target: ATXN1; (-) strand; PAM type: NRG; PAM sequence: CAG
tctagtaagtcaatttcact

SEQ ID NO: 44330 - DNA, 20 bp, Artificial Sequence
  Description of Artificial Sequence: Synthetic oligonucleotide
  Target: ATXN1; (-) strand; PAM type: NRG; PAM sequence: AAG
ttctatggtagatttctagt

SEQ ID NO: 44331 - DNA, 20 bp, Artificial Sequence
  Description of Artificial Sequence: Synthetic oligonucleotide
  Target: ATXN1; (-) strand; PAM type: NRG; PAM sequence: TAG
agtattctatggtagatttc

SEQ ID NO: 44332 - DNA, 20 bp, Artificial Sequence
  Description of Artificial Sequence: Synthetic oligonucleotide
  Target: ATXN1; (-) strand; PAM type: NRG; PAM sequence: TAG
ggatgttcagtattctatgg

SEQ ID NO: 44333 - DNA, 20 bp, Artificial Sequence
  Description of Artificial Sequence: Synthetic oligonucleotide
  Target: ATXN1; (-) strand; PAM type: NRG; PAM sequence: TGG
ttgggatgttcagtattcta

SEQ ID NO: 44334 - DNA, 20 bp, Artificial Sequence
  Description of Artificial Sequence: Synthetic oligonucleotide
  Target: ATXN1; (-) strand; PAM type: NRG; PAM sequence: CAG
atttggtctgttgggatgtt

SEQ ID NO: 44335 - DNA, 20 bp, Artificial Sequence
  Description of Artificial Sequence: Synthetic oligonucleotide
  Target: ATXN1; (-) strand; PAM type: NRG; PAM sequence: GGG
actcctccatttggtctgtt

SEQ ID NO: 44336 - DNA, 20 bp, Artificial Sequence
  Description of Artificial Sequence: Synthetic oligonucleotide
  Target: ATXN1; (-) strand; PAM type: NRG; PAM sequence: TGG
aactcctccatttggtctgt

SEQ ID NO: 44337 - DNA, 20 bp, Artificial Sequence
  Description of Artificial Sequence: Synthetic oligonucleotide
  Target: ATXN1; (-) strand; PAM type: NRG; PAM sequence: TGG
cgggagccaactcctccatt

SEQ ID NO: 44338 - DNA, 20 bp, Artificial Sequence
  Description of Artificial Sequence: Synthetic oligonucleotide
  Target: ATXN1; (-) strand; PAM type: NRG; PAM sequence: GAG
atctgcagagccaagtgcgg

SEQ ID NO: 44339 - DNA, 20 bp, Artificial Sequence
  Description of Artificial Sequence: Synthetic oligonucleotide
  Target: ATXN1; (-) strand; PAM type: NRG; PAM sequence: GGG
aaatctgcagagccaagtgc

SEQ ID NO: 44340 - DNA, 20 bp, Artificial Sequence
  Description of Artificial Sequence: Synthetic oligonucleotide
  Target: ATXN1; (-) strand; PAM type: NRG; PAM sequence: CGG
aaaatctgcagagccaagtg

SEQ ID NO: 44341 - DNA, 20 bp, Artificial Sequence
  Description of Artificial Sequence: Synthetic oligonucleotide
  Target: ATXN1; (-) strand; PAM type: NRG; PAM sequence: AAG
tccccaaaatctgcagagcc

SEQ ID NO: 44342 - DNA, 20 bp, Artificial Sequence
  Description of Artificial Sequence: Synthetic oligonucleotide
  Target: ATXN1; (-) strand; PAM type: NRG; PAM sequence: GAG
atatgtccccaaaatctgca

SEQ ID NO: 44343 - DNA, 20 bp, Artificial Sequence
  Description of Artificial Sequence: Synthetic oligonucleotide
  Target: ATXN1; (-) strand; PAM type: NRG; PAM sequence: CAG
aaatatgtccccaaaatctg

SEQ ID NO: 44344 - DNA, 20 bp, Artificial Sequence
  Description of Artificial Sequence: Synthetic oligonucleotide
  Target: ATXN1; (-) strand; PAM type: NRG; PAM sequence: AGG
catcctcctttgtattgtgg

SEQ ID NO: 44345 - DNA, 20 bp, Artificial Sequence
  Description of Artificial Sequence: Synthetic oligonucleotide
  Target: ATXN1; (-) strand; PAM type: NRG; PAM sequence: GAG
gcatcctcctttgtattgtg

SEQ ID NO: 44346 - DNA, 20 bp, Artificial Sequence
  Description of Artificial Sequence: Synthetic oligonucleotide
  Target: ATXN1; (-) strand; PAM type: NRG; PAM sequence: TGG
gtgcatcctcctttgtattg

SEQ ID NO: 44347 - DNA, 20 bp, Artificial Sequence
  Description of Artificial Sequence: Synthetic oligonucleotide
  Target: ATXN1; (-) strand; PAM type: NRG; PAM sequence: AGG
agtgaaaccagtagtgtccc

SEQ ID NO: 44348 - DNA, 20 bp, Artificial Sequence
  Description of Artificial Sequence: Synthetic oligonucleotide
  Target: ATXN1; (-) strand; PAM type: NRG; PAM sequence: CAG
cagtgaaaccagtagtgtcc

SEQ ID NO: 44349 - DNA, 20 bp, Artificial Sequence
  Description of Artificial Sequence: Synthetic oligonucleotide
  Target: ATXN1; (-) strand; PAM type: NRG; PAM sequence: TAG
cacaaacacagtgaaaccag

SEQ ID NO: 44350 - DNA, 20 bp, Artificial Sequence
  Description of Artificial Sequence: Synthetic oligonucleotide
  Target: ATXN1; (-) strand; PAM type: NRG; PAM sequence: CAG
gaccacaaacacagtgaaac

SEQ ID NO: 44351 - DNA, 20 bp, Artificial Sequence
  Description of Artificial Sequence: Synthetic oligonucleotide
  Target: ATXN1; (-) strand; PAM type: NRG; PAM sequence: CAG
attcagcatgaccacaaaca

SEQ ID NO: 44352 - DNA, 20 bp, Artificial Sequence
  Description of Artificial Sequence: Synthetic oligonucleotide
  Target: ATXN1; (-) strand; PAM type: NRG; PAM sequence: CAG
gccactgatacaccattatt

SEQ ID NO: 44353 - DNA, 20 bp, Artificial Sequence
  Description of Artificial Sequence: Synthetic oligonucleotide
  Target: ATXN1; (-) strand; PAM type: NRG; PAM sequence: GAG
gggttctggtctctcagcca

SEQ ID NO: 44354 - DNA, 20 bp, Artificial Sequence
  Description of Artificial Sequence: Synthetic oligonucleotide
  Target: ATXN1; (-) strand; PAM type: NRG; PAM sequence: CAG
aagggttctggtctctcagc

SEQ ID NO: 44355 - DNA, 20 bp, Artificial Sequence
  Description of Artificial Sequence: Synthetic oligonucleotide
  Target: ATXN1; (-) strand; PAM type: NRG; PAM sequence: CAG
ctgcaagggttctggtctct

SEQ ID NO: 44356 - DNA, 20 bp, Artificial Sequence
  Description of Artificial Sequence: Synthetic oligonucleotide
  Target: ATXN1; (-) strand; PAM type: NRG; PAM sequence: TGG
tactaaggctgcaagggttc

SEQ ID NO: 44357 - DNA, 20 bp, Artificial Sequence
  Description of Artificial Sequence: Synthetic oligonucleotide
  Target: ATXN1; (-) strand; PAM type: NRG; PAM sequence: GGG
ccctagtactaaggctgcaa

SEQ ID NO: 44358 - DNA, 20 bp, Artificial Sequence
  Description of Artificial Sequence: Synthetic oligonucleotide
  Target: ATXN1; (-) strand; PAM type: NRG; PAM sequence: AGG
gccctagtactaaggctgca

SEQ ID NO: 44359 - DNA, 20 bp, Artificial Sequence
  Description of Artificial Sequence: Synthetic oligonucleotide
  Target: ATXN1; (-) strand; PAM type: NRG; PAM sequence: AAG
ggccctagtactaaggctgc

SEQ ID NO: 44360 - DNA, 20 bp, Artificial Sequence
  Description of Artificial Sequence: Synthetic oligonucleotide
  Target: ATXN1; (-) strand; PAM type: NRG; PAM sequence: AGG
agagtatggccctagtacta

SEQ ID NO: 44361 - DNA, 20 bp, Artificial Sequence
  Description of Artificial Sequence: Synthetic oligonucleotide
  Target: ATXN1; (-) strand; PAM type: NRG; PAM sequence: AAG
gagagtatggccctagtact

SEQ ID NO: 44362 - DNA, 20 bp, Artificial Sequence
  Description of Artificial Sequence: Synthetic oligonucleotide
  Target: ATXN1; (-) strand; PAM type: NRG; PAM sequence: TAG
caggtgagagagtatggccc

SEQ ID NO: 44363 - DNA, 20 bp, Artificial Sequence
  Description of Artificial Sequence: Synthetic oligonucleotide
  Target: ATXN1; (-) strand; PAM type: NRG; PAM sequence: TGG
attctgcaggtgagagagta

SEQ ID NO: 44364 - DNA, 20 bp, Artificial Sequence
  Description of Artificial Sequence: Synthetic oligonucleotide
  Target: ATXN1; (-) strand; PAM type: NRG; PAM sequence: GAG
ttcttattctgcaggtgaga

SEQ ID NO: 44365 - DNA, 20 bp, Artificial Sequence
  Description of Artificial Sequence: Synthetic oligonucleotide
  Target: ATXN1; (-) strand; PAM type: NRG; PAM sequence: GAG
atttcttattctgcaggtga

SEQ ID NO: 44366 - DNA, 20 bp, Artificial Sequence
  Description of Artificial Sequence: Synthetic oligonucleotide
  Target: ATXN1; (-) strand; PAM type: NRG; PAM sequence: GAG
tgatttcttattctgcaggt

SEQ ID NO: 44367 - DNA, 20 bp, Artificial Sequence
  Description of Artificial Sequence: Synthetic oligonucleotide
  Target: ATXN1; (-) strand; PAM type: NRG; PAM sequence: AGG
gcattgatttcttattctgc

SEQ ID NO: 44368 - DNA, 20 bp, Artificial Sequence
  Description of Artificial Sequence: Synthetic oligonucleotide
  Target: ATXN1; (-) strand; PAM type: NRG; PAM sequence: CAG
agcattgatttcttattctg

SEQ ID NO: 44369 - DNA, 20 bp, Artificial Sequence
  Description of Artificial Sequence: Synthetic oligonucleotide
  Target: ATXN1; (-) strand; PAM type: NRG; PAM sequence: CAG
gggtgagtctgatgtgccgt

SEQ ID NO: 44370 - DNA, 20 bp, Artificial Sequence
  Description of Artificial Sequence: Synthetic oligonucleotide
  Target: ATXN1; (-) strand; PAM type: NRG; PAM sequence: GAG
tttttaaaagctccctgggt

SEQ ID NO: 44371 - DNA, 20 bp, Artificial Sequence
  Description of Artificial Sequence: Synthetic oligonucleotide
  Target: ATXN1; (-) strand; PAM type: NRG; PAM sequence: GGG
tatgtttttaaaagctccct

SEQ ID NO: 44372 - DNA, 20 bp, Artificial Sequence
  Description of Artificial Sequence: Synthetic oligonucleotide
  Target: ATXN1; (-) strand; PAM type: NRG; PAM sequence: TGG
ttatgtttttaaaagctccc

SEQ ID NO: 44373 - DNA, 20 bp, Artificial Sequence
  Description of Artificial Sequence: Synthetic oligonucleotide
  Target: ATXN1; (-) strand; PAM type: NRG; PAM sequence: AAG
tctggacattatgtttttaa

SEQ ID NO: 44374 - DNA, 20 bp, Artificial Sequence
  Description of Artificial Sequence: Synthetic oligonucleotide
  Target: ATXN1; (-) strand; PAM type: NRG; PAM sequence: TGG
cagttggtctggggtagatc

SEQ ID NO: 44375 - DNA, 20 bp, Artificial Sequence
  Description of Artificial Sequence: Synthetic oligonucleotide
  Target: ATXN1; (-) strand; PAM type: NRG; PAM sequence: TAG
cttattcagttggtctgggg

SEQ ID NO: 44376 - DNA, 20 bp, Artificial Sequence
  Description of Artificial Sequence: Synthetic oligonucleotide
  Target: ATXN1; (-) strand; PAM type: NRG; PAM sequence: GGG
attcttattcagttggtctg

SEQ ID NO: 44377 - DNA, 20 bp, Artificial Sequence
  Description of Artificial Sequence: Synthetic oligonucleotide
  Target: ATXN1; (-) strand; PAM type: NRG; PAM sequence: GGG
gattcttattcagttggtct

SEQ ID NO: 44378 - DNA, 20 bp, Artificial Sequence
  Description of Artificial Sequence: Synthetic oligonucleotide
  Target: ATXN1; (-) strand; PAM type: NRG; PAM sequence: TGG
ggattcttattcagttggtc

SEQ ID NO: 44379 - DNA, 20 bp, Artificial Sequence
  Description of Artificial Sequence: Synthetic oligonucleotide
  Target: ATXN1; (-) strand; PAM type: NRG; PAM sequence: TGG
tctagggattcttattcagt

SEQ ID NO: 44380 - DNA, 20 bp, Artificial Sequence
  Description of Artificial Sequence: Synthetic oligonucleotide
  Target: ATXN1; (-) strand; PAM type: NRG; PAM sequence: CAG
aacatctagggattcttatt

SEQ ID NO: 44381 - DNA, 20 bp, Artificial Sequence
  Description of Artificial Sequence: Synthetic oligonucleotide
  Target: ATXN1; (-) strand; PAM type: NRG; PAM sequence: GGG
agtggtggtcccaacatcta

SEQ ID NO: 44382 - DNA, 20 bp, Artificial Sequence
  Description of Artificial Sequence: Synthetic oligonucleotide
  Target: ATXN1; (-) strand; PAM type: NRG; PAM sequence: AGG
cagtggtggtcccaacatct

SEQ ID NO: 44383 - DNA, 20 bp, Artificial Sequence
  Description of Artificial Sequence: Synthetic oligonucleotide
  Target: ATXN1; (-) strand; PAM type: NRG; PAM sequence: TAG
ccagtggtggtcccaacatc

SEQ ID NO: 44384 - DNA, 20 bp, Artificial Sequence
  Description of Artificial Sequence: Synthetic oligonucleotide
  Target: ATXN1; (-) strand; PAM type: NRG; PAM sequence: TGG
atttcctaaaatgccagtgg

SEQ ID NO: 44385 - DNA, 20 bp, Artificial Sequence
  Description of Artificial Sequence: Synthetic oligonucleotide
  Target: ATXN1; (-) strand; PAM type: NRG; PAM sequence: TGG
tgcatttcctaaaatgccag

SEQ ID NO: 44386 - DNA, 20 bp, Artificial Sequence
  Description of Artificial Sequence: Synthetic oligonucleotide
  Target: ATXN1; (-) strand; PAM type: NRG; PAM sequence: CAG
tggtgcatttcctaaaatgc

SEQ ID NO: 44387 - DNA, 20 bp, Artificial Sequence
  Description of Artificial Sequence: Synthetic oligonucleotide
  Target: ATXN1; (-) strand; PAM type: NRG; PAM sequence: TGG
ggctgcaaattagaatcccc

SEQ ID NO: 44388 - DNA, 20 bp, Artificial Sequence
  Description of Artificial Sequence: Synthetic oligonucleotide
  Target: ATXN1; (-) strand; PAM type: NRG; PAM sequence: TAG
tctcacctctggctgcaaat

SEQ ID NO: 44389 - DNA, 20 bp, Artificial Sequence
  Description of Artificial Sequence: Synthetic oligonucleotide
  Target: ATXN1; (-) strand; PAM type: NRG; PAM sequence: TGG
ataccagaggttctcacctc

SEQ ID NO: 44390 - DNA, 20 bp, Artificial Sequence
  Description of Artificial Sequence: Synthetic oligonucleotide
  Target: ATXN1; (-) strand; PAM type: NRG; PAM sequence: AGG
aaaaaaatcctctataccag

SEQ ID NO: 44391 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaatcctctatacca

SEQ ID NO: 44392 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaatcctctatac

SEQ ID NO: 44393 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggggacagagc

SEQ ID NO: 44394 - DNA, 20 bp, Artificial Sequence
  Description of Artificial Sequence: Synthetic oligonucleotide
  Target: ATXN1; (-) strand; PAM type: NRG; PAM sequence: GAG
gcattccagcctgggggaca

SEQ ID NO: 44395 - DNA, 20 bp, Artificial Sequence
  Description of Artificial Sequence: Synthetic oligonucleotide
  Target: ATXN1; (-) strand; PAM type: NRG; PAM sequence: CAG
ctgcattccagcctggggga

SEQ ID NO: 44396 - DNA, 20 bp, Artificial Sequence
  Description of Artificial Sequence: Synthetic oligonucleotide
  Target: ATXN1; (-) strand; PAM type: NRG; PAM sequence: GGG
gccactgcattccagcctgg

SEQ ID NO: 44397 - DNA, 20 bp, Artificial Sequence
  Description of Artificial Sequence: Synthetic oligonucleotide
  Target: ATXN1; (-) strand; PAM type: NRG; PAM sequence: GGG
cgccactgcattccagcctg

SEQ ID NO: 44398 - DNA, 20 bp, Artificial Sequence
  Description of Artificial Sequence: Synthetic oligonucleotide
  Target: ATXN1; (-) strand; PAM type: NRG; PAM sequence: GGG
acgccactgcattccagcct

SEQ ID NO: 44399 - DNA, 20 bp, Artificial Sequence
  Description of Artificial Sequence: Synthetic oligonucleotide
  Target: ATXN1; (-) strand; PAM type: NRG; PAM sequence: TGG
cacgccactgcattccagcc

SEQ ID NO: 44400 - DNA, 20 bp, Artificial Sequence
  Description of Artificial Sequence: Synthetic oligonucleotide
  Target: ATXN1; (-) strand; PAM type: NRG; PAM sequence: CAG
gagatcacgccactgcattc

SEQ ID NO: 44401 - DNA, 20 bp, Artificial Sequence
  Description of Artificial Sequence: Synthetic oligonucleotide
  Target: ATXN1; (-) strand; PAM type: NRG; PAM sequence: GAG
ggtggagcttgcagtgagcc

SEQ ID NO: 44402 - DNA, 20 bp, Artificial Sequence
  Description of Artificial Sequence: Synthetic oligonucleotide
  Target: ATXN1; (-) strand; PAM type: NRG; PAM sequence: GAG
cgggaggtggagcttgcagt

SEQ ID NO: 44403 - DNA, 20 bp, Artificial Sequence
  Description of Artificial Sequence: Synthetic oligonucleotide
  Target: ATXN1; (-) strand; PAM type: NRG; PAM sequence: CAG
aacccgggaggtggagcttg

SEQ ID NO: 44404 - DNA, 20 bp, Artificial Sequence
  Description of Artificial Sequence: Synthetic oligonucleotide
  Target: ATXN1; (-) strand; PAM type: NRG; PAM sequence: GAG
tggtgtgaacccgggaggtg

SEQ ID NO: 44405 - DNA, 20 bp, Artificial Sequence
  Description of Artificial Sequence: Synthetic oligonucleotide
  Target: ATXN1; (-) strand; PAM type: NRG; PAM sequence: TGG
aatggtgtgaacccgggagg

SEQ ID NO: 44406 - DNA, 20 bp, Artificial Sequence
  Description of Artificial Sequence: Synthetic oligonucleotide
  Target: ATXN1; (-) strand; PAM type: NRG; PAM sequence: AGG
gagaatggtgtgaacccggg

SEQ ID NO: 44407 - DNA, 20 bp, Artificial Sequence
  Description of Artificial Sequence: Synthetic oligonucleotide
  Target: ATXN1; (-) strand; PAM type: NRG; PAM sequence: GAG
ggagaatggtgtgaacccgg

SEQ ID NO: 44408 - DNA, 20 bp, Artificial Sequence
  Description of Artificial Sequence: Synthetic oligonucleotide
  Target: ATXN1; (-) strand; PAM type: NRG; PAM sequence: GGG
caggagaatggtgtgaaccc

SEQ ID NO: 44409 - DNA, 20 bp, Artificial Sequence
  Description of Artificial Sequence: Synthetic oligonucleotide
  Target: ATXN1; (-) strand; PAM type: NRG; PAM sequence: CGG
gcaggagaatggtgtgaacc

SEQ ID NO: 44410 - DNA, 20 bp, Artificial Sequence
  Description of Artificial Sequence: Synthetic oligonucleotide
  Target: ATXN1; (-) strand; PAM type: NRG; PAM sequence: TGG
gggaggctgaggcaggagaa

SEQ ID NO: 44411 - DNA, 20 bp, Artificial Sequence
  Description of Artificial Sequence: Synthetic oligonucleotide
  Target: ATXN1; (-) strand; PAM type: NRG; PAM sequence: GAG
cactcgggaggctgaggcag

SEQ ID NO: 44412 - DNA, 20 bp, Artificial Sequence
  Description of Artificial Sequence: Synthetic oligonucleotide
  Target: ATXN1; (-) strand; PAM type: NRG; PAM sequence: AGG
gccactcgggaggctgaggc

SEQ ID NO: 44413 - DNA, 20 bp, Artificial Sequence
  Description of Artificial Sequence: Synthetic oligonucleotide
  Target: ATXN1; (-) strand; PAM type: NRG; PAM sequence: CAG
agccactcgggaggctgagg

SEQ ID NO: 44414 - DNA, 20 bp, Artificial Sequence
  Description of Artificial Sequence: Synthetic oligonucleotide
  Target: ATXN1; (-) strand; PAM type: NRG; PAM sequence: AGG
cccagccactcgggaggctg

SEQ ID NO: 44415 - DNA, 20 bp, Artificial Sequence
  Description of Artificial Sequence: Synthetic oligonucleotide
  Target: ATXN1; (-) strand; PAM type: NRG; PAM sequence: GAG
tcccagccactcgggaggct

SEQ ID NO: 44416 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagccactcggg

SEQ ID NO: 44417 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagccactcgg

SEQ ID NO: 44418 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcccagccactc

SEQ ID NO: 44419 - DNA, 20 bp, Artificial Sequence
  Description of Artificial Sequence: Synthetic oligonucleotide
  Target: ATXN1; (-) strand; PAM type: NRG; PAM sequence: CGG
tgcctgtagtcccagccact

SEQ ID NO: 44420 - DNA, 20 bp, Artificial Sequence
  Description of Artificial Sequence: Synthetic oligonucleotide
  Target: ATXN1; (-) strand; PAM type: NRG; PAM sequence: CAG
gtggtgggtgcctgtagtcc

SEQ ID NO: 44421 - DNA, 20 bp, Artificial Sequence
  Description of Artificial Sequence: Synthetic oligonucleotide
  Target: ATXN1; (-) strand; PAM type: NRG; PAM sequence: TAG
ggcgtggtggtgggtgcctg

SEQ ID NO: 44422 - DNA, 20 bp, Artificial Sequence
  Description of Artificial Sequence: Synthetic oligonucleotide
  Target: ATXN1; (-) strand; PAM type: NRG; PAM sequence: GGG
aattagccaggcgtggtggt

SEQ ID NO: 44423 - DNA, 20 bp, Artificial Sequence
  Description of Artificial Sequence: Synthetic oligonucleotide
  Target: ATXN1; (-) strand; PAM type: NRG; PAM sequence: TGG
aaattagccaggcgtggtgg

SEQ ID NO: 44424 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggcgtgg

SEQ ID NO: 44425 - DNA, 20 bp, Artificial Sequence
  Description of Artificial Sequence: Synthetic oligonucleotide
  Target: ATXN1; (-) strand; PAM type: NRG; PAM sequence: TGG
acaaaaaaattagccaggcg

SEQ ID NO: 44426 - DNA, 20 bp, Artificial Sequence
  Description of Artificial Sequence: Synthetic oligonucleotide
  Target: ATXN1; (-) strand; PAM type: NRG; PAM sequence: AGG
aaaatacaaaaaaattagcc

SEQ ID NO: 44427 - DNA, 20 bp, Artificial Sequence
  Description of Artificial Sequence: Synthetic oligonucleotide
  Target: ATXN1; (-) strand; PAM type: NRG; PAM sequence: CAG
aaaaatacaaaaaaattagc

SEQ ID NO: 44428 - DNA, 20 bp, Artificial Sequence
  Description of Artificial Sequence: Synthetic oligonucleotide
  Target: ATXN1; (-) strand; PAM type: NRG; PAM sequence: TAG
tactaaaaatacaaaaaaat

SEQ ID NO: 44429 - DNA, 20 bp, Artificial Sequence
  Description of Artificial Sequence: Synthetic oligonucleotide
  Target: ATXN1; (-) strand; PAM type: NRG; PAM sequence: CGG
caagaccatcctggctaaca

SEQ ID NO: 44430 - DNA, 20 bp, Artificial Sequence
  Description of Artificial Sequence: Synthetic oligonucleotide
  Target: ATXN1; (-) strand; PAM type: NRG; PAM sequence: TGG
tcaggagatcaagaccatcc

SEQ ID NO: 44431 - DNA, 20 bp, Artificial Sequence
  Description of Artificial Sequence: Synthetic oligonucleotide
  Target: ATXN1; (-) strand; PAM type: NRG; PAM sequence: AAG
gatcaagaggtcaggagatc

SEQ ID NO: 44432 - DNA, 20 bp, Artificial Sequence
  Description of Artificial Sequence: Synthetic oligonucleotide
  Target: ATXN1; (-) strand; PAM type: NRG; PAM sequence: GAG
caggcagatcaagaggtcag

SEQ ID NO: 44433 - DNA, 20 bp, Artificial Sequence
  Description of Artificial Sequence: Synthetic oligonucleotide
  Target: ATXN1; (-) strand; PAM type: NRG; PAM sequence: AGG
ggcaggcagatcaagaggtc

SEQ ID NO: 44434 - DNA, 20 bp, Artificial Sequence
  Description of Artificial Sequence: Synthetic oligonucleotide
  Target: ATXN1; (-) strand; PAM type: NRG; PAM sequence: CAG
aggcaggcagatcaagaggt

SEQ ID NO: 44435 - DNA, 20 bp, Artificial Sequence
  Description of Artificial Sequence: Synthetic oligonucleotide
  Target: ATXN1; (-) strand; PAM type: NRG; PAM sequence: AGG
gccgaggcaggcagatcaag

SEQ ID NO: 44436 - DNA, 20 bp, Artificial Sequence
  Description of Artificial Sequence: Synthetic oligonucleotide
  Target: ATXN1; (-) strand; PAM type: NRG; PAM sequence: GAG
ggccgaggcaggcagatcaa

SEQ ID NO: 44437 - DNA, 20 bp, Artificial Sequence
  Description of Artificial Sequence: Synthetic oligonucleotide
  Target: ATXN1; (-) strand; PAM type: NRG; PAM sequence: AAG
gaggccgaggcaggcagatc

SEQ ID NO: 44438 - DNA, 20 bp, Artificial Sequence
  Description of Artificial Sequence: Synthetic oligonucleotide
  Target: ATXN1; (-) strand; PAM type: NRG; PAM sequence: CAG
ctttgggaggccgaggcagg

SEQ ID NO: 44439 - DNA, 20 bp, Artificial Sequence
  Description of Artificial Sequence: Synthetic oligonucleotide
  Target: ATXN1; (-) strand; PAM type: NRG; PAM sequence: AGG
gtactttgggaggccgaggc

SEQ ID NO: 44440 - DNA, 20 bp, Artificial Sequence
  Description of Artificial Sequence: Synthetic oligonucleotide
  Target: ATXN1; (-) strand; PAM type: NRG; PAM sequence: CAG
agtactttgggaggccgagg

SEQ ID NO: 44441 - DNA, 20 bp, Artificial Sequence
  Description of Artificial Sequence: Synthetic oligonucleotide
  Target: ATXN1; (-) strand; PAM type: NRG; PAM sequence: AGG
cccagtactttgggaggccg

SEQ ID NO: 44442 - DNA, 20 bp, Artificial Sequence
  Description of Artificial Sequence: Synthetic oligonucleotide
  Target: ATXN1; (-) strand; PAM type: NRG; PAM sequence: GAG
tcccagtactttgggaggcc

SEQ ID NO: 44443 - DNA, 20 bp, Artificial Sequence
  Description of Artificial Sequence: Synthetic oligonucleotide
  Target: ATXN1; (-) strand; PAM type: NRG; PAM sequence: AGG
tataatcccagtactttggg

SEQ ID NO: 44444 - DNA, 20 bp, Artificial Sequence
  Description of Artificial Sequence: Synthetic oligonucleotide
  Target: ATXN1; (-) strand; PAM type: NRG; PAM sequence: GAG
ctataatcccagtactttgg

SEQ ID NO: 44445 - DNA, 20 bp, Artificial Sequence
  Description of Artificial Sequence: Synthetic oligonucleotide
  Target: ATXN1; (-) strand; PAM type: NRG; PAM sequence: GGG
gcctataatcccagtacttt

SEQ ID NO: 44446 - DNA, 20 bp, Artificial Sequence
  Description of Artificial Sequence: Synthetic oligonucleotide
  Target: ATXN1; (-) strand; PAM type: NRG; PAM sequence: TGG
cgcctataatcccagtactt

SEQ ID NO: 44447 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctataatcc

SEQ ID NO: 44448 - DNA, 20 bp, Artificial Sequence
  Description of Artificial Sequence: Synthetic oligonucleotide
  Target: ATXN1; (-) strand; PAM type: NRG; PAM sequence: TGG
tctataccagccgggtgcgg

SEQ ID NO: 44449 - DNA, 20 bp, Artificial Sequence
  Description of Artificial Sequence: Synthetic oligonucleotide
  Target: ATXN1; (-) strand; PAM type: NRG; PAM sequence: CGG
tcctctataccagccgggtg

SEQ ID NO: 44450 - DNA, 20 bp, Artificial Sequence
  Description of Artificial Sequence: Synthetic oligonucleotide
  Target: ATXN1; (-) strand; PAM type: NRG; PAM sequence: GGG
aaagatcctctataccagcc

SEQ ID NO: 44451 - DNA, 20 bp, Artificial Sequence
  Description of Artificial Sequence: Synthetic oligonucleotide
  Target: ATXN1; (-) strand; PAM type: NRG; PAM sequence: CGG
taaagatcctctataccagc

SEQ ID NO: 44452 - DNA, 20 bp, Artificial Sequence
  Description of Artificial Sequence: Synthetic oligonucleotide
  Target: ATXN1; (-) strand; PAM type: NRG; PAM sequence: CAG
ggcttaaagatcctctatac

SEQ ID NO: 44453 - DNA, 20 bp, Artificial Sequence
  Description of Artificial Sequence: Synthetic oligonucleotide
  Target: ATXN1; (-) strand; PAM type: NRG; PAM sequence: AAG
agatggagttagggggctta

SEQ ID NO: 44454 - DNA, 20 bp, Artificial Sequence
  Description of Artificial Sequence: Synthetic oligonucleotide
  Target: ATXN1; (-) strand; PAM type: NRG; PAM sequence: GGG
caaggacagatggagttagg

SEQ ID NO: 44455 - DNA, 20 bp, Artificial Sequence
  Description of Artificial Sequence: Synthetic oligonucleotide
  Target: ATXN1; (-) strand; PAM type: NRG; PAM sequence: GGG
ccaaggacagatggagttag

SEQ ID NO: 44456 - DNA, 20 bp, Artificial Sequence
  Description of Artificial Sequence: Synthetic oligonucleotide
  Target: ATXN1; (-) strand; PAM type: NRG; PAM sequence: GGG
gccaaggacagatggagtta

SEQ ID NO: 44457 - DNA, 20 bp, Artificial Sequence
  Description of Artificial Sequence: Synthetic oligonucleotide
  Target: ATXN1; (-) strand; PAM type: NRG; PAM sequence: AGG
tgccaaggacagatggagtt

SEQ ID NO: 44458 - DNA, 20 bp, Artificial Sequence
  Description of Artificial Sequence: Synthetic oligonucleotide
  Target: ATXN1; (-) strand; PAM type: NRG; PAM sequence: TAG
ctgccaaggacagatggagt

SEQ ID NO: 44459 - DNA, 20 bp, Artificial Sequence
  Description of Artificial Sequence: Synthetic oligonucleotide
  Target: ATXN1; (-) strand; PAM type: NRG; PAM sequence: GAG
catactgccaaggacagatg

SEQ ID NO: 44460 - DNA, 20 bp, Artificial Sequence
  Description of Artificial Sequence: Synthetic oligonucleotide
  Target: ATXN1; (-) strand; PAM type: NRG; PAM sequence: TGG
gacatactgccaaggacaga

SEQ ID NO: 44461 - DNA, 20 bp, Artificial Sequence
  Description of Artificial Sequence: Synthetic oligonucleotide
  Target: ATXN1; (-) strand; PAM type: NRG; PAM sequence: CAG
ctgagacatactgccaagga

SEQ ID NO: 44462 - DNA, 20 bp, Artificial Sequence
  Description of Artificial Sequence: Synthetic oligonucleotide
  Target: ATXN1; (-) strand; PAM type: NRG; PAM sequence: AGG
atcactgagacatactgcca

SEQ ID NO: 44463 - DNA, 20 bp, Artificial Sequence
  Description of Artificial Sequence: Synthetic oligonucleotide
  Target: ATXN1; (-) strand; PAM type: NRG; PAM sequence: AAG
aatcactgagacatactgcc

SEQ ID NO: 44464 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaaaaaaaatcact

SEQ ID NO: 44465 - DNA, 20 bp, Artificial Sequence
  Description of Artificial Sequence: Synthetic oligonucleotide
  Target: ATXN1; (-) strand; PAM type: NRG; PAM sequence: GAG
accagcctgggtgacagagc

SEQ ID NO: 44466 - DNA, 20 bp, Artificial Sequence
  Description of Artificial Sequence: Synthetic oligonucleotide
  Target: ATXN1; (-) strand; PAM type: NRG; PAM sequence: GAG
gcacaccagcctgggtgaca

SEQ ID NO: 44467 - DNA, 20 bp, Artificial Sequence
  Description of Artificial Sequence: Synthetic oligonucleotide
  Target: ATXN1; (-) strand; PAM type: NRG; PAM sequence: CAG
ttgcacaccagcctgggtga

SEQ ID NO: 44468 - DNA, 20 bp, Artificial Sequence
  Description of Artificial Sequence: Synthetic oligonucleotide
  Target: ATXN1; (-) strand; PAM type: NRG; PAM sequence: GGG
cacccattgcacaccagcct

SEQ ID NO: 44469 - DNA, 20 bp, Artificial Sequence
  Description of Artificial Sequence: Synthetic oligonucleotide
  Target: ATXN1; (-) strand; PAM type: NRG; PAM sequence: TGG
gcacccattgcacaccagcc

SEQ ID NO: 44470 - DNA, 20 bp, Artificial Sequence
  Description of Artificial Sequence: Synthetic oligonucleotide
  Target: ATXN1; (-) strand; PAM type: NRG; PAM sequence: CAG
agactgcacccattgcacac

SEQ ID NO: 44471 - DNA, 20 bp, Artificial Sequence
  Description of Artificial Sequence: Synthetic oligonucleotide
  Target: ATXN1; (-) strand; PAM type: NRG; PAM sequence: GAG
cctgggaggtgcagtgagcc

SEQ ID NO: 44472 - DNA, 20 bp, Artificial Sequence
  Description of Artificial Sequence: Synthetic oligonucleotide
  Target: ATXN1; (-) strand; PAM type: NRG; PAM sequence: GAG
ttgaacctgggaggtgcagt

SEQ ID NO: 44473 - DNA, 20 bp, Artificial Sequence
  Description of Artificial Sequence: Synthetic oligonucleotide
  Target: ATXN1; (-) strand; PAM type: NRG; PAM sequence: CAG
tcacttgaacctgggaggtg

SEQ ID NO: 44474 - DNA, 20 bp, Artificial Sequence
  Description of Artificial Sequence: Synthetic oligonucleotide
  Target: ATXN1; (-) strand; PAM type: NRG; PAM sequence: AGG
gagaatcacttgaacctggg

SEQ ID NO: 44475 - DNA, 20 bp, Artificial Sequence
  Description of Artificial Sequence: Synthetic oligonucleotide
  Target: ATXN1; (-) strand; PAM type: NRG; PAM sequence: GAG
ggagaatcacttgaacctgg

SEQ ID NO: 44476 - DNA, 20 bp, Artificial Sequence
  Description of Artificial Sequence: Synthetic oligonucleotide
  Target: ATXN1; (-) strand; PAM type: NRG; PAM sequence: GGG
caggagaatcacttgaacct

SEQ ID NO: 44477 - DNA, 20 bp, Artificial Sequence
  Description of Artificial Sequence: Synthetic oligonucleotide
  Target: ATXN1; (-) strand; PAM type: NRG; PAM sequence: TGG
gcaggagaatcacttgaacc

SEQ ID NO: 44478 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcag

SEQ ID NO: 44479 - DNA, 20 bp, Artificial Sequence
  Description of Artificial Sequence: Synthetic oligonucleotide
  Target: ATXN1; (-) strand; PAM type: NRG; PAM sequence: AGG
actacttgggaggctgaggc

SEQ ID NO: 44480 - DNA, 20 bp, Artificial Sequence
  Description of Artificial Sequence: Synthetic oligonucleotide
  Target: ATXN1; (-) strand; PAM type: NRG; PAM sequence: CAG
aactacttgggaggctgagg

SEQ ID NO: 44481 - DNA, 20 bp, Artificial Sequence
  Description of Artificial Sequence: Synthetic oligonucleotide
  Target: ATXN1; (-) strand; PAM type: NRG; PAM sequence: AGG
cccaactacttgggaggctg

SEQ ID NO: 44482 - DNA, 20 bp, Artificial Sequence
  Description of Artificial Sequence: Synthetic oligonucleotide
  Target: ATXN1; (-) strand; PAM type: NRG; PAM sequence: GAG
tcccaactacttgggaggct

SEQ ID NO: 44483 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccaactacttggg

SEQ ID NO: 44484 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccaactacttgg

SEQ ID NO: 44485 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccaactactt

SEQ ID NO: 44486 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccaactact

SEQ ID NO: 44487 - DNA, 20 bp, Artificial Sequence
  Description of Artificial Sequence: Synthetic oligonucleotide
  Target: ATXN1; (-) strand; PAM type: NRG; PAM sequence: AGG
acatagccaggtgtggtggc

SEQ ID NO: 44488 - DNA, 20 bp, Artificial Sequence
  Description of Artificial Sequence: Synthetic oligonucleotide
  Target: ATXN1; (-) strand; PAM type: NRG; PAM sequence: CAG
aacatagccaggtgtggtgg

SEQ ID NO: 44489 - DNA, 20 bp, Artificial Sequence
  Description of Artificial Sequence: Synthetic oligonucleotide
  Target: ATXN1; (-) strand; PAM type: NRG; PAM sequence: TGG
aataacatagccaggtgtgg

SEQ ID NO: 44490 - DNA, 20 bp, Artificial Sequence
  Description of Artificial Sequence: Synthetic oligonucleotide
  Target: ATXN1; (-) strand; PAM type: NRG; PAM sequence: TGG
aaaaataacatagccaggtg

SEQ ID NO: 44491 - DNA, 20 bp, Artificial Sequence
  Description of Artificial Sequence: Synthetic oligonucleotide
  Target: ATXN1; (-) strand; PAM type: NRG; PAM sequence: AGG
aaaataaaaataacatagcc

SEQ ID NO: 44492 - DNA, 20 bp, Artificial Sequence
  Description of Artificial Sequence: Synthetic oligonucleotide
  Target: ATXN1; (-) strand; PAM type: NRG; PAM sequence: CAG
aaaaataaaaataacatagc

SEQ ID NO: 44493 - DNA, 20 bp, Artificial Sequence
  Description of Artificial Sequence: Synthetic oligonucleotide
  Target: ATXN1; (-) strand; PAM type: NRG; PAM sequence: TAG
aaataaaaataaaaataaca

SEQ ID NO: 44494 - DNA, 20 bp, Artificial Sequence
  Description of Artificial Sequence: Synthetic oligonucleotide
  Target: ATXN1; (-) strand; PAM type: NRG; PAM sequence: TGG
tgagaccagcctggccaaca

SEQ ID NO: 44495 - DNA, 20 bp, Artificial Sequence
  Description of Artificial Sequence: Synthetic oligonucleotide
  Target: ATXN1; (-) strand; PAM type: NRG; PAM sequence: TGG
tcaggagtttgagaccagcc

SEQ ID NO: 44496 - DNA, 20 bp, Artificial Sequence
  Description of Artificial Sequence: Synthetic oligonucleotide
  Target: ATXN1; (-) strand; PAM type: NRG; PAM sequence: CAG
tcaggtcaggagtttgagac

SEQ ID NO: 44497 - DNA, 20 bp, Artificial Sequence
  Description of Artificial Sequence: Synthetic oligonucleotide
  Target: ATXN1; (-) strand; PAM type: NRG; PAM sequence: GAG
atcgctcaggtcaggagttt

SEQ ID NO: 44498 - DNA, 20 bp, Artificial Sequence
  Description of Artificial Sequence: Synthetic oligonucleotide
  Target: ATXN1; (-) strand; PAM type: NRG; PAM sequence: GAG
aggtggatcgctcaggtcag

SEQ ID NO: 44499 - DNA, 20 bp, Artificial Sequence
  Description of Artificial Sequence: Synthetic oligonucleotide
  Target: ATXN1; (-) strand; PAM type: NRG; PAM sequence: AGG
gtaggtggatcgctcaggtc

SEQ ID NO: 44500 - DNA, 20 bp, Artificial Sequence
  Description of Artificial Sequence: Synthetic oligonucleotide
  Target: ATXN1; (-) strand; PAM type: NRG; PAM sequence: CAG
ggtaggtggatcgctcaggt

SEQ ID NO: 44501 - DNA, 20 bp, Artificial Sequence
  Description of Artificial Sequence: Synthetic oligonucleotide
  Target: ATXN1; (-) strand; PAM type: NRG; PAM sequence: AGG
ccaaggtaggtggatcgctc

SEQ ID NO: 44502 - DNA, 20 bp, Artificial Sequence
  Description of Artificial Sequence: Synthetic oligonucleotide
  Target: ATXN1; (-) strand; PAM type: NRG; PAM sequence: CAG
gccaaggtaggtggatcgct

SEQ ID NO: 44503 - DNA, 20 bp, Artificial Sequence
  Description of Artificial Sequence: Synthetic oligonucleotide
  Target: ATXN1; (-) strand; PAM type: NRG; PAM sequence: TGG
cgttgggaggccaaggtagg

SEQ ID NO: 44504 - DNA, 20 bp, Artificial Sequence
  Description of Artificial Sequence: Synthetic oligonucleotide
  Target: ATXN1; (-) strand; PAM type: NRG; PAM sequence: AGG
gcacgttgggaggccaaggt

SEQ ID NO: 44505 - DNA, 20 bp, Artificial Sequence
  Description of Artificial Sequence: Synthetic oligonucleotide
  Target: ATXN1; (-) strand; PAM type: NRG; PAM sequence: TAG
agcacgttgggaggccaagg

SEQ ID NO: 44506 - DNA, 20 bp, Artificial Sequence
  Description of Artificial Sequence: Synthetic oligonucleotide
  Target: ATXN1; (-) strand; PAM type: NRG; PAM sequence: AGG
cccagcacgttgggaggcca

SEQ ID NO: 44507 - DNA, 20 bp, Artificial Sequence
  Description of Artificial Sequence: Synthetic oligonucleotide
  Target: ATXN1; (-) strand; PAM type: NRG; PAM sequence: AAG
tcccagcacgttgggaggcc

SEQ ID NO: 44508 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcacgttggg

SEQ ID NO: 44509 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcacgttgg

SEQ ID NO: 44510 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacgtt

SEQ ID NO: 44511 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcacgt

SEQ ID NO: 44512 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 44513 - DNA, 20 bp, Artificial Sequence
  Description of Artificial Sequence: Synthetic oligonucleotide
  Target: ATXN1; (-) strand; PAM type: NRG; PAM sequence: TGG
ctgagacaggccgggctcag

SEQ ID NO: 44514 - DNA, 20 bp, Artificial Sequence
  Description of Artificial Sequence: Synthetic oligonucleotide
  Target: ATXN1; (-) strand; PAM type: NRG; PAM sequence: CAG
tcactgagacaggccgggct

SEQ ID NO: 44515 - DNA, 20 bp, Artificial Sequence
  Description of Artificial Sequence: Synthetic oligonucleotide
  Target: ATXN1; (-) strand; PAM type: NRG; PAM sequence: GGG
taaaatcactgagacaggcc

SEQ ID NO: 44516 - DNA, 20 bp, Artificial Sequence
  Description of Artificial Sequence: Synthetic oligonucleotide
  Target: ATXN1; (-) strand; PAM type: NRG; PAM sequence: CGG
ttaaaatcactgagacaggc

SEQ ID NO: 44517 - DNA, 20 bp, Artificial Sequence
  Description of Artificial Sequence: Synthetic oligonucleotide
  Target: ATXN1; (-) strand; PAM type: NRG; PAM sequence: AGG
gtaattaaaatcactgagac

SEQ ID NO: 44518 - DNA, 20 bp, Artificial Sequence
  Description of Artificial Sequence: Synthetic oligonucleotide
  Target: ATXN1; (-) strand; PAM type: NRG; PAM sequence: CAG
tgtaattaaaatcactgaga

SEQ ID NO: 44519 - DNA, 20 bp, Artificial Sequence
  Description of Artificial Sequence: Synthetic oligonucleotide
  Target: ATXN1; (-) strand; PAM type: NRG; PAM sequence: GAG
ctgctgtaattaaaatcact

SEQ ID NO: 44520 - DNA, 20 bp, Artificial Sequence
  Description of Artificial Sequence: Synthetic oligonucleotide
  Target: ATXN1; (-) strand; PAM type: NRG; PAM sequence: TGG
ggcaaagtggggaaaaggat

SEQ ID NO: 44521 - DNA, 20 bp, Artificial Sequence
  Description of Artificial Sequence: Synthetic oligonucleotide
  Target: ATXN1; (-) strand; PAM type: NRG; PAM sequence: AGG
gtgttggcaaagtggggaaa

SEQ ID NO: 44522 - DNA, 20 bp, Artificial Sequence
  Description of Artificial Sequence: Synthetic oligonucleotide
  Target: ATXN1; (-) strand; PAM type: NRG; PAM sequence: AAG
tgtgttggcaaagtggggaa

SEQ ID NO: 44523 - DNA, 20 bp, Artificial Sequence
  Description of Artificial Sequence: Synthetic oligonucleotide
  Target: ATXN1; (-) strand; PAM type: NRG; PAM sequence: GGG
acttttgtgttggcaaagtg

SEQ ID NO: 44524 - DNA, 20 bp, Artificial Sequence
  Description of Artificial Sequence: Synthetic oligonucleotide
  Target: ATXN1; (-) strand; PAM type: NRG; PAM sequence: GGG
gacttttgtgttggcaaagt

SEQ ID NO: 44525 - DNA, 20 bp, Artificial Sequence
  Description of Artificial Sequence: Synthetic oligonucleotide
  Target: ATXN1; (-) strand; PAM type: NRG; PAM sequence: TGG
cgacttttgtgttggcaaag

SEQ ID NO: 44526 - DNA, 20 bp, Artificial Sequence
  Description of Artificial Sequence: Synthetic oligonucleotide
  Target: ATXN1; (-) strand; PAM type: NRG; PAM sequence: AAG
acacgacttttgtgttggca

SEQ ID NO: 44527 - DNA, 20 bp, Artificial Sequence
  Description of Artificial Sequence: Synthetic oligonucleotide
  Target: ATXN1; (-) strand; PAM type: NRG; PAM sequence: TGG
ttagaacacgacttttgtgt

SEQ ID NO: 44528 - DNA, 20 bp, Artificial Sequence
  Description of Artificial Sequence: Synthetic oligonucleotide
  Target: ATXN1; (-) strand; PAM type: NRG; PAM sequence: TAG
taagtatgattaaaggaggt

SEQ ID NO: 44529 - DNA, 20 bp, Artificial Sequence
  Description of Artificial Sequence: Synthetic oligonucleotide
  Target: ATXN1; (-) strand; PAM type: NRG; PAM sequence: AGG
attttaagtatgattaaagg

SEQ ID NO: 44530 - DNA, 20 bp, Artificial Sequence
  Description of Artificial Sequence: Synthetic oligonucleotide
  Target: ATXN1; (-) strand; PAM type: NRG; PAM sequence: GAG
aattttaagtatgattaaag

SEQ ID NO: 44531 - DNA, 20 bp, Artificial Sequence
  Description of Artificial Sequence: Synthetic oligonucleotide
  Target: ATXN1; (-) strand; PAM type: NRG; PAM sequence: AGG
ataattttaagtatgattaa

SEQ ID NO: 44532 - DNA, 20 bp, Artificial Sequence
  Description of Artificial Sequence: Synthetic oligonucleotide
  Target: ATXN1; (-) strand; PAM type: NRG; PAM sequence: AAG
tataattttaagtatgatta

SEQ ID NO: 44533 - DNA, 20 bp, Artificial Sequence
  Description of Artificial Sequence: Synthetic oligonucleotide
  Target: ATXN1; (-) strand; PAM type: NRG; PAM sequence: AAG
tggacatagcatataatttt

SEQ ID NO: 44534 - DNA, 20 bp, Artificial Sequence
  Description of Artificial Sequence: Synthetic oligonucleotide
  Target: ATXN1; (-) strand; PAM type: NRG; PAM sequence: TAG
gtggtgtctcattgtggaca

SEQ ID NO: 44535 - DNA, 20 bp, Artificial Sequence
  Description of Artificial Sequence: Synthetic oligonucleotide
  Target: ATXN1; (-) strand; PAM type: NRG; PAM sequence: TGG
tgtgaagtggtgtctcattg

SEQ ID NO: 44536 - DNA, 20 bp, Artificial Sequence
  Description of Artificial Sequence: Synthetic oligonucleotide
  Target: ATXN1; (-) strand; PAM type: NRG; PAM sequence: TGG
ccatcttaatgagtgtgaag

SEQ ID NO: 44537 - DNA, 20 bp, Artificial Sequence
  Description of Artificial Sequence: Synthetic oligonucleotide
  Target: ATXN1; (-) strand; PAM type: NRG; PAM sequence: AAG
tgtccatcttaatgagtgtg

SEQ ID NO: 44538 - DNA, 20 bp, Artificial Sequence
  Description of Artificial Sequence: Synthetic oligonucleotide
  Target: ATXN1; (-) strand; PAM type: NRG; PAM sequence: GAG
aatataatgtccatcttaat

SEQ ID NO: 44539 - DNA, 20 bp, Artificial Sequence
  Description of Artificial Sequence: Synthetic oligonucleotide
  Target: ATXN1; (-) strand; PAM type: NRG; PAM sequence: AAG
ttgtttttttttttaaaaaa

SEQ ID NO: 44540 - DNA, 20 bp, Artificial Sequence
  Description of Artificial Sequence: Synthetic oligonucleotide
  Target: ATXN1; (-) strand; PAM type: NRG; PAM sequence: AGG
ttcccaccaacgatgcacat

SEQ ID NO: 44541 - DNA, 20 bp, Artificial Sequence
  Description of Artificial Sequence: Synthetic oligonucleotide
  Target: ATXN1; (-) strand; PAM type: NRG; PAM sequence: TAG
gttcccaccaacgatgcaca

SEQ ID NO: 44542 - DNA, 20 bp, Artificial Sequence
  Description of Artificial Sequence: Synthetic oligonucleotide
  Target: ATXN1; (-) strand; PAM type: NRG; PAM sequence: CAG
ctgccaaaatgttttccatg

SEQ ID NO: 44543 - DNA, 20 bp, Artificial Sequence
  Description of Artificial Sequence: Synthetic oligonucleotide
  Target: ATXN1; (-) strand; PAM type: NRG; PAM sequence: AGG
attctgtatttcacattttg

SEQ ID NO: 44544 - DNA, 20 bp, Artificial Sequence
  Description of Artificial Sequence: Synthetic oligonucleotide
  Target: ATXN1; (-) strand; PAM type: NRG; PAM sequence: GAG
aattctgtatttcacatttt

SEQ ID NO: 44545 - DNA, 20 bp, Artificial Sequence
  Description of Artificial Sequence: Synthetic oligonucleotide
  Target: ATXN1; (-) strand; PAM type: NRG; PAM sequence: TGG
cgtggaattgctgagtcatg

SEQ ID NO: 44546 - DNA, 20 bp, Artificial Sequence
  Description of Artificial Sequence: Synthetic oligonucleotide
  Target: ATXN1; (-) strand; PAM type: NRG; PAM sequence: GAG
tatccagacgtggaattgct

SEQ ID NO: 44547 - DNA, 20 bp, Artificial Sequence
  Description of Artificial Sequence: Synthetic oligonucleotide
  Target: ATXN1; (-) strand; PAM type: NRG; PAM sequence: TGG
ttgtggtagatatccagacg

SEQ ID NO: 44548 - DNA, 20 bp, Artificial Sequence
  Description of Artificial Sequence: Synthetic oligonucleotide
  Target: ATXN1; (-) strand; PAM type: NRG; PAM sequence: CAG
agtgctttgtggtagatatc

SEQ ID NO: 44549 - DNA, 20 bp, Artificial Sequence
  Description of Artificial Sequence: Synthetic oligonucleotide
  Target: ATXN1; (-) strand; PAM type: NRG; PAM sequence: TAG
ctgctttcagtgctttgtgg

SEQ ID NO: 44550 - DNA, 20 bp, Artificial Sequence
  Description of Artificial Sequence: Synthetic oligonucleotide
  Target: ATXN1; (-) strand; PAM type: NRG; PAM sequence: TGG
tccctgctttcagtgctttg

SEQ ID NO: 44551 - DNA, 20 bp, Artificial Sequence
  Description of Artificial Sequence: Synthetic oligonucleotide
  Target: ATXN1; (-) strand; PAM type: NRG; PAM sequence: CAG
aatatctgagtccctgcttt

SEQ ID NO: 44552 - DNA, 20 bp, Artificial Sequence
  Description of Artificial Sequence: Synthetic oligonucleotide
  Target: ATXN1; (-) strand; PAM type: NRG; PAM sequence: GAG
aacacgggtgtggaatatct

SEQ ID NO: 44553 - DNA, 20 bp, Artificial Sequence
  Description of Artificial Sequence: Synthetic oligonucleotide
  Target: ATXN1; (-) strand; PAM type: NRG; PAM sequence: TGG
tgctgctatgaacacgggtg

SEQ ID NO: 44554 - DNA, 20 bp, Artificial Sequence
  Description of Artificial Sequence: Synthetic oligonucleotide
  Target: ATXN1; (-) strand; PAM type: NRG; PAM sequence: GGG
cacaatgctgctatgaacac

SEQ ID NO: 44555 - DNA, 20 bp, Artificial Sequence
  Description of Artificial Sequence: Synthetic oligonucleotide
  Target: ATXN1; (-) strand; PAM type: NRG; PAM sequence: CGG
gcacaatgctgctatgaaca

SEQ ID NO: 44556 - DNA, 20 bp, Artificial Sequence
  Description of Artificial Sequence: Synthetic oligonucleotide
  Target: ATXN1; (-) strand; PAM type: NRG; PAM sequence: TGG
attgggttgttgacaccttt

SEQ ID NO: 44557 - DNA, 20 bp, Artificial Sequence
  Description of Artificial Sequence: Synthetic oligonucleotide
  Target: ATXN1; (-) strand; PAM type: NRG; PAM sequence: GGG
ttcatctgttgatgatcatt

SEQ ID NO: 44558 - DNA, 20 bp, Artificial Sequence
  Description of Artificial Sequence: Synthetic oligonucleotide
  Target: ATXN1; (-) strand; PAM type: NRG; PAM sequence: TGG
attcatctgttgatgatcat

SEQ ID NO: 44559 - DNA, 20 bp, Artificial Sequence
  Description of Artificial Sequence: Synthetic oligonucleotide
  Target: ATXN1; (-) strand; PAM type: NRG; PAM sequence: AAG
aaggatataccacattttta

SEQ ID NO: 44560 - DNA, 20 bp, Artificial Sequence
  Description of Artificial Sequence: Synthetic oligonucleotide
  Target: ATXN1; (-) strand; PAM type: NRG; PAM sequence: AGG
atgaataatagctcgtcata

SEQ ID NO: 44561 - DNA, 20 bp, Artificial Sequence
  Description of Artificial Sequence: Synthetic oligonucleotide
  Target: ATXN1; (-) strand; PAM type: NRG; PAM sequence: AAG
gatgaataatagctcgtcat

SEQ ID NO: 44562 - DNA, 20 bp, Artificial Sequence
  Description of Artificial Sequence: Synthetic oligonucleotide
  Target: ATXN1; (-) strand; PAM type: NRG; PAM sequence: TAG
aaggagagggggatgaataa

SEQ ID NO: 44563 - DNA, 20 bp, Artificial Sequence
  Description of Artificial Sequence: Synthetic oligonucleotide
  Target: ATXN1; (-) strand; PAM type: NRG; PAM sequence: GGG
cattcctttgtaaggagagg

SEQ ID NO: 44564 - DNA, 20 bp, Artificial Sequence
  Description of Artificial Sequence: Synthetic oligonucleotide
  Target: ATXN1; (-) strand; PAM type: NRG; PAM sequence: GGG
tcattcctttgtaaggagag

SEQ ID NO: 44565 - DNA, 20 bp, Artificial Sequence
  Description of Artificial Sequence: Synthetic oligonucleotide
  Target: ATXN1; (-) strand; PAM type: NRG; PAM sequence: GGG
gtcattcctttgtaaggaga

SEQ ID NO: 44566 - DNA, 20 bp, Artificial Sequence
  Description of Artificial Sequence: Synthetic oligonucleotide
  Target: ATXN1; (-) strand; PAM type: NRG; PAM sequence: AGG
tgtcattcctttgtaaggag

SEQ ID NO: 44567 - DNA, 20 bp, Artificial Sequence
  Description of Artificial Sequence: Synthetic oligonucleotide
  Target: ATXN1; (-) strand; PAM type: NRG; PAM sequence: GAG
atgtcattcctttgtaagga

SEQ ID NO: 44568 - DNA, 20 bp, Artificial Sequence
  Description of Artificial Sequence: Synthetic oligonucleotide
  Target: ATXN1; (-) strand; PAM type: NRG; PAM sequence: GAG
gaatgtcattcctttgtaag

SEQ ID NO: 44569 - DNA, 20 bp, Artificial Sequence
  Description of Artificial Sequence: Synthetic oligonucleotide
  Target: ATXN1; (-) strand; PAM type: NRG; PAM sequence: AGG
cagaatgtcattcctttgta

SEQ ID NO: 44570 - DNA, 20 bp, Artificial Sequence
  Description of Artificial Sequence: Synthetic oligonucleotide
  Target: ATXN1; (-) strand; PAM type: NRG; PAM sequence: AAG
acagaatgtcattcctttgt

SEQ ID NO: 44571 - DNA, 20 bp, Artificial Sequence
  Description of Artificial Sequence: Synthetic oligonucleotide
  Target: ATXN1; (-) strand; PAM type: NRG; PAM sequence: CAG
atcaatgtcatagcatgtaa

SEQ ID NO: 44572 - DNA, 20 bp, Artificial Sequence
  Description of Artificial Sequence: Synthetic oligonucleotide
  Target: ATXN1; (-) strand; PAM type: NRG; PAM sequence: TAG
ttgaagatttatcaatgtca

SEQ ID NO: 44573 - DNA, 20 bp, Artificial Sequence
  Description of Artificial Sequence: Synthetic oligonucleotide
  Target: ATXN1; (-) strand; PAM type: NRG; PAM sequence: AAG
ttcacttagcataatgtttg

SEQ ID NO: 44574 - DNA, 20 bp, Artificial Sequence
  Description of Artificial Sequence: Synthetic oligonucleotide
  Target: ATXN1; (-) strand; PAM type: NRG; PAM sequence: TAG
tgtgtctggcttctttcact

SEQ ID NO: 44575 - DNA, 20 bp, Artificial Sequence
  Description of Artificial Sequence: Synthetic oligonucleotide
  Target: ATXN1; (-) strand; PAM type: NRG; PAM sequence: TGG
tgatattgttcttttgtgtc

SEQ ID NO: 44576 - DNA, 20 bp, Artificial Sequence
  Description of Artificial Sequence: Synthetic oligonucleotide
  Target: ATXN1; (-) strand; PAM type: NRG; PAM sequence: GGG
ttctagattcctcatagaag

SEQ ID NO: 44577 - DNA, 20 bp, Artificial Sequence
  Description of Artificial Sequence: Synthetic oligonucleotide
  Target: ATXN1; (-) strand; PAM type: NRG; PAM sequence: GGG
attctagattcctcatagaa

SEQ ID NO: 44578 - DNA, 20 bp, Artificial Sequence
  Description of Artificial Sequence: Synthetic oligonucleotide
  Target: ATXN1; (-) strand; PAM type: NRG; PAM sequence: AGG
tattctagattcctcataga

SEQ ID NO: 44579 - DNA, 20 bp, Artificial Sequence
  Description of Artificial Sequence: Synthetic oligonucleotide
  Target: ATXN1; (-) strand; PAM type: NRG; PAM sequence: AAG
ctattctagattcctcatag

SEQ ID NO: 44580 - DNA, 20 bp, Artificial Sequence
  Description of Artificial Sequence: Synthetic oligonucleotide
  Target: ATXN1; (-) strand; PAM type: NRG; PAM sequence: TAG
tgactattctagattcctca

SEQ ID NO: 44581 - DNA, 20 bp, Artificial Sequence
  Description of Artificial Sequence: Synthetic oligonucleotide
  Target: ATXN1; (-) strand; PAM type: NRG; PAM sequence: TAG
ctctccaaatttgactattc

SEQ ID NO: 44582 - DNA, 20 bp, Artificial Sequence
  Description of Artificial Sequence: Synthetic oligonucleotide
  Target: ATXN1; (-) strand; PAM type: NRG; PAM sequence: CAG
ctcccattgccccgtcctcc

SEQ ID NO: 44583 - DNA, 20 bp, Artificial Sequence
  Description of Artificial Sequence: Synthetic oligonucleotide
  Target: ATXN1; (-) strand; PAM type: NRG; PAM sequence: TGG
atcataccaaactgaaattc

SEQ ID NO: 44584 - DNA, 20 bp, Artificial Sequence
  Description of Artificial Sequence: Synthetic oligonucleotide
  Target: ATXN1; (-) strand; PAM type: NRG; PAM sequence: CAG
ccatcaccaccatctgtctc

SEQ ID NO: 44585 - DNA, 20 bp, Artificial Sequence
  Description of Artificial Sequence: Synthetic oligonucleotide
  Target: ATXN1; (-) strand; PAM type: NRG; PAM sequence: TGG
tttttacgtgcacggttaag

SEQ ID NO: 44586 - DNA, 20 bp, Artificial Sequence
  Description of Artificial Sequence: Synthetic oligonucleotide
  Target: ATXN1; (-) strand; PAM type: NRG; PAM sequence: AAG
tcatttttacgtgcacggtt

SEQ ID NO: 44587 - DNA, 20 bp, Artificial Sequence
  Description of Artificial Sequence: Synthetic oligonucleotide
  Target: ATXN1; (-) strand; PAM type: NRG; PAM sequence: CGG
cttaatcatttttacgtgca

SEQ ID NO: 44588 - DNA, 20 bp, Artificial Sequence
  Description of Artificial Sequence: Synthetic oligonucleotide
  Target: ATXN1; (-) strand; PAM type: NRG; PAM sequence: TGG
tatttttaaaaatttttgac

SEQ ID NO: 44589 - DNA, 20 bp, Artificial Sequence
  Description of Artificial Sequence: Synthetic oligonucleotide
  Target: ATXN1; (-) strand; PAM type: NRG; PAM sequence: CAG
caggcgtgagccaacgcgcc

SEQ ID NO: 44590 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 44591 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 44592 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 44593 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 44594 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaagtgc

SEQ ID NO: 44595 - DNA, 20 bp, Artificial Sequence
  Description of Artificial Sequence: Synthetic oligonucleotide
  Target: ATXN1; (-) strand; PAM type: NRG; PAM sequence: AAG
ctgcgcgcctcagcctccca

SEQ ID NO: 44596 - DNA, 20 bp, Artificial Sequence
  Description of Artificial Sequence: Synthetic oligonucleotide
  Target: ATXN1; (-) strand; PAM type: NRG; PAM sequence: CAG
accttgtgatctgcgcgcct

SEQ ID NO: 44597 - DNA, 20 bp, Artificial Sequence
  Description of Artificial Sequence: Synthetic oligonucleotide
  Target: ATXN1; (-) strand; PAM type: NRG; PAM sequence: TGG
tttcaccgtgttagccagga

SEQ ID NO: 44598 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccgtgttagcc

SEQ ID NO: 44599 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccgtgttagc

SEQ ID NO: 44600 - DNA, 20 bp, Artificial Sequence
  Description of Artificial Sequence: Synthetic oligonucleotide
  Target: ATXN1; (-) strand; PAM type: NRG; PAM sequence: TAG
gagacagggtttcaccgtgt

SEQ ID NO: 44601 - DNA, 20 bp, Artificial Sequence
  Description of Artificial Sequence: Synthetic oligonucleotide
  Target: ATXN1; (-) strand; PAM type: NRG; PAM sequence: GGG
tctattttttagtagagaca

SEQ ID NO: 44602 - DNA, 20 bp, Artificial Sequence
  Description of Artificial Sequence: Synthetic oligonucleotide
  Target: ATXN1; (-) strand; PAM type: NRG; PAM sequence: AGG
ttctattttttagtagagac

SEQ ID NO: 44603 - DNA, 20 bp, Artificial Sequence
  Description of Artificial Sequence: Synthetic oligonucleotide
  Target: ATXN1; (-) strand; PAM type: NRG; PAM sequence: CAG
tttctattttttagtagaga

SEQ ID NO: 44604 - DNA, 20 bp, Artificial Sequence
  Description of Artificial Sequence: Synthetic oligonucleotide
  Target: ATXN1; (-) strand; PAM type: NRG; PAM sequence: GAG
attttttctattttttagta

SEQ ID NO: 44605 - DNA, 20 bp, Artificial Sequence
  Description of Artificial Sequence: Synthetic oligonucleotide
  Target: ATXN1; (-) strand; PAM type: NRG; PAM sequence: TAG
taattttttctattttttag

SEQ ID NO: 44606 - DNA, 20 bp, Artificial Sequence
  Description of Artificial Sequence: Synthetic oligonucleotide
  Target: ATXN1; (-) strand; PAM type: NRG; PAM sequence: TAG
ggctaattttttctattttt

SEQ ID NO: 44607 - DNA, 20 bp, Artificial Sequence
  Description of Artificial Sequence: Synthetic oligonucleotide
  Target: ATXN1; (-) strand; PAM type: NRG; PAM sequence: CGG
cacgtgcccaccaccacgcc

SEQ ID NO: 44608 - DNA, 20 bp, Artificial Sequence
  Description of Artificial Sequence: Synthetic oligonucleotide
  Target: ATXN1; (-) strand; PAM type: NRG; PAM sequence: GGG
tctcagcctctcgagtagct

SEQ ID NO: 44609 - DNA, 20 bp, Artificial Sequence
  Description of Artificial Sequence: Synthetic oligonucleotide
  Target: ATXN1; (-) strand; PAM type: NRG; PAM sequence: TGG
gtctcagcctctcgagtagc

SEQ ID NO: 44610 - DNA, 20 bp, Artificial Sequence
  Description of Artificial Sequence: Synthetic oligonucleotide
  Target: ATXN1; (-) strand; PAM type: NRG; PAM sequence: TAG
tcctgtctcagcctctcgag

SEQ ID NO: 44611 - DNA, 20 bp, Artificial Sequence
  Description of Artificial Sequence: Synthetic oligonucleotide
  Target: ATXN1; (-) strand; PAM type: NRG; PAM sequence: GAG
ttctcctgtctcagcctctc

SEQ ID NO: 44612 - DNA, 20 bp, Artificial Sequence
  Description of Artificial Sequence: Synthetic oligonucleotide
  Target: ATXN1; (-) strand; PAM type: NRG; PAM sequence: CAG
ttcacgccattctcctgtct

SEQ ID NO: 44613 - DNA, 20 bp, Artificial Sequence
  Description of Artificial Sequence: Synthetic oligonucleotide
  Target: ATXN1; (-) strand; PAM type: NRG; PAM sequence: AGG
tcactgcaagcctgcctccc

SEQ ID NO: 44614 - DNA, 20 bp, Artificial Sequence
  Description of Artificial Sequence: Synthetic oligonucleotide
  Target: ATXN1; (-) strand; PAM type: NRG; PAM sequence: CAG
ctcactgcaagcctgcctcc

SEQ ID NO: 44615 - DNA, 20 bp, Artificial Sequence
  Description of Artificial Sequence: Synthetic oligonucleotide
  Target: ATXN1; (-) strand; PAM type: NRG; PAM sequence: AAG
gtgcgatctcagctcactgc

SEQ ID NO: 44616 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggtgcgatct

SEQ ID NO: 44617 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 44618 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggagtg

SEQ ID NO: 44619 - DNA, 20 bp, Artificial Sequence
  Description of Artificial Sequence: Synthetic oligonucleotide
  Target: ATXN1; (-) strand; PAM type: NRG; PAM sequence: GAG
tcgctctgtcacccaggctg

SEQ ID NO: 44620 - DNA, 20 bp, Artificial Sequence
  Description of Artificial Sequence: Synthetic oligonucleotide
  Target: ATXN1; (-) strand; PAM type: NRG; PAM sequence: TGG
tctcgctctgtcacccaggc

SEQ ID NO: 44621 - DNA, 20 bp, Artificial Sequence
  Description of Artificial Sequence: Synthetic oligonucleotide
  Target: ATXN1; (-) strand; PAM type: NRG; PAM sequence: AGG
agagtctcgctctgtcaccc

SEQ ID NO: 44622 - DNA, 20 bp, Artificial Sequence
  Description of Artificial Sequence: Synthetic oligonucleotide
  Target: ATXN1; (-) strand; PAM type: NRG; PAM sequence: CAG
cagagtctcgctctgtcacc

SEQ ID NO: 44623 - DNA, 20 bp, Artificial Sequence
  Description of Artificial Sequence: Synthetic oligonucleotide
  Target: ATXN1; (-) strand; PAM type: NRG; PAM sequence: GAG
ttatttatttatttgagaca

SEQ ID NO: 44624 - DNA, 20 bp, Artificial Sequence
  Description of Artificial Sequence: Synthetic oligonucleotide
  Target: ATXN1; (-) strand; PAM type: NRG; PAM sequence: CAG
atttatttatttatttgaga

SEQ ID NO: 44625 - DNA, 20 bp, Artificial Sequence
  Description of Artificial Sequence: Synthetic oligonucleotide
  Target: ATXN1; (-) strand; PAM type: NRG; PAM sequence: GAG
atttatttatttatttattt

SEQ ID NO: 44626 - DNA, 20 bp, Artificial Sequence
  Description of Artificial Sequence: Synthetic oligonucleotide
  Target: ATXN1; (-) strand; PAM type: NRG; PAM sequence: AAG
cagtttgttcacaaactttt

SEQ ID NO: 44627 - DNA, 20 bp, Artificial Sequence
  Description of Artificial Sequence: Synthetic oligonucleotide
  Target: ATXN1; (-) strand; PAM type: NRG; PAM sequence: CAG
gtggtttcaaaacagaaatg

SEQ ID NO: 44628 - DNA, 20 bp, Artificial Sequence
  Description of Artificial Sequence: Synthetic oligonucleotide
  Target: ATXN1; (-) strand; PAM type: NRG; PAM sequence: CAG
ggcgctgtgtggtttcaaaa

SEQ ID NO: 44629 - DNA, 20 bp, Artificial Sequence
  Description of Artificial Sequence: Synthetic oligonucleotide
  Target: ATXN1; (-) strand; PAM type: NRG; PAM sequence: TGG
tgagggagcggggcgctgtg

SEQ ID NO: 44630 - DNA, 20 bp, Artificial Sequence
  Description of Artificial Sequence: Synthetic oligonucleotide
  Target: ATXN1; (-) strand; PAM type: NRG; PAM sequence: GGG
tccaagcagatgagggagcg

SEQ ID NO: 44631 - DNA, 20 bp, Artificial Sequence
  Description of Artificial Sequence: Synthetic oligonucleotide
  Target: ATXN1; (-) strand; PAM type: NRG; PAM sequence: GGG
ctccaagcagatgagggagc

SEQ ID NO: 44632 - DNA, 20 bp, Artificial Sequence
  Description of Artificial Sequence: Synthetic oligonucleotide
  Target: ATXN1; (-) strand; PAM type: NRG; PAM sequence: CGG
gctccaagcagatgagggag

SEQ ID NO: 44633 - DNA, 20 bp, Artificial Sequence
  Description of Artificial Sequence: Synthetic oligonucleotide
  Target: ATXN1; (-) strand; PAM type: NRG; PAM sequence: GAG
gtagctccaagcagatgagg

SEQ ID NO: 44634 - DNA, 20 bp, Artificial Sequence
  Description of Artificial Sequence: Synthetic oligonucleotide
  Target: ATXN1; (-) strand; PAM type: NRG; PAM sequence: GGG
ttgtagctccaagcagatga

SEQ ID NO: 44635 - DNA, 20 bp, Artificial Sequence
  Description of Artificial Sequence: Synthetic oligonucleotide
  Target: ATXN1; (-) strand; PAM type: NRG; PAM sequence: AGG
cttgtagctccaagcagatg

SEQ ID NO: 44636 - DNA, 20 bp, Artificial Sequence
  Description of Artificial Sequence: Synthetic oligonucleotide
  Target: ATXN1; (-) strand; PAM type: NRG; PAM sequence: GAG
ccttgtagctccaagcagat

SEQ ID NO: 44637 - DNA, 20 bp, Artificial Sequence
  Description of Artificial Sequence: Synthetic oligonucleotide
  Target: ATXN1; (-) strand; PAM type: NRG; PAM sequence: CAG
gagatccttgtagctccaag

SEQ ID NO: 44638 - DNA, 20 bp, Artificial Sequence
  Description of Artificial Sequence: Synthetic oligonucleotide
  Target: ATXN1; (-) strand; PAM type: NRG; PAM sequence: AAG
tcagagatccttgtagctcc

SEQ ID NO: 44639 - DNA, 20 bp, Artificial Sequence
  Description of Artificial Sequence: Synthetic oligonucleotide
  Target: ATXN1; (-) strand; PAM type: NRG; PAM sequence: TAG
aggtatctcagagatccttg

SEQ ID NO: 44640 - DNA, 20 bp, Artificial Sequence
  Description of Artificial Sequence: Synthetic oligonucleotide
  Target: ATXN1; (-) strand; PAM type: NRG; PAM sequence: GAG
taatgccagcaggtatctca

SEQ ID NO: 44641 - DNA, 20 bp, Artificial Sequence
  Description of Artificial Sequence: Synthetic oligonucleotide
  Target: ATXN1; (-) strand; PAM type: NRG; PAM sequence: CAG
gctaatgccagcaggtatct

SEQ ID NO: 44642 - DNA, 20 bp, Artificial Sequence
  Description of Artificial Sequence: Synthetic oligonucleotide
  Target: ATXN1; (-) strand; PAM type: NRG; PAM sequence: AGG
gaatacaggctaatgccagc

SEQ ID NO: 44643 - DNA, 20 bp, Artificial Sequence
  Description of Artificial Sequence: Synthetic oligonucleotide
  Target: ATXN1; (-) strand; PAM type: NRG; PAM sequence: CAG
ggaatacaggctaatgccag

SEQ ID NO: 44644 - DNA, 20 bp, Artificial Sequence
  Description of Artificial Sequence: Synthetic oligonucleotide
  Target: ATXN1; (-) strand; PAM type: NRG; PAM sequence: CAG
cctggaatacaggctaatgc

SEQ ID NO: 44645 - DNA, 20 bp, Artificial Sequence
  Description of Artificial Sequence: Synthetic oligonucleotide
  Target: ATXN1; (-) strand; PAM type: NRG; PAM sequence: AGG
gacgtccagtcctggaatac

SEQ ID NO: 44646 - DNA, 20 bp, Artificial Sequence
  Description of Artificial Sequence: Synthetic oligonucleotide
  Target: ATXN1; (-) strand; PAM type: NRG; PAM sequence: CAG
tgacgtccagtcctggaata

SEQ ID NO: 44647 - DNA, 20 bp, Artificial Sequence
  Description of Artificial Sequence: Synthetic oligonucleotide
  Target: ATXN1; (-) strand; PAM type: NRG; PAM sequence: TGG
gatgccctgacgtccagtcc

SEQ ID NO: 44648 - DNA, 20 bp, Artificial Sequence
  Description of Artificial Sequence: Synthetic oligonucleotide
  Target: ATXN1; (-) strand; PAM type: NRG; PAM sequence: CAG
ttaaaggatgccctgacgtc

SEQ ID NO: 44649 - DNA, 20 bp, Artificial Sequence
  Description of Artificial Sequence: Synthetic oligonucleotide
  Target: ATXN1; (-) strand; PAM type: NRG; PAM sequence: AGG
atacagctttaagggcttaa

SEQ ID NO: 44650 - DNA, 20 bp, Artificial Sequence
  Description of Artificial Sequence: Synthetic oligonucleotide
  Target: ATXN1; (-) strand; PAM type: NRG; PAM sequence: AAG
catacagctttaagggctta

SEQ ID NO: 44651 - DNA, 20 bp, Artificial Sequence
  Description of Artificial Sequence: Synthetic oligonucleotide
  Target: ATXN1; (-) strand; PAM type: NRG; PAM sequence: GGG
gaaagggcatacagctttaa

SEQ ID NO: 44652 - DNA, 20 bp, Artificial Sequence
  Description of Artificial Sequence: Synthetic oligonucleotide
  Target: ATXN1; (-) strand; PAM type: NRG; PAM sequence: AGG
agaaagggcatacagcttta

SEQ ID NO: 44653 - DNA, 20 bp, Artificial Sequence
  Description of Artificial Sequence: Synthetic oligonucleotide
  Target: ATXN1; (-) strand; PAM type: NRG; PAM sequence: AAG
gagaaagggcatacagcttt

SEQ ID NO: 44654 - DNA, 20 bp, Artificial Sequence
  Description of Artificial Sequence: Synthetic oligonucleotide
  Target: ATXN1; (-) strand; PAM type: NRG; PAM sequence: CAG
cggatgtgagaaagggcata

SEQ ID NO: 44655 - DNA, 20 bp, Artificial Sequence
  Description of Artificial Sequence: Synthetic oligonucleotide
  Target: ATXN1; (-) strand; PAM type: NRG; PAM sequence: GGG
ccctttgcggatgtgagaaa

SEQ ID NO: 44656 - DNA, 20 bp, Artificial Sequence
  Description of Artificial Sequence: Synthetic oligonucleotide
  Target: ATXN1; (-) strand; PAM type: NRG; PAM sequence: AGG
cccctttgcggatgtgagaa

SEQ ID NO: 44657 - DNA, 20 bp, Artificial Sequence
  Description of Artificial Sequence: Synthetic oligonucleotide
  Target: ATXN1; (-) strand; PAM type: NRG; PAM sequence: AAG
tcccctttgcggatgtgaga

SEQ ID NO: 44658 - DNA, 20 bp, Artificial Sequence
  Description of Artificial Sequence: Synthetic oligonucleotide
  Target: ATXN1; (-) strand; PAM type: NRG; PAM sequence: GAG
acagtcccctttgcggatgt

SEQ ID NO: 44659 - DNA, 20 bp, Artificial Sequence
  Description of Artificial Sequence: Synthetic oligonucleotide
  Target: ATXN1; (-) strand; PAM type: NRG; PAM sequence: CGG
acagctcacagtcccctttg

SEQ ID NO: 44660 - DNA, 20 bp, Artificial Sequence
  Description of Artificial Sequence: Synthetic oligonucleotide
  Target: ATXN1; (-) strand; PAM type: NRG; PAM sequence: CAG
gcctcactttttacagctca

SEQ ID NO: 44661 - DNA, 20 bp, Artificial Sequence
  Description of Artificial Sequence: Synthetic oligonucleotide
  Target: ATXN1; (-) strand; PAM type: NRG; PAM sequence: CAG
tactgctgcctcacttttta

SEQ ID NO: 44662 - DNA, 20 bp, Artificial Sequence
  Description of Artificial Sequence: Synthetic oligonucleotide
  Target: ATXN1; (-) strand; PAM type: NRG; PAM sequence: AAG
catgatagagcagtgacact

SEQ ID NO: 44663 - DNA, 20 bp, Artificial Sequence
  Description of Artificial Sequence: Synthetic oligonucleotide
  Target: ATXN1; (-) strand; PAM type: NRG; PAM sequence: CAG
tgagcaatgacatgatagag

SEQ ID NO: 44664 - DNA, 20 bp, Artificial Sequence
  Description of Artificial Sequence: Synthetic oligonucleotide
  Target: ATXN1; (-) strand; PAM type: NRG; PAM sequence: GAG
cagtgagcaatgacatgata

SEQ ID NO: 44665 - DNA, 20 bp, Artificial Sequence
  Description of Artificial Sequence: Synthetic oligonucleotide
  Target: ATXN1; (-) strand; PAM type: NRG; PAM sequence: TAG
ttcagtgagcaatgacatga

SEQ ID NO: 44666 - DNA, 20 bp, Artificial Sequence
  Description of Artificial Sequence: Synthetic oligonucleotide
  Target: ATXN1; (-) strand; PAM type: NRG; PAM sequence: GAG
gccagctttcagtcttcagt

SEQ ID NO: 44667 - DNA, 20 bp, Artificial Sequence
  Description of Artificial Sequence: Synthetic oligonucleotide
  Target: ATXN1; (-) strand; PAM type: NRG; PAM sequence: CAG
atcggccagctttcagtctt

SEQ ID NO: 44668 - DNA, 20 bp, Artificial Sequence
  Description of Artificial Sequence: Synthetic oligonucleotide
  Target: ATXN1; (-) strand; PAM type: NRG; PAM sequence: CAG
cagggatatcggccagcttt

SEQ ID NO: 44669 - DNA, 20 bp, Artificial Sequence
  Description of Artificial Sequence: Synthetic oligonucleotide
  Target: ATXN1; (-) strand; PAM type: NRG; PAM sequence: CAG
aggcatacagggatatcggc

SEQ ID NO: 44670 - DNA, 20 bp, Artificial Sequence
  Description of Artificial Sequence: Synthetic oligonucleotide
  Target: ATXN1; (-) strand; PAM type: NRG; PAM sequence: CGG
gaagaggcatacagggatat

SEQ ID NO: 44671 - DNA, 20 bp, Artificial Sequence
  Description of Artificial Sequence: Synthetic oligonucleotide
  Target: ATXN1; (-) strand; PAM type: NRG; PAM sequence: GGG
caggggagaagaggcataca

SEQ ID NO: 44672 - DNA, 20 bp, Artificial Sequence
  Description of Artificial Sequence: Synthetic oligonucleotide
  Target: ATXN1; (-) strand; PAM type: NRG; PAM sequence: AGG
tcaggggagaagaggcatac

SEQ ID NO: 44673 - DNA, 20 bp, Artificial Sequence
  Description of Artificial Sequence: Synthetic oligonucleotide
  Target: ATXN1; (-) strand; PAM type: NRG; PAM sequence: CAG
atcaggggagaagaggcata

SEQ ID NO: 44674 - DNA, 20 bp, Artificial Sequence
  Description of Artificial Sequence: Synthetic oligonucleotide
  Target: ATXN1; (-) strand; PAM type: NRG; PAM sequence: AGG
tgacagaatcaggggagaag

SEQ ID NO: 44675 - DNA, 20 bp, Artificial Sequence
  Description of Artificial Sequence: Synthetic oligonucleotide
  Target: ATXN1; (-) strand; PAM type: NRG; PAM sequence: GAG
atgacagaatcaggggagaa

SEQ ID NO: 44676 - DNA, 20 bp, Artificial Sequence
  Description of Artificial Sequence: Synthetic oligonucleotide
  Target: ATXN1; (-) strand; PAM type: NRG; PAM sequence: AAG
tgatgacagaatcaggggag

SEQ ID NO: 44677 - DNA, 20 bp, Artificial Sequence
  Description of Artificial Sequence: Synthetic oligonucleotide
  Target: ATXN1; (-) strand; PAM type: NRG; PAM sequence: GAG
acctgatgacagaatcaggg

SEQ ID NO: 44678 - DNA, 20 bp, Artificial Sequence
  Description of Artificial Sequence: Synthetic oligonucleotide
  Target: ATXN1; (-) strand; PAM type: NRG; PAM sequence: GGG
taacctgatgacagaatcag

SEQ ID NO: 44679 - DNA, 20 bp, Artificial Sequence
  Description of Artificial Sequence: Synthetic oligonucleotide
  Target: ATXN1; (-) strand; PAM type: NRG; PAM sequence: GGG
ataacctgatgacagaatca

SEQ ID NO: 44680 - DNA, 20 bp, Artificial Sequence
  Description of Artificial Sequence: Synthetic oligonucleotide
  Target: ATXN1; (-) strand; PAM type: NRG; PAM sequence: AGG
cataacctgatgacagaatc

SEQ ID NO: 44681 - DNA, 20 bp, Artificial Sequence
  Description of Artificial Sequence: Synthetic oligonucleotide
  Target: ATXN1; (-) strand; PAM type: NRG; PAM sequence: CAG
acataacctgatgacagaat

SEQ ID NO: 44682 - DNA, 20 bp, Artificial Sequence
  Description of Artificial Sequence: Synthetic oligonucleotide
  Target: ATXN1; (-) strand; PAM type: NRG; PAM sequence: CAG
gaactgacataacctgatga

SEQ ID NO: 44683 - DNA, 20 bp, Artificial Sequence
  Description of Artificial Sequence: Synthetic oligonucleotide
  Target: ATXN1; (-) strand; PAM type: NRG; PAM sequence: TGG
ccagtccctgattcagaggg

SEQ ID NO: 44684 - DNA, 20 bp, Artificial Sequence
  Description of Artificial Sequence: Synthetic oligonucleotide
  Target: ATXN1; (-) strand; PAM type: NRG; PAM sequence: GGG
tttccagtccctgattcaga

SEQ ID NO: 44685 - DNA, 20 bp, Artificial Sequence
  Description of Artificial Sequence: Synthetic oligonucleotide
  Target: ATXN1; (-) strand; PAM type: NRG; PAM sequence: AGG
ttttccagtccctgattcag

SEQ ID NO: 44686 - DNA, 20 bp, Artificial Sequence
  Description of Artificial Sequence: Synthetic oligonucleotide
  Target: ATXN1; (-) strand; PAM type: NRG; PAM sequence: GAG
gttttccagtccctgattca

SEQ ID NO: 44687 - DNA, 20 bp, Artificial Sequence
  Description of Artificial Sequence: Synthetic oligonucleotide
  Target: ATXN1; (-) strand; PAM type: NRG; PAM sequence: CAG
aggttttccagtccctgatt

SEQ ID NO: 44688 - DNA, 20 bp, Artificial Sequence
  Description of Artificial Sequence: Synthetic oligonucleotide
  Target: ATXN1; (-) strand; PAM type: NRG; PAM sequence: CAG
cgcgcatcgtcaaggttttc

SEQ ID NO: 44689 - DNA, 20 bp, Artificial Sequence
  Description of Artificial Sequence: Synthetic oligonucleotide
  Target: ATXN1; (-) strand; PAM type: NRG; PAM sequence: AGG
taggtggccgcgcatcgtca

SEQ ID NO: 44690 - DNA, 20 bp, Artificial Sequence
  Description of Artificial Sequence: Synthetic oligonucleotide
  Target: ATXN1; (-) strand; PAM type: NRG; PAM sequence: AAG
ctaggtggccgcgcatcgtc

SEQ ID NO: 44691 - DNA, 20 bp, Artificial Sequence
  Description of Artificial Sequence: Synthetic oligonucleotide
  Target: ATXN1; (-) strand; PAM type: NRG; PAM sequence: TGG
aagccacacgatttactagg

SEQ ID NO: 44692 - DNA, 20 bp, Artificial Sequence
  Description of Artificial Sequence: Synthetic oligonucleotide
  Target: ATXN1; (-) strand; PAM type: NRG; PAM sequence: AGG
gcaaagccacacgatttact

SEQ ID NO: 44693 - DNA, 20 bp, Artificial Sequence
  Description of Artificial Sequence: Synthetic oligonucleotide
  Target: ATXN1; (-) strand; PAM type: NRG; PAM sequence: TAG
cgcaaagccacacgatttac

SEQ ID NO: 44694 - DNA, 20 bp, Artificial Sequence
  Description of Artificial Sequence: Synthetic oligonucleotide
  Target: ATXN1; (-) strand; PAM type: NRG; PAM sequence: AAG
acagaggtgtatggcccgca

SEQ ID NO: 44695 - DNA, 20 bp, Artificial Sequence
  Description of Artificial Sequence: Synthetic oligonucleotide
  Target: ATXN1; (-) strand; PAM type: NRG; PAM sequence: TGG
gtaatggccacagaggtgta

SEQ ID NO: 44696 - DNA, 20 bp, Artificial Sequence
  Description of Artificial Sequence: Synthetic oligonucleotide
  Target: ATXN1; (-) strand; PAM type: NRG; PAM sequence: AGG
gagctgagtaatggccacag

SEQ ID NO: 44697 - DNA, 20 bp, Artificial Sequence
  Description of Artificial Sequence: Synthetic oligonucleotide
  Target: ATXN1; (-) strand; PAM type: NRG; PAM sequence: GAG
agagctgagtaatggccaca

SEQ ID NO: 44698 - DNA, 20 bp, Artificial Sequence
  Description of Artificial Sequence: Synthetic oligonucleotide
  Target: ATXN1; (-) strand; PAM type: NRG; PAM sequence: CAG
gtagagctgagtaatggcca

SEQ ID NO: 44699 - DNA, 20 bp, Artificial Sequence
  Description of Artificial Sequence: Synthetic oligonucleotide
  Target: ATXN1; (-) strand; PAM type: NRG; PAM sequence: TGG
gcagaggtagagctgagtaa

SEQ ID NO: 44700 - DNA, 20 bp, Artificial Sequence
  Description of Artificial Sequence: Synthetic oligonucleotide
  Target: ATXN1; (-) strand; PAM type: NRG; PAM sequence: GAG
cagcctgcagaggtagagct

SEQ ID NO: 44701 - DNA, 20 bp, Artificial Sequence
  Description of Artificial Sequence: Synthetic oligonucleotide
  Target: ATXN1; (-) strand; PAM type: NRG; PAM sequence: GAG
gctttcagcctgcagaggta

SEQ ID NO: 44702 - DNA, 20 bp, Artificial Sequence
  Description of Artificial Sequence: Synthetic oligonucleotide
  Target: ATXN1; (-) strand; PAM type: NRG; PAM sequence: TAG
ttgctttcagcctgcagagg

SEQ ID NO: 44703 - DNA, 20 bp, Artificial Sequence
  Description of Artificial Sequence: Synthetic oligonucleotide
  Target: ATXN1; (-) strand; PAM type: NRG; PAM sequence: AGG
tggttgctttcagcctgcag

SEQ ID NO: 44704 - DNA, 20 bp, Artificial Sequence
  Description of Artificial Sequence: Synthetic oligonucleotide
  Target: ATXN1; (-) strand; PAM type: NRG; PAM sequence: GAG
gtggttgctttcagcctgca

SEQ ID NO: 44705 - DNA, 20 bp, Artificial Sequence
  Description of Artificial Sequence: Synthetic oligonucleotide
  Target: ATXN1; (-) strand; PAM type: NRG; PAM sequence: CAG
ctgtggttgctttcagcctg

SEQ ID NO: 44706 - DNA, 20 bp, Artificial Sequence
  Description of Artificial Sequence: Synthetic oligonucleotide
  Target: ATXN1; (-) strand; PAM type: NRG; PAM sequence: CAG
aaattatctgtggttgcttt

SEQ ID NO: 44707 - DNA, 20 bp, Artificial Sequence
  Description of Artificial Sequence: Synthetic oligonucleotide
  Target: ATXN1; (-) strand; PAM type: NRG; PAM sequence: TGG
cactggttacaaattatctg

SEQ ID NO: 44708 - DNA, 20 bp, Artificial Sequence
  Description of Artificial Sequence: Synthetic oligonucleotide
  Target: ATXN1; (-) strand; PAM type: NRG; PAM sequence: TGG
acacagccacccacacccac

SEQ ID NO: 44709 - DNA, 20 bp, Artificial Sequence
  Description of Artificial Sequence: Synthetic oligonucleotide
  Target: ATXN1; (-) strand; PAM type: NRG; PAM sequence: CAG
tttgaggcttgatcaggaca

SEQ ID NO: 44710 - DNA, 20 bp, Artificial Sequence
  Description of Artificial Sequence: Synthetic oligonucleotide
  Target: ATXN1; (-) strand; PAM type: NRG; PAM sequence: AGG
ggcatatttgaggcttgatc

SEQ ID NO: 44711 - DNA, 20 bp, Artificial Sequence
  Description of Artificial Sequence: Synthetic oligonucleotide
  Target: ATXN1; (-) strand; PAM type: NRG; PAM sequence: CAG
aggcatatttgaggcttgat

SEQ ID NO: 44712 - DNA, 20 bp, Artificial Sequence
  Description of Artificial Sequence: Synthetic oligonucleotide
  Target: ATXN1; (-) strand; PAM type: NRG; PAM sequence: AGG
gcctgcagcaggcatatttg

SEQ ID NO: 44713 - DNA, 20 bp, Artificial Sequence
  Description of Artificial Sequence: Synthetic oligonucleotide
  Target: ATXN1; (-) strand; PAM type: NRG; PAM sequence: GAG
ggcctgcagcaggcatattt

SEQ ID NO: 44714 - DNA, 20 bp, Artificial Sequence
  Description of Artificial Sequence: Synthetic oligonucleotide
  Target: ATXN1; (-) strand; PAM type: NRG; PAM sequence: AGG
catacccagaggcctgcagc

SEQ ID NO: 44715 - DNA, 20 bp, Artificial Sequence
  Description of Artificial Sequence: Synthetic oligonucleotide
  Target: ATXN1; (-) strand; PAM type: NRG; PAM sequence: CAG
acatacccagaggcctgcag

SEQ ID NO: 44716 - DNA, 20 bp, Artificial Sequence
  Description of Artificial Sequence: Synthetic oligonucleotide
  Target: ATXN1; (-) strand; PAM type: NRG; PAM sequence: CAG
aacacatacccagaggcctg

SEQ ID NO: 44717 - DNA, 20 bp, Artificial Sequence
  Description of Artificial Sequence: Synthetic oligonucleotide
  Target: ATXN1; (-) strand; PAM type: NRG; PAM sequence: AGG
cagagggaacacatacccag

SEQ ID NO: 44718 - DNA, 20 bp, Artificial Sequence
  Description of Artificial Sequence: Synthetic oligonucleotide
  Target: ATXN1; (-) strand; PAM type: NRG; PAM sequence: GAG
gcagagggaacacataccca

SEQ ID NO: 44719 - DNA, 20 bp, Artificial Sequence
  Description of Artificial Sequence: Synthetic oligonucleotide
  Target: ATXN1; (-) strand; PAM type: NRG; PAM sequence: CAG
gagcagagggaacacatacc

SEQ ID NO: 44720 - DNA, 20 bp, Artificial Sequence
  Description of Artificial Sequence: Synthetic oligonucleotide
  Target: ATXN1; (-) strand; PAM type: NRG; PAM sequence: GGG
aagtactctaacagagcaga

SEQ ID NO: 44721 - DNA, 20 bp, Artificial Sequence
  Description of Artificial Sequence: Synthetic oligonucleotide
  Target: ATXN1; (-) strand; PAM type: NRG; PAM sequence: AGG
aaagtactctaacagagcag

SEQ ID NO: 44722 - DNA, 20 bp, Artificial Sequence
  Description of Artificial Sequence: Synthetic oligonucleotide
  Target: ATXN1; (-) strand; PAM type: NRG; PAM sequence: GAG
gaaagtactctaacagagca

SEQ ID NO: 44723 - DNA, 20 bp, Artificial Sequence
  Description of Artificial Sequence: Synthetic oligonucleotide
  Target: ATXN1; (-) strand; PAM type: NRG; PAM sequence: CAG
tggaaagtactctaacagag

SEQ ID NO: 44724 - DNA, 20 bp, Artificial Sequence
  Description of Artificial Sequence: Synthetic oligonucleotide
  Target: ATXN1; (-) strand; PAM type: NRG; PAM sequence: GAG
gtgtggaaagtactctaaca

SEQ ID NO: 44725 - DNA, 20 bp, Artificial Sequence
  Description of Artificial Sequence: Synthetic oligonucleotide
  Target: ATXN1; (-) strand; PAM type: NRG; PAM sequence: CAG
tggtgtggaaagtactctaa

SEQ ID NO: 44726 - DNA, 20 bp, Artificial Sequence
  Description of Artificial Sequence: Synthetic oligonucleotide
  Target: ATXN1; (-) strand; PAM type: NRG; PAM sequence: AAG
ggagcggtggctggtgtgga

SEQ ID NO: 44727 - DNA, 20 bp, Artificial Sequence
  Description of Artificial Sequence: Synthetic oligonucleotide
  Target: ATXN1; (-) strand; PAM type: NRG; PAM sequence: TGG
cggaggagcggtggctggtg

SEQ ID NO: 44728 - DNA, 20 bp, Artificial Sequence
  Description of Artificial Sequence: Synthetic oligonucleotide
  Target: ATXN1; (-) strand; PAM type: NRG; PAM sequence: TGG
ccttgcggaggagcggtggc

SEQ ID NO: 44729 - DNA, 20 bp, Artificial Sequence
  Description of Artificial Sequence: Synthetic oligonucleotide
  Target: ATXN1; (-) strand; PAM type: NRG; PAM sequence: TGG
agtgccttgcggaggagcgg

SEQ ID NO: 44730 - DNA, 20 bp, Artificial Sequence
  Description of Artificial Sequence: Synthetic oligonucleotide
  Target: ATXN1; (-) strand; PAM type: NRG; PAM sequence: CGG
gacagtgccttgcggaggag

SEQ ID NO: 44731 - DNA, 20 bp, Artificial Sequence
  Description of Artificial Sequence: Synthetic oligonucleotide
  Target: ATXN1; (-) strand; PAM type: NRG; PAM sequence: GAG
ggtgacagtgccttgcggag

SEQ ID NO: 44732 - DNA, 20 bp, Artificial Sequence
  Description of Artificial Sequence: Synthetic oligonucleotide
  Target: ATXN1; (-) strand; PAM type: NRG; PAM sequence: AGG
caggtgacagtgccttgcgg

SEQ ID NO: 44733 - DNA, 20 bp, Artificial Sequence
  Description of Artificial Sequence: Synthetic oligonucleotide
  Target: ATXN1; (-) strand; PAM type: NRG; PAM sequence: GAG
acaggtgacagtgccttgcg

SEQ ID NO: 44734 - DNA, 20 bp, Artificial Sequence
  Description of Artificial Sequence: Synthetic oligonucleotide
  Target: ATXN1; (-) strand; PAM type: NRG; PAM sequence: CGG
aaacaggtgacagtgccttg

SEQ ID NO: 44735 - DNA, 20 bp, Artificial Sequence
  Description of Artificial Sequence: Synthetic oligonucleotide
  Target: ATXN1; (-) strand; PAM type: NRG; PAM sequence: CAG
ctgcattagaaaacaggtga

SEQ ID NO: 44736 - DNA, 20 bp, Artificial Sequence
  Description of Artificial Sequence: Synthetic oligonucleotide
  Target: ATXN1; (-) strand; PAM type: NRG; PAM sequence: AGG
gaaccactgcattagaaaac

SEQ ID NO: 44737 - DNA, 20 bp, Artificial Sequence
  Description of Artificial Sequence: Synthetic oligonucleotide
  Target: ATXN1; (-) strand; PAM type: NRG; PAM sequence: CAG
agaaccactgcattagaaaa

SEQ ID NO: 44738 - DNA, 20 bp, Artificial Sequence
  Description of Artificial Sequence: Synthetic oligonucleotide
  Target: ATXN1; (-) strand; PAM type: NRG; PAM sequence: TAG
gagtataagaaccactgcat

SEQ ID NO: 44739 - DNA, 20 bp, Artificial Sequence
  Description of Artificial Sequence: Synthetic oligonucleotide
  Target: ATXN1; (-) strand; PAM type: NRG; PAM sequence: AAG
tgatgcgcacgctcgagtat

SEQ ID NO: 44740 - DNA, 20 bp, Artificial Sequence
  Description of Artificial Sequence: Synthetic oligonucleotide
  Target: ATXN1; (-) strand; PAM type: NRG; PAM sequence: GAG
tgaatgtgatgcgcacgctc

SEQ ID NO: 44741 - DNA, 20 bp, Artificial Sequence
  Description of Artificial Sequence: Synthetic oligonucleotide
  Target: ATXN1; (-) strand; PAM type: NRG; PAM sequence: GGG
cagcagcatctgggaactcc

SEQ ID NO: 44742 - DNA, 20 bp, Artificial Sequence
  Description of Artificial Sequence: Synthetic oligonucleotide
  Target: ATXN1; (-) strand; PAM type: NRG; PAM sequence: CGG
tcagcagcatctgggaactc

SEQ ID NO: 44743 - DNA, 20 bp, Artificial Sequence
  Description of Artificial Sequence: Synthetic oligonucleotide
  Target: ATXN1; (-) strand; PAM type: NRG; PAM sequence: GGG
cagcagcatcagcagcatct

SEQ ID NO: 44744 - DNA, 20 bp, Artificial Sequence
  Description of Artificial Sequence: Synthetic oligonucleotide
  Target: ATXN1; (-) strand; PAM type: NRG; PAM sequence: TGG
ccagcagcatcagcagcatc

SEQ ID NO: 44745 - DNA, 20 bp, Artificial Sequence
  Description of Artificial Sequence: Synthetic oligonucleotide
  Target: ATXN1; (-) strand; PAM type: NRG; PAM sequence: CAG
tcctggaccagcagcatcag

SEQ ID NO: 44746 - DNA, 20 bp, Artificial Sequence
  Description of Artificial Sequence: Synthetic oligonucleotide
  Target: ATXN1; (-) strand; PAM type: NRG; PAM sequence: CAG
ggttcctggaccagcagcat

SEQ ID NO: 44747 - DNA, 20 bp, Artificial Sequence
  Description of Artificial Sequence: Synthetic oligonucleotide
  Target: ATXN1; (-) strand; PAM type: NRG; PAM sequence: CAG
aagtgtggttcctggaccag

SEQ ID NO: 44748 - DNA, 20 bp, Artificial Sequence
  Description of Artificial Sequence: Synthetic oligonucleotide
  Target: ATXN1; (-) strand; PAM type: NRG; PAM sequence: CAG
tggaagtgtggttcctggac

SEQ ID NO: 44749 - DNA, 20 bp, Artificial Sequence
  Description of Artificial Sequence: Synthetic oligonucleotide
  Target: ATXN1; (-) strand; PAM type: NRG; PAM sequence: TGG
gcttctggaagtgtggttcc

SEQ ID NO: 44750 - DNA, 20 bp, Artificial Sequence
  Description of Artificial Sequence: Synthetic oligonucleotide
  Target: ATXN1; (-) strand; PAM type: NRG; PAM sequence: TGG
ggccagtgcttctggaagtg

SEQ ID NO: 44751 - DNA, 20 bp, Artificial Sequence
  Description of Artificial Sequence: Synthetic oligonucleotide
  Target: ATXN1; (-) strand; PAM type: NRG; PAM sequence: AAG
ggtgaggccagtgcttctgg

SEQ ID NO: 44752 - DNA, 20 bp, Artificial Sequence
  Description of Artificial Sequence: Synthetic oligonucleotide
  Target: ATXN1; (-) strand; PAM type: NRG; PAM sequence: TGG
atgggtgaggccagtgcttc

SEQ ID NO: 44753 - DNA, 20 bp, Artificial Sequence
  Description of Artificial Sequence: Synthetic oligonucleotide
  Target: ATXN1; (-) strand; PAM type: NRG; PAM sequence: CAG
acctgaaagatgggtgaggc

SEQ ID NO: 44754 - DNA, 20 bp, Artificial Sequence
  Description of Artificial Sequence: Synthetic oligonucleotide
  Target: ATXN1; (-) strand; PAM type: NRG; PAM sequence: AGG
agagacctgaaagatgggtg

SEQ ID NO: 44755 - DNA, 20 bp, Artificial Sequence
  Description of Artificial Sequence: Synthetic oligonucleotide
  Target: ATXN1; (-) strand; PAM type: NRG; PAM sequence: GAG
gagagacctgaaagatgggt

SEQ ID NO: 44756 - DNA, 20 bp, Artificial Sequence
  Description of Artificial Sequence: Synthetic oligonucleotide
  Target: ATXN1; (-) strand; PAM type: NRG; PAM sequence: GGG
gaaggagagacctgaaagat

SEQ ID NO: 44757 - DNA, 20 bp, Artificial Sequence
  Description of Artificial Sequence: Synthetic oligonucleotide
  Target: ATXN1; (-) strand; PAM type: NRG; PAM sequence: TGG
ggaaggagagacctgaaaga

SEQ ID NO: 44758 - DNA, 20 bp, Artificial Sequence
  Description of Artificial Sequence: Synthetic oligonucleotide
  Target: ATXN1; (-) strand; PAM type: NRG; PAM sequence: AAG
acatggaaggagagacctga

SEQ ID NO: 44759 - DNA, 20 bp, Artificial Sequence
  Description of Artificial Sequence: Synthetic oligonucleotide
  Target: ATXN1; (-) strand; PAM type: NRG; PAM sequence: GAG
aaggaggtgacatggaagga

SEQ ID NO: 44760 - DNA, 20 bp, Artificial Sequence
  Description of Artificial Sequence: Synthetic oligonucleotide
  Target: ATXN1; (-) strand; PAM type: NRG; PAM sequence: GAG
ttaaggaggtgacatggaag

SEQ ID NO: 44761 - DNA, 20 bp, Artificial Sequence
  Description of Artificial Sequence: Synthetic oligonucleotide
  Target: ATXN1; (-) strand; PAM type: NRG; PAM sequence: AGG
ccttaaggaggtgacatgga

SEQ ID NO: 44762 - DNA, 20 bp, Artificial Sequence
  Description of Artificial Sequence: Synthetic oligonucleotide
  Target: ATXN1; (-) strand; PAM type: NRG; PAM sequence: AAG
gccttaaggaggtgacatgg

SEQ ID NO: 44763 - DNA, 20 bp, Artificial Sequence
  Description of Artificial Sequence: Synthetic oligonucleotide
  Target: ATXN1; (-) strand; PAM type: NRG; PAM sequence: TGG
agagccttaaggaggtgaca

SEQ ID NO: 44764 - DNA, 20 bp, Artificial Sequence
  Description of Artificial Sequence: Synthetic oligonucleotide
  Target: ATXN1; (-) strand; PAM type: NRG; PAM sequence: AGG
gagtggggagagccttaagg

SEQ ID NO: 44765 - DNA, 20 bp, Artificial Sequence
  Description of Artificial Sequence: Synthetic oligonucleotide
  Target: ATXN1; (-) strand; PAM type: NRG; PAM sequence: GAG
ggagtggggagagccttaag

SEQ ID NO: 44766 - DNA, 20 bp, Artificial Sequence
  Description of Artificial Sequence: Synthetic oligonucleotide
  Target: ATXN1; (-) strand; PAM type: NRG; PAM sequence: AGG
ttggagtggggagagcctta

SEQ ID NO: 44767 - DNA, 20 bp, Artificial Sequence
  Description of Artificial Sequence: Synthetic oligonucleotide
  Target: ATXN1; (-) strand; PAM type: NRG; PAM sequence: AAG
gttggagtggggagagcctt

SEQ ID NO: 44768 - DNA, 20 bp, Artificial Sequence
  Description of Artificial Sequence: Synthetic oligonucleotide
  Target: ATXN1; (-) strand; PAM type: NRG; PAM sequence: GAG
gtatggggttggagtgggga

SEQ ID NO: 44769 - DNA, 20 bp, Artificial Sequence
  Description of Artificial Sequence: Synthetic oligonucleotide
  Target: ATXN1; (-) strand; PAM type: NRG; PAM sequence: GAG
gggtatggggttggagtggg

SEQ ID NO: 44770 - DNA, 20 bp, Artificial Sequence
  Description of Artificial Sequence: Synthetic oligonucleotide
  Target: ATXN1; (-) strand; PAM type: NRG; PAM sequence: GGG
gagggtatggggttggagtg

SEQ ID NO: 44771 - DNA, 20 bp, Artificial Sequence
  Description of Artificial Sequence: Synthetic oligonucleotide
  Target: ATXN1; (-) strand; PAM type: NRG; PAM sequence: GGG
agagggtatggggttggagt

SEQ ID NO: 44772 - DNA, 20 bp, Artificial Sequence
  Description of Artificial Sequence: Synthetic oligonucleotide
  Target: ATXN1; (-) strand; PAM type: NRG; PAM sequence: TGG
cagagggtatggggttggag

SEQ ID NO: 44773 - DNA, 20 bp, Artificial Sequence
  Description of Artificial Sequence: Synthetic oligonucleotide
  Target: ATXN1; (-) strand; PAM type: NRG; PAM sequence: GAG
aggcagagggtatggggttg

SEQ ID NO: 44774 - DNA, 20 bp, Artificial Sequence
  Description of Artificial Sequence: Synthetic oligonucleotide
  Target: ATXN1; (-) strand; PAM type: NRG; PAM sequence: TGG
agaggcagagggtatggggt

SEQ ID NO: 44775 - DNA, 20 bp, Artificial Sequence
  Description of Artificial Sequence: Synthetic oligonucleotide
  Target: ATXN1; (-) strand; PAM type: NRG; PAM sequence: GGG
gaggagaggcagagggtatg

SEQ ID NO: 44776 - DNA, 20 bp, Artificial Sequence
  Description of Artificial Sequence: Synthetic oligonucleotide
  Target: ATXN1; (-) strand; PAM type: NRG; PAM sequence: GGG
agaggagaggcagagggtat

SEQ ID NO: 44777 - DNA, 20 bp, Artificial Sequence
  Description of Artificial Sequence: Synthetic oligonucleotide
  Target: ATXN1; (-) strand; PAM type: NRG; PAM sequence: TGG
cagaggagaggcagagggta

SEQ ID NO: 44778 - DNA, 20 bp, Artificial Sequence
  Description of Artificial Sequence: Synthetic oligonucleotide
  Target: ATXN1; (-) strand; PAM type: NRG; PAM sequence: GGG
aggcacagaggagaggcaga

SEQ ID NO: 44779 - DNA, 20 bp, Artificial Sequence
  Description of Artificial Sequence: Synthetic oligonucleotide
  Target: ATXN1; (-) strand; PAM type: NRG; PAM sequence: AGG
gaggcacagaggagaggcag

SEQ ID NO: 44780 - DNA, 20 bp, Artificial Sequence
  Description of Artificial Sequence: Synthetic oligonucleotide
  Target: ATXN1; (-) strand; PAM type: NRG; PAM sequence: GAG
ggaggcacagaggagaggca

SEQ ID NO: 44781 - DNA, 20 bp, Artificial Sequence
  Description of Artificial Sequence: Synthetic oligonucleotide
  Target: ATXN1; (-) strand; PAM type: NRG; PAM sequence: CAG
aaggaggcacagaggagagg

SEQ ID NO: 44782 - DNA, 20 bp, Artificial Sequence
  Description of Artificial Sequence: Synthetic oligonucleotide
  Target: ATXN1; (-) strand; PAM type: NRG; PAM sequence: AGG
gctaaggaggcacagaggag

SEQ ID NO: 44783 - DNA, 20 bp, Artificial Sequence
  Description of Artificial Sequence: Synthetic oligonucleotide
  Target: ATXN1; (-) strand; PAM type: NRG; PAM sequence: GAG
tgctaaggaggcacagagga

SEQ ID NO: 44784 - DNA, 20 bp, Artificial Sequence
  Description of Artificial Sequence: Synthetic oligonucleotide
  Target: ATXN1; (-) strand; PAM type: NRG; PAM sequence: GAG
ggtgctaaggaggcacagag

SEQ ID NO: 44785 - DNA, 20 bp, Artificial Sequence
  Description of Artificial Sequence: Synthetic oligonucleotide
  Target: ATXN1; (-) strand; PAM type: NRG; PAM sequence: AGG
agggtgctaaggaggcacag

SEQ ID NO: 44786 - DNA, 20 bp, Artificial Sequence
  Description of Artificial Sequence: Synthetic oligonucleotide
  Target: ATXN1; (-) strand; PAM type: NRG; PAM sequence: GAG
cagggtgctaaggaggcaca

SEQ ID NO: 44787 - DNA, 20 bp, Artificial Sequence
  Description of Artificial Sequence: Synthetic oligonucleotide
  Target: ATXN1; (-) strand; PAM type: NRG; PAM sequence: CAG
agcagggtgctaaggaggca

SEQ ID NO: 44788 - DNA, 20 bp, Artificial Sequence
  Description of Artificial Sequence: Synthetic oligonucleotide
  Target: ATXN1; (-) strand; PAM type: NRG; PAM sequence: AGG
gttggagcagggtgctaagg

SEQ ID NO: 44789 - DNA, 20 bp, Artificial Sequence
  Description of Artificial Sequence: Synthetic oligonucleotide
  Target: ATXN1; (-) strand; PAM type: NRG; PAM sequence: GAG
tgttggagcagggtgctaag

SEQ ID NO: 44790 - DNA, 20 bp, Artificial Sequence
  Description of Artificial Sequence: Synthetic oligonucleotide
  Target: ATXN1; (-) strand; PAM type: NRG; PAM sequence: AGG
aatgttggagcagggtgcta

SEQ ID NO: 44791 - DNA, 20 bp, Artificial Sequence
  Description of Artificial Sequence: Synthetic oligonucleotide
  Target: ATXN1; (-) strand; PAM type: NRG; PAM sequence: AAG
gaatgttggagcagggtgct

SEQ ID NO: 44792 - DNA, 20 bp, Artificial Sequence
  Description of Artificial Sequence: Synthetic oligonucleotide
  Target: ATXN1; (-) strand; PAM type: NRG; PAM sequence: GGG
tggatgagaatgttggagca

SEQ ID NO: 44793 - DNA, 20 bp, Artificial Sequence
  Description of Artificial Sequence: Synthetic oligonucleotide
  Target: ATXN1; (-) strand; PAM type: NRG; PAM sequence: AGG
gtggatgagaatgttggagc

SEQ ID NO: 44794 - DNA, 20 bp, Artificial Sequence
  Description of Artificial Sequence: Synthetic oligonucleotide
  Target: ATXN1; (-) strand; PAM type: NRG; PAM sequence: CAG
tgtggatgagaatgttggag

SEQ ID NO: 44795 - DNA, 20 bp, Artificial Sequence
  Description of Artificial Sequence: Synthetic oligonucleotide
  Target: ATXN1; (-) strand; PAM type: NRG; PAM sequence: GAG
gtgtgtggatgagaatgttg

SEQ ID NO: 44796 - DNA, 20 bp, Artificial Sequence
  Description of Artificial Sequence: Synthetic oligonucleotide
  Target: ATXN1; (-) strand; PAM type: NRG; PAM sequence: TGG
cggtgtgtggatgagaatgt

SEQ ID NO: 44797 - DNA, 20 bp, Artificial Sequence
  Description of Artificial Sequence: Synthetic oligonucleotide
  Target: ATXN1; (-) strand; PAM type: NRG; PAM sequence: GAG
ttcctgaacggtgtgtggat

SEQ ID NO: 44798 - DNA, 20 bp, Artificial Sequence
  Description of Artificial Sequence: Synthetic oligonucleotide
  Target: ATXN1; (-) strand; PAM type: NRG; PAM sequence: TGG
aacggttcctgaacggtgtg

SEQ ID NO: 44799 - DNA, 20 bp, Artificial Sequence
  Description of Artificial Sequence: Synthetic oligonucleotide
  Target: ATXN1; (-) strand; PAM type: NRG; PAM sequence: CGG
tcgaggaaacggttcctgaa

SEQ ID NO: 44800 - DNA, 20 bp, Artificial Sequence
  Description of Artificial Sequence: Synthetic oligonucleotide
  Target: ATXN1; (-) strand; PAM type: NRG; PAM sequence: CGG
ttggaggatagtcgaggaaa

SEQ ID NO: 44801 - DNA, 20 bp, Artificial Sequence
  Description of Artificial Sequence: Synthetic oligonucleotide
  Target: ATXN1; (-) strand; PAM type: NRG; PAM sequence: AGG
ggagccttggaggatagtcg

SEQ ID NO: 44802 - DNA, 20 bp, Artificial Sequence
  Description of Artificial Sequence: Synthetic oligonucleotide
  Target: ATXN1; (-) strand; PAM type: NRG; PAM sequence: GAG
tggagccttggaggatagtc

SEQ ID NO: 44803 - DNA, 20 bp, Artificial Sequence
  Description of Artificial Sequence: Synthetic oligonucleotide
  Target: ATXN1; (-) strand; PAM type: NRG; PAM sequence: TAG
ctaattggagccttggagga

SEQ ID NO: 44804 - DNA, 20 bp, Artificial Sequence
  Description of Artificial Sequence: Synthetic oligonucleotide
  Target: ATXN1; (-) strand; PAM type: NRG; PAM sequence: AGG
tagactaattggagccttgg

SEQ ID NO: 44805 - DNA, 20 bp, Artificial Sequence
  Description of Artificial Sequence: Synthetic oligonucleotide
  Target: ATXN1; (-) strand; PAM type: NRG; PAM sequence: GAG
ttagactaattggagccttg

SEQ ID NO: 44806 - DNA, 20 bp, Artificial Sequence
  Description of Artificial Sequence: Synthetic oligonucleotide
  Target: ATXN1; (-) strand; PAM type: NRG; PAM sequence: TGG
tgttagactaattggagcct

SEQ ID NO: 44807 - DNA, 20 bp, Artificial Sequence
  Description of Artificial Sequence: Synthetic oligonucleotide
  Target: ATXN1; (-) strand; PAM type: NRG; PAM sequence: GAG
ggctggtgttagactaattg

SEQ ID NO: 44808 - DNA, 20 bp, Artificial Sequence
  Description of Artificial Sequence: Synthetic oligonucleotide
  Target: ATXN1; (-) strand; PAM type: NRG; PAM sequence: TGG
gtggctggtgttagactaat

SEQ ID NO: 44809 - DNA, 20 bp, Artificial Sequence
  Description of Artificial Sequence: Synthetic oligonucleotide
  Target: ATXN1; (-) strand; PAM type: NRG; PAM sequence: TAG
catgcgggggtggctggtgt

SEQ ID NO: 44810 - DNA, 20 bp, Artificial Sequence
  Description of Artificial Sequence: Synthetic oligonucleotide
  Target: ATXN1; (-) strand; PAM type: NRG; PAM sequence: TGG
tgaaggcatgcgggggtggc

SEQ ID NO: 44811 - DNA, 20 bp, Artificial Sequence
  Description of Artificial Sequence: Synthetic oligonucleotide
  Target: ATXN1; (-) strand; PAM type: NRG; PAM sequence: TGG
atggtgaaggcatgcggggg

SEQ ID NO: 44812 - DNA, 20 bp, Artificial Sequence
  Description of Artificial Sequence: Synthetic oligonucleotide
  Target: ATXN1; (-) strand; PAM type: NRG; PAM sequence: GGG
accatggtgaaggcatgcgg

SEQ ID NO: 44813 - DNA, 20 bp, Artificial Sequence
  Description of Artificial Sequence: Synthetic oligonucleotide
  Target: ATXN1; (-) strand; PAM type: NRG; PAM sequence: GGG
caccatggtgaaggcatgcg

SEQ ID NO: 44814 - DNA, 20 bp, Artificial Sequence
  Description of Artificial Sequence: Synthetic oligonucleotide
  Target: ATXN1; (-) strand; PAM type: NRG; PAM sequence: GGG
ccaccatggtgaaggcatgc

SEQ ID NO: 44815 - DNA, 20 bp, Artificial Sequence
  Description of Artificial Sequence: Synthetic oligonucleotide
  Target: ATXN1; (-) strand; PAM type: NRG; PAM sequence: CGG
cccaccatggtgaaggcatg

SEQ ID NO: 44816 - DNA, 20 bp, Artificial Sequence
  Description of Artificial Sequence: Synthetic oligonucleotide
  Target: ATXN1; (-) strand; PAM type: NRG; PAM sequence: AGG
catcatgcccaccatggtga

SEQ ID NO: 44817 - DNA, 20 bp, Artificial Sequence
  Description of Artificial Sequence: Synthetic oligonucleotide
  Target: ATXN1; (-) strand; PAM type: NRG; PAM sequence: AAG
ccatcatgcccaccatggtg

SEQ ID NO: 44818 - DNA, 20 bp, Artificial Sequence
  Description of Artificial Sequence: Synthetic oligonucleotide
  Target: ATXN1; (-) strand; PAM type: NRG; PAM sequence: TGG
attaaccatcatgcccacca

SEQ ID NO: 44819 - DNA, 20 bp, Artificial Sequence
  Description of Artificial Sequence: Synthetic oligonucleotide
  Target: ATXN1; (-) strand; PAM type: NRG; PAM sequence: CAG
aatccaatcaagttgacact

SEQ ID NO: 44820 - DNA, 20 bp, Artificial Sequence
  Description of Artificial Sequence: Synthetic oligonucleotide
  Target: ATXN1; (-) strand; PAM type: NRG; PAM sequence: AAG
ttgcatccttcaatccaatc

SEQ ID NO: 44821 - DNA, 20 bp, Artificial Sequence
  Description of Artificial Sequence: Synthetic oligonucleotide
  Target: ATXN1; (-) strand; PAM type: NRG; PAM sequence: AAG
acaccctcacagacacaacc

SEQ ID NO: 44822 - DNA, 20 bp, Artificial Sequence
  Description of Artificial Sequence: Synthetic oligonucleotide
  Target: ATXN1; (-) strand; PAM type: NRG; PAM sequence: CAG
ctcctttggcaacaccctca

SEQ ID NO: 44823 - DNA, 20 bp, Artificial Sequence
  Description of Artificial Sequence: Synthetic oligonucleotide
  Target: ATXN1; (-) strand; PAM type: NRG; PAM sequence: TGG
acccaaatgtttatctcctt

SEQ ID NO: 44824 - DNA, 20 bp, Artificial Sequence
  Description of Artificial Sequence: Synthetic oligonucleotide
  Target: ATXN1; (-) strand; PAM type: NRG; PAM sequence: AAG
gagggtgggtcttcctctcc

SEQ ID NO: 44825 - DNA, 20 bp, Artificial Sequence
  Description of Artificial Sequence: Synthetic oligonucleotide
  Target: ATXN1; (-) strand; PAM type: NRG; PAM sequence: GGG
tgcccacccagattgagggt

SEQ ID NO: 44826 - DNA, 20 bp, Artificial Sequence
  Description of Artificial Sequence: Synthetic oligonucleotide
  Target: ATXN1; (-) strand; PAM type: NRG; PAM sequence: TGG
gtgcccacccagattgaggg

SEQ ID NO: 44827 - DNA, 20 bp, Artificial Sequence
  Description of Artificial Sequence: Synthetic oligonucleotide
  Target: ATXN1; (-) strand; PAM type: NRG; PAM sequence: GGG
attgtgcccacccagattga

SEQ ID NO: 44828 - DNA, 20 bp, Artificial Sequence
  Description of Artificial Sequence: Synthetic oligonucleotide
  Target: ATXN1; (-) strand; PAM type: NRG; PAM sequence: AGG
gattgtgcccacccagattg

SEQ ID NO: 44829 - DNA, 20 bp, Artificial Sequence
  Description of Artificial Sequence: Synthetic oligonucleotide
  Target: ATXN1; (-) strand; PAM type: NRG; PAM sequence: GAG
agattgtgcccacccagatt

SEQ ID NO: 44830 - DNA, 20 bp, Artificial Sequence
  Description of Artificial Sequence: Synthetic oligonucleotide
  Target: ATXN1; (-) strand; PAM type: NRG; PAM sequence: CAG
ctgattagattgtgcccacc

SEQ ID NO: 44831 - DNA, 20 bp, Artificial Sequence
  Description of Artificial Sequence: Synthetic oligonucleotide
  Target: ATXN1; (-) strand; PAM type: NRG; PAM sequence: TAG
tagcctcactggcagctgat

SEQ ID NO: 44832 - DNA, 20 bp, Artificial Sequence
  Description of Artificial Sequence: Synthetic oligonucleotide
  Target: ATXN1; (-) strand; PAM type: NRG; PAM sequence: CAG
tttcattctagcctcactgg

SEQ ID NO: 44833 - DNA, 20 bp, Artificial Sequence
  Description of Artificial Sequence: Synthetic oligonucleotide
  Target: ATXN1; (-) strand; PAM type: NRG; PAM sequence: TGG
tgctttcattctagcctcac

SEQ ID NO: 44834 - DNA, 20 bp, Artificial Sequence
  Description of Artificial Sequence: Synthetic oligonucleotide
  Target: ATXN1; (-) strand; PAM type: NRG; PAM sequence: TAG
tcttctgcctgctttcattc

SEQ ID NO: 44835 - DNA, 20 bp, Artificial Sequence
  Description of Artificial Sequence: Synthetic oligonucleotide
  Target: ATXN1; (-) strand; PAM type: NRG; PAM sequence: TAG
gccagaagactcagccagtc

SEQ ID NO: 44836 - DNA, 20 bp, Artificial Sequence
  Description of Artificial Sequence: Synthetic oligonucleotide
  Target: ATXN1; (-) strand; PAM type: NRG; PAM sequence: CAG
tgaaggccagaagactcagc

SEQ ID NO: 44837 - DNA, 20 bp, Artificial Sequence
  Description of Artificial Sequence: Synthetic oligonucleotide
  Target: ATXN1; (-) strand; PAM type: NRG; PAM sequence: CAG
aagatgaaggccagaagact

SEQ ID NO: 44838 - DNA, 20 bp, Artificial Sequence
  Description of Artificial Sequence: Synthetic oligonucleotide
  Target: ATXN1; (-) strand; PAM type: NRG; PAM sequence: AAG
gagaaaaagatgaaggccag

SEQ ID NO: 44839 - DNA, 20 bp, Artificial Sequence
  Description of Artificial Sequence: Synthetic oligonucleotide
  Target: ATXN1; (-) strand; PAM type: NRG; PAM sequence: CAG
cacgagaaaaagatgaaggc

SEQ ID NO: 44840 - DNA, 20 bp, Artificial Sequence
  Description of Artificial Sequence: Synthetic oligonucleotide
  Target: ATXN1; (-) strand; PAM type: NRG; PAM sequence: AGG
ccagcacgagaaaaagatga

SEQ ID NO: 44841 - DNA, 20 bp, Artificial Sequence
  Description of Artificial Sequence: Synthetic oligonucleotide
  Target: ATXN1; (-) strand; PAM type: NRG; PAM sequence: AAG
tccagcacgagaaaaagatg

SEQ ID NO: 44842 - DNA, 20 bp, Artificial Sequence
  Description of Artificial Sequence: Synthetic oligonucleotide
  Target: ATXN1; (-) strand; PAM type: NRG; PAM sequence: AAG
gaagcatccagcacgagaaa

SEQ ID NO: 44843 - DNA, 20 bp, Artificial Sequence
  Description of Artificial Sequence: Synthetic oligonucleotide
  Target: ATXN1; (-) strand; PAM type: NRG; PAM sequence: GAG
gggcaggaagcatccagcac

SEQ ID NO: 44844 - DNA, 20 bp, Artificial Sequence
  Description of Artificial Sequence: Synthetic oligonucleotide
  Target: ATXN1; (-) strand; PAM type: NRG; PAM sequence: CAG
gttcgagggcaggaagcatc

SEQ ID NO: 44845 - DNA, 20 bp, Artificial Sequence
  Description of Artificial Sequence: Synthetic oligonucleotide
  Target: ATXN1; (-) strand; PAM type: NRG; PAM sequence: AAG
gtcgggtgttcgagggcagg

SEQ ID NO: 44846 - DNA, 20 bp, Artificial Sequence
  Description of Artificial Sequence: Synthetic oligonucleotide
  Target: ATXN1; (-) strand; PAM type: NRG; PAM sequence: AGG
caagtcgggtgttcgagggc

SEQ ID NO: 44847 - DNA, 20 bp, Artificial Sequence
  Description of Artificial Sequence: Synthetic oligonucleotide
  Target: ATXN1; (-) strand; PAM type: NRG; PAM sequence: CAG
tcaagtcgggtgttcgaggg

SEQ ID NO: 44848 - DNA, 20 bp, Artificial Sequence
  Description of Artificial Sequence: Synthetic oligonucleotide
  Target: ATXN1; (-) strand; PAM type: NRG; PAM sequence: GGG
acttcaagtcgggtgttcga

SEQ ID NO: 44849 - DNA, 20 bp, Artificial Sequence
  Description of Artificial Sequence: Synthetic oligonucleotide
  Target: ATXN1; (-) strand; PAM type: NRG; PAM sequence: AGG
aacttcaagtcgggtgttcg

SEQ ID NO: 44850 - DNA, 20 bp, Artificial Sequence
  Description of Artificial Sequence: Synthetic oligonucleotide
  Target: ATXN1; (-) strand; PAM type: NRG; PAM sequence: GAG
gaacttcaagtcgggtgttc

SEQ ID NO: 44851 - DNA, 20 bp, Artificial Sequence
  Description of Artificial Sequence: Synthetic oligonucleotide
  Target: ATXN1; (-) strand; PAM type: NRG; PAM sequence: GGG
aagctgaagaacttcaagtc

SEQ ID NO: 44852 - DNA, 20 bp, Artificial Sequence
  Description of Artificial Sequence: Synthetic oligonucleotide
  Target: ATXN1; (-) strand; PAM type: NRG; PAM sequence: CGG
aaagctgaagaacttcaagt

SEQ ID NO: 44853 - DNA, 20 bp, Artificial Sequence
  Description of Artificial Sequence: Synthetic oligonucleotide
  Target: ATXN1; (-) strand; PAM type: NRG; PAM sequence: AAG
tccaaaagctgaagaacttc

SEQ ID NO: 44854 - DNA, 20 bp, Artificial Sequence
  Description of Artificial Sequence: Synthetic oligonucleotide
  Target: ATXN1; (-) strand; PAM type: NRG; PAM sequence: AAG
gtccaagagtccaaaagctg

SEQ ID NO: 44855 - DNA, 20 bp, Artificial Sequence
  Description of Artificial Sequence: Synthetic oligonucleotide
  Target: ATXN1; (-) strand; PAM type: NRG; PAM sequence: AAG
gtgtaggtccaagagtccaa

SEQ ID NO: 44856 - DNA, 20 bp, Artificial Sequence
  Description of Artificial Sequence: Synthetic oligonucleotide
  Target: ATXN1; (-) strand; PAM type: NRG; PAM sequence: GAG
aaccattagtgtaggtccaa

SEQ ID NO: 44857 - DNA, 20 bp, Artificial Sequence
  Description of Artificial Sequence: Synthetic oligonucleotide
  Target: ATXN1; (-) strand; PAM type: NRG; PAM sequence: AAG
ccaaccattagtgtaggtcc

SEQ ID NO: 44858 - DNA, 20 bp, Artificial Sequence
  Description of Artificial Sequence: Synthetic oligonucleotide
  Target: ATXN1; (-) strand; PAM type: NRG; PAM sequence: AGG
ccctggccaaccattagtgt

SEQ ID NO: 44859 - DNA, 20 bp, Artificial Sequence
  Description of Artificial Sequence: Synthetic oligonucleotide
  Target: ATXN1; (-) strand; PAM type: NRG; PAM sequence: TAG
gccctggccaaccattagtg

SEQ ID NO: 44860 - DNA, 20 bp, Artificial Sequence
  Description of Artificial Sequence: Synthetic oligonucleotide
  Target: ATXN1; (-) strand; PAM type: NRG; PAM sequence: TAG
caagagccctggccaaccat

SEQ ID NO: 44861 - DNA, 20 bp, Artificial Sequence
  Description of Artificial Sequence: Synthetic oligonucleotide
  Target: ATXN1; (-) strand; PAM type: NRG; PAM sequence: TGG
ggccaaaggcccaagagccc

SEQ ID NO: 44862 - DNA, 20 bp, Artificial Sequence
  Description of Artificial Sequence: Synthetic oligonucleotide
  Target: ATXN1; (-) strand; PAM type: NRG; PAM sequence: GAG
gcctgtggccaaaggcccaa

SEQ ID NO: 44863 - DNA, 20 bp, Artificial Sequence
  Description of Artificial Sequence: Synthetic oligonucleotide
  Target: ATXN1; (-) strand; PAM type: NRG; PAM sequence: AAG
cagcctgtggccaaaggccc

SEQ ID NO: 44864 - DNA, 20 bp, Artificial Sequence
  Description of Artificial Sequence: Synthetic oligonucleotide
  Target: ATXN1; (-) strand; PAM type: NRG; PAM sequence: AGG
agccttcagcctgtggccaa

SEQ ID NO: 44865 - DNA, 20 bp, Artificial Sequence
  Description of Artificial Sequence: Synthetic oligonucleotide
  Target: ATXN1; (-) strand; PAM type: NRG; PAM sequence: AAG
cagccttcagcctgtggcca

SEQ ID NO: 44866 - DNA, 20 bp, Artificial Sequence
  Description of Artificial Sequence: Synthetic oligonucleotide
  Target: ATXN1; (-) strand; PAM type: NRG; PAM sequence: TGG
acagtgcagccttcagcctg

SEQ ID NO: 44867 - DNA, 20 bp, Artificial Sequence
  Description of Artificial Sequence: Synthetic oligonucleotide
  Target: ATXN1; (-) strand; PAM type: NRG; PAM sequence: CAG
gaagccgacagtgcagcctt

SEQ ID NO: 44868 - DNA, 20 bp, Artificial Sequence
  Description of Artificial Sequence: Synthetic oligonucleotide
  Target: ATXN1; (-) strand; PAM type: NRG; PAM sequence: CAG
aagtagggaagccgacagtg

SEQ ID NO: 44869 - DNA, 20 bp, Artificial Sequence
  Description of Artificial Sequence: Synthetic oligonucleotide
  Target: ATXN1; (-) strand; PAM type: NRG; PAM sequence: CAG
ctcaaaagtagggaagccga

SEQ ID NO: 44870 - DNA, 20 bp, Artificial Sequence
  Description of Artificial Sequence: Synthetic oligonucleotide
  Target: ATXN1; (-) strand; PAM type: NRG; PAM sequence: AAG
ccaagacctcaaaagtaggg

SEQ ID NO: 44871 - DNA, 20 bp, Artificial Sequence
  Description of Artificial Sequence: Synthetic oligonucleotide
  Target: ATXN1; (-) strand; PAM type: NRG; PAM sequence: GGG
gtcccaagacctcaaaagta

SEQ ID NO: 44872 - DNA, 20 bp, Artificial Sequence
  Description of Artificial Sequence: Synthetic oligonucleotide
  Target: ATXN1; (-) strand; PAM type: NRG; PAM sequence: AGG
agtcccaagacctcaaaagt

SEQ ID NO: 44873 - DNA, 20 bp, Artificial Sequence
  Description of Artificial Sequence: Synthetic oligonucleotide
  Target: ATXN1; (-) strand; PAM type: NRG; PAM sequence: TAG
gagtcccaagacctcaaaag

SEQ ID NO: 44874 - DNA, 20 bp, Artificial Sequence
  Description of Artificial Sequence: Synthetic oligonucleotide
  Target: ATXN1; (-) strand; PAM type: NRG; PAM sequence: AAG
tctgagtcccaagacctcaa

SEQ ID NO: 44875 - DNA, 20 bp, Artificial Sequence
  Description of Artificial Sequence: Synthetic oligonucleotide
  Target: ATXN1; (-) strand; PAM type: NRG; PAM sequence: AAG
ggttgaccagtctgagtccc

SEQ ID NO: 44876 - DNA, 20 bp, Artificial Sequence
  Description of Artificial Sequence: Synthetic oligonucleotide
  Target: ATXN1; (-) strand; PAM type: NRG; PAM sequence: GAG
agccagtggttgaccagtct

SEQ ID NO: 44877 - DNA, 20 bp, Artificial Sequence
  Description of Artificial Sequence: Synthetic oligonucleotide
  Target: ATXN1; (-) strand; PAM type: NRG; PAM sequence: CAG
caaggaagccagtggttgac

SEQ ID NO: 44878 - DNA, 20 bp, Artificial Sequence
  Description of Artificial Sequence: Synthetic oligonucleotide
  Target: ATXN1; (-) strand; PAM type: NRG; PAM sequence: TGG
ctgaggagcaaggaagccag

SEQ ID NO: 44879 - DNA, 20 bp, Artificial Sequence
  Description of Artificial Sequence: Synthetic oligonucleotide
  Target: ATXN1; (-) strand; PAM type: NRG; PAM sequence: CAG
aagctgaggagcaaggaagc

SEQ ID NO: 44880 - DNA, 20 bp, Artificial Sequence
  Description of Artificial Sequence: Synthetic oligonucleotide
  Target: ATXN1; (-) strand; PAM type: NRG; PAM sequence: AAG
ctgcaagctgaggagcaagg

SEQ ID NO: 44881 - DNA, 20 bp, Artificial Sequence
  Description of Artificial Sequence: Synthetic oligonucleotide
  Target: ATXN1; (-) strand; PAM type: NRG; PAM sequence: AGG
cacctgcaagctgaggagca

SEQ ID NO: 44882 - DNA, 20 bp, Artificial Sequence
  Description of Artificial Sequence: Synthetic oligonucleotide
  Target: ATXN1; (-) strand; PAM type: NRG; PAM sequence: AAG
ccacctgcaagctgaggagc

SEQ ID NO: 44883 - DNA, 20 bp, Artificial Sequence
  Description of Artificial Sequence: Synthetic oligonucleotide
  Target: ATXN1; (-) strand; PAM type: NRG; PAM sequence: GAG
taggccacctgcaagctgag

SEQ ID NO: 44884 - DNA, 20 bp, Artificial Sequence
  Description of Artificial Sequence: Synthetic oligonucleotide
  Target: ATXN1; (-) strand; PAM type: NRG; PAM sequence: AGG
aataggccacctgcaagctg

SEQ ID NO: 44885 - DNA, 20 bp, Artificial Sequence
  Description of Artificial Sequence: Synthetic oligonucleotide
  Target: ATXN1; (-) strand; PAM type: NRG; PAM sequence: GAG
caataggccacctgcaagct

SEQ ID NO: 44886 - DNA, 20 bp, Artificial Sequence
  Description of Artificial Sequence: Synthetic oligonucleotide
  Target: ATXN1; (-) strand; PAM type: NRG; PAM sequence: AAG
tcctacaataggccacctgc

SEQ ID NO: 44887 - DNA, 20 bp, Artificial Sequence
  Description of Artificial Sequence: Synthetic oligonucleotide
  Target: ATXN1; (-) strand; PAM type: NRG; PAM sequence: AGG
aaaaggtcaagtcctacaat

SEQ ID NO: 44888 - DNA, 20 bp, Artificial Sequence
  Description of Artificial Sequence: Synthetic oligonucleotide
  Target: ATXN1; (-) strand; PAM type: NRG; PAM sequence: TAG
caaaaggtcaagtcctacaa

SEQ ID NO: 44889 - DNA, 20 bp, Artificial Sequence
  Description of Artificial Sequence: Synthetic oligonucleotide
  Target: ATXN1; (-) strand; PAM type: NRG; PAM sequence: AAG
actcacatgatcaaaaggtc

SEQ ID NO: 44890 - DNA, 20 bp, Artificial Sequence
  Description of Artificial Sequence: Synthetic oligonucleotide
  Target: ATXN1; (-) strand; PAM type: NRG; PAM sequence: AGG
tattgactcacatgatcaaa

SEQ ID NO: 44891 - DNA, 20 bp, Artificial Sequence
  Description of Artificial Sequence: Synthetic oligonucleotide
  Target: ATXN1; (-) strand; PAM type: NRG; PAM sequence: AAG
atattgactcacatgatcaa

SEQ ID NO: 44892 - DNA, 20 bp, Artificial Sequence
  Description of Artificial Sequence: Synthetic oligonucleotide
  Target: ATXN1; (-) strand; PAM type: NRG; PAM sequence: AGG
atatgaaggggagtttatta

SEQ ID NO: 44893 - DNA, 20 bp, Artificial Sequence
  Description of Artificial Sequence: Synthetic oligonucleotide
  Target: ATXN1; (-) strand; PAM type: NRG; PAM sequence: AAG
tatatgaaggggagtttatt

SEQ ID NO: 44894 - DNA, 20 bp, Artificial Sequence
  Description of Artificial Sequence: Synthetic oligonucleotide
  Target: ATXN1; (-) strand; PAM type: NRG; PAM sequence: GAG
atagatgtatatatgaaggg

SEQ ID NO: 44895 - DNA, 20 bp, Artificial Sequence
  Description of Artificial Sequence: Synthetic oligonucleotide
  Target: ATXN1; (-) strand; PAM type: NRG; PAM sequence: GGG
ggatagatgtatatatgaag

SEQ ID NO: 44896 - DNA, 20 bp, Artificial Sequence
  Description of Artificial Sequence: Synthetic oligonucleotide
  Target: ATXN1; (-) strand; PAM type: NRG; PAM sequence: GGG
aggatagatgtatatatgaa

SEQ ID NO: 44897 - DNA, 20 bp, Artificial Sequence
  Description of Artificial Sequence: Synthetic oligonucleotide
  Target: ATXN1; (-) strand; PAM type: NRG; PAM sequence: AGG
taggatagatgtatatatga

SEQ ID NO: 44898 - DNA, 20 bp, Artificial Sequence
  Description of Artificial Sequence: Synthetic oligonucleotide
  Target: ATXN1; (-) strand; PAM type: NRG; PAM sequence: AAG
ataggatagatgtatatatg

SEQ ID NO: 44899 - DNA, 20 bp, Artificial Sequence
  Description of Artificial Sequence: Synthetic oligonucleotide
  Target: ATXN1; (-) strand; PAM type: NRG; PAM sequence: TAG
gacagacaggactaatagga

SEQ ID NO: 44900 - DNA, 20 bp, Artificial Sequence
  Description of Artificial Sequence: Synthetic oligonucleotide
  Target: ATXN1; (-) strand; PAM type: NRG; PAM sequence: AGG
tctagacagacaggactaat

SEQ ID NO: 44901 - DNA, 20 bp, Artificial Sequence
  Description of Artificial Sequence: Synthetic oligonucleotide
  Target: ATXN1; (-) strand; PAM type: NRG; PAM sequence: TAG
ctctagacagacaggactaa

SEQ ID NO: 44902 - DNA, 20 bp, Artificial Sequence
  Description of Artificial Sequence: Synthetic oligonucleotide
  Target: ATXN1; (-) strand; PAM type: NRG; PAM sequence: AGG
tcagggttctctagacagac

SEQ ID NO: 44903 - DNA, 20 bp, Artificial Sequence
  Description of Artificial Sequence: Synthetic oligonucleotide
  Target: ATXN1; (-) strand; PAM type: NRG; PAM sequence: CAG
gtcagggttctctagacaga

SEQ ID NO: 44904 - DNA, 20 bp, Artificial Sequence
  Description of Artificial Sequence: Synthetic oligonucleotide
  Target: ATXN1; (-) strand; PAM type: NRG; PAM sequence: CAG
attagtcagggttctctaga

SEQ ID NO: 44905 - DNA, 20 bp, Artificial Sequence
  Description of Artificial Sequence: Synthetic oligonucleotide
  Target: ATXN1; (-) strand; PAM type: NRG; PAM sequence: TAG
ctgtattagtcagggttctc

SEQ ID NO: 44906 - DNA, 20 bp, Artificial Sequence
  Description of Artificial Sequence: Synthetic oligonucleotide
  Target: ATXN1; (-) strand; PAM type: NRG; PAM sequence: GGG
gggacccactgtattagtca

SEQ ID NO: 44907 - DNA, 20 bp, Artificial Sequence
  Description of Artificial Sequence: Synthetic oligonucleotide
  Target: ATXN1; (-) strand; PAM type: NRG; PAM sequence: AGG
ggggacccactgtattagtc

SEQ ID NO: 44908 - DNA, 20 bp, Artificial Sequence
  Description of Artificial Sequence: Synthetic oligonucleotide
  Target: ATXN1; (-) strand; PAM type: NRG; PAM sequence: CAG
aggggacccactgtattagt

SEQ ID NO: 44909 - DNA, 20 bp, Artificial Sequence
  Description of Artificial Sequence: Synthetic oligonucleotide
  Target: ATXN1; (-) strand; PAM type: NRG; PAM sequence: TAG
agttaggggacccactgtat

SEQ ID NO: 44910 - DNA, 20 bp, Artificial Sequence
  Description of Artificial Sequence: Synthetic oligonucleotide
  Target: ATXN1; (-) strand; PAM type: NRG; PAM sequence: GGG
cctaaggaagtagcagttag

SEQ ID NO: 44911 - DNA, 20 bp, Artificial Sequence
  Description of Artificial Sequence: Synthetic oligonucleotide
  Target: ATXN1; (-) strand; PAM type: NRG; PAM sequence: GGG
gcctaaggaagtagcagtta

SEQ ID NO: 44912 - DNA, 20 bp, Artificial Sequence
  Description of Artificial Sequence: Synthetic oligonucleotide
  Target: ATXN1; (-) strand; PAM type: NRG; PAM sequence: AGG
tgcctaaggaagtagcagtt

SEQ ID NO: 44913 - DNA, 20 bp, Artificial Sequence
  Description of Artificial Sequence: Synthetic oligonucleotide
  Target: ATXN1; (-) strand; PAM type: NRG; PAM sequence: TAG
ttgcctaaggaagtagcagt

SEQ ID NO: 44914 - DNA, 20 bp, Artificial Sequence
  Description of Artificial Sequence: Synthetic oligonucleotide
  Target: ATXN1; (-) strand; PAM type: NRG; PAM sequence: CAG
atgattgcctaaggaagtag

SEQ ID NO: 44915 - DNA, 20 bp, Artificial Sequence
  Description of Artificial Sequence: Synthetic oligonucleotide
  Target: ATXN1; (-) strand; PAM type: NRG; PAM sequence: TAG
ggaatgattgcctaaggaag

SEQ ID NO: 44916 - DNA, 20 bp, Artificial Sequence
  Description of Artificial Sequence: Synthetic oligonucleotide
  Target: ATXN1; (-) strand; PAM type: NRG; PAM sequence: AAG
ttaggaatgattgcctaagg

SEQ ID NO: 44917 - DNA, 20 bp, Artificial Sequence
  Description of Artificial Sequence: Synthetic oligonucleotide
  Target: ATXN1; (-) strand; PAM type: NRG; PAM sequence: AGG
agtttaggaatgattgccta

SEQ ID NO: 44918 - DNA, 20 bp, Artificial Sequence
  Description of Artificial Sequence: Synthetic oligonucleotide
  Target: ATXN1; (-) strand; PAM type: NRG; PAM sequence: AAG
gagtttaggaatgattgcct

SEQ ID NO: 44919 - DNA, 20 bp, Artificial Sequence
  Description of Artificial Sequence: Synthetic oligonucleotide
  Target: ATXN1; (-) strand; PAM type: NRG; PAM sequence: AGG
agtggctttgctgagagttt

SEQ ID NO: 44920 - DNA, 20 bp, Artificial Sequence
  Description of Artificial Sequence: Synthetic oligonucleotide
  Target: ATXN1; (-) strand; PAM type: NRG; PAM sequence: TAG
aagtggctttgctgagagtt

SEQ ID NO: 44921 - DNA, 20 bp, Artificial Sequence
  Description of Artificial Sequence: Synthetic oligonucleotide
  Target: ATXN1; (-) strand; PAM type: NRG; PAM sequence: GAG
gccggaagtggctttgctga

SEQ ID NO: 44922 - DNA, 20 bp, Artificial Sequence
  Description of Artificial Sequence: Synthetic oligonucleotide
  Target: ATXN1; (-) strand; PAM type: NRG; PAM sequence: GAG
cagccggaagtggctttgct

SEQ ID NO: 44923 - DNA, 20 bp, Artificial Sequence
  Description of Artificial Sequence: Synthetic oligonucleotide
  Target: ATXN1; (-) strand; PAM type: NRG; PAM sequence: TGG
aggattgcagcagccggaag

SEQ ID NO: 44924 - DNA, 20 bp, Artificial Sequence
  Description of Artificial Sequence: Synthetic oligonucleotide
  Target: ATXN1; (-) strand; PAM type: NRG; PAM sequence: AAG
acaaggattgcagcagccgg

SEQ ID NO: 44925 - DNA, 20 bp, Artificial Sequence
  Description of Artificial Sequence: Synthetic oligonucleotide
  Target: ATXN1; (-) strand; PAM type: NRG; PAM sequence: CGG
aaaacaaggattgcagcagc

SEQ ID NO: 44926 - DNA, 20 bp, Artificial Sequence
  Description of Artificial Sequence: Synthetic oligonucleotide
  Target: ATXN1; (-) strand; PAM type: NRG; PAM sequence: CAG
cgtgaaaacaaggattgcag

SEQ ID NO: 44927 - DNA, 20 bp, Artificial Sequence
  Description of Artificial Sequence: Synthetic oligonucleotide
  Target: ATXN1; (-) strand; PAM type: NRG; PAM sequence: CAG
acacgtgaaaacaaggattg

SEQ ID NO: 44928 - DNA, 20 bp, Artificial Sequence
  Description of Artificial Sequence: Synthetic oligonucleotide
  Target: ATXN1; (-) strand; PAM type: NRG; PAM sequence: AGG
gacgaaaacacgtgaaaaca

SEQ ID NO: 44929 - DNA, 20 bp, Artificial Sequence
  Description of Artificial Sequence: Synthetic oligonucleotide
  Target: ATXN1; (-) strand; PAM type: NRG; PAM sequence: AAG
tgacgaaaacacgtgaaaac

SEQ ID NO: 44930 - DNA, 20 bp, Artificial Sequence
  Description of Artificial Sequence: Synthetic oligonucleotide
  Target: ATXN1; (-) strand; PAM type: NRG; PAM sequence: CGG
ctaagcagcatcggagttta

SEQ ID NO: 44931 - DNA, 20 bp, Artificial Sequence
  Description of Artificial Sequence: Synthetic oligonucleotide
  Target: ATXN1; (-) strand; PAM type: NRG; PAM sequence: GAG
tcagtctctaagcagcatcg

SEQ ID NO: 44932 - DNA, 20 bp, Artificial Sequence
  Description of Artificial Sequence: Synthetic oligonucleotide
  Target: ATXN1; (-) strand; PAM type: NRG; PAM sequence: CGG
cttcagtctctaagcagcat

SEQ ID NO: 44933 - DNA, 20 bp, Artificial Sequence
  Description of Artificial Sequence: Synthetic oligonucleotide
  Target: ATXN1; (-) strand; PAM type: NRG; PAM sequence: CAG
tgtgaacttcagtctctaag

SEQ ID NO: 44934 - DNA, 20 bp, Artificial Sequence
  Description of Artificial Sequence: Synthetic oligonucleotide
  Target: ATXN1; (-) strand; PAM type: NRG; PAM sequence: AAG
ggttgtgaacttcagtctct

SEQ ID NO: 44935 - DNA, 20 bp, Artificial Sequence
  Description of Artificial Sequence: Synthetic oligonucleotide
  Target: ATXN1; (-) strand; PAM type: NRG; PAM sequence: CAG
acccaaggggttgtgaactt

SEQ ID NO: 44936 - DNA, 20 bp, Artificial Sequence
  Description of Artificial Sequence: Synthetic oligonucleotide
  Target: ATXN1; (-) strand; PAM type: NRG; PAM sequence: GGG
cagcaccctagaaacccaag

SEQ ID NO: 44937 - DNA, 20 bp, Artificial Sequence
  Description of Artificial Sequence: Synthetic oligonucleotide
  Target: ATXN1; (-) strand; PAM type: NRG; PAM sequence: GGG
acagcaccctagaaacccaa

SEQ ID NO: 44938 - DNA, 20 bp, Artificial Sequence
  Description of Artificial Sequence: Synthetic oligonucleotide
  Target: ATXN1; (-) strand; PAM type: NRG; PAM sequence: AGG
gacagcaccctagaaaccca

SEQ ID NO: 44939 - DNA, 20 bp, Artificial Sequence
  Description of Artificial Sequence: Synthetic oligonucleotide
  Target: ATXN1; (-) strand; PAM type: NRG; PAM sequence: AAG
ggacagcaccctagaaaccc

SEQ ID NO: 44940 - DNA, 20 bp, Artificial Sequence
  Description of Artificial Sequence: Synthetic oligonucleotide
  Target: ATXN1; (-) strand; PAM type: NRG; PAM sequence: TAG
accaaggacggacagcaccc

SEQ ID NO: 44941 - DNA, 20 bp, Artificial Sequence
  Description of Artificial Sequence: Synthetic oligonucleotide
  Target: ATXN1; (-) strand; PAM type: NRG; PAM sequence: CAG
agtaaccaaccaaggacgga

SEQ ID NO: 44942 - DNA, 20 bp, Artificial Sequence
  Description of Artificial Sequence: Synthetic oligonucleotide
  Target: ATXN1; (-) strand; PAM type: NRG; PAM sequence: CGG
gaacagtaaccaaccaagga

SEQ ID NO: 44943 - DNA, 20 bp, Artificial Sequence
  Description of Artificial Sequence: Synthetic oligonucleotide
  Target: ATXN1; (-) strand; PAM type: NRG; PAM sequence: AGG
ataagaacagtaaccaacca

SEQ ID NO: 44944 - DNA, 20 bp, Artificial Sequence
  Description of Artificial Sequence: Synthetic oligonucleotide
  Target: ATXN1; (-) strand; PAM type: NRG; PAM sequence: AAG
gataagaacagtaaccaacc

SEQ ID NO: 44945 - DNA, 20 bp, Artificial Sequence
  Description of Artificial Sequence: Synthetic oligonucleotide
  Target: ATXN1; (-) strand; PAM type: NRG; PAM sequence: CAG
agatggacacaagataagaa

SEQ ID NO: 44946 - DNA, 20 bp, Artificial Sequence
  Description of Artificial Sequence: Synthetic oligonucleotide
  Target: ATXN1; (-) strand; PAM type: NRG; PAM sequence: AAG
gcaagagatggacacaagat

SEQ ID NO: 44947 - DNA, 20 bp, Artificial Sequence
  Description of Artificial Sequence: Synthetic oligonucleotide
  Target: ATXN1; (-) strand; PAM type: NRG; PAM sequence: AAG
aaactgcaagagatggacac

SEQ ID NO: 44948 - DNA, 20 bp, Artificial Sequence
  Description of Artificial Sequence: Synthetic oligonucleotide
  Target: ATXN1; (-) strand; PAM type: NRG; PAM sequence: TGG
ggaagacaaactgcaagaga

SEQ ID NO: 44949 - DNA, 20 bp, Artificial Sequence
  Description of Artificial Sequence: Synthetic oligonucleotide
  Target: ATXN1; (-) strand; PAM type: NRG; PAM sequence: GAG
gtaaggaagacaaactgcaa

SEQ ID NO: 44950 - DNA, 20 bp, Artificial Sequence
  Description of Artificial Sequence: Synthetic oligonucleotide
  Target: ATXN1; (-) strand; PAM type: NRG; PAM sequence: AAG
ttgtaaggaagacaaactgc

SEQ ID NO: 44951 - DNA, 20 bp, Artificial Sequence
  Description of Artificial Sequence: Synthetic oligonucleotide
  Target: ATXN1; (-) strand; PAM type: NRG; PAM sequence: AAG
ttaataaccagcttgtaagg

SEQ ID NO: 44952 - DNA, 20 bp, Artificial Sequence
  Description of Artificial Sequence: Synthetic oligonucleotide
  Target: ATXN1; (-) strand; PAM type: NRG; PAM sequence: AGG
cttttaataaccagcttgta

SEQ ID NO: 44953 - DNA, 20 bp, Artificial Sequence
  Description of Artificial Sequence: Synthetic oligonucleotide
  Target: ATXN1; (-) strand; PAM type: NRG; PAM sequence: AAG
ccttttaataaccagcttgt

SEQ ID NO: 44954 - DNA, 20 bp, Artificial Sequence
  Description of Artificial Sequence: Synthetic oligonucleotide
  Target: ATXN1; (-) strand; PAM type: NRG; PAM sequence: CAG
atcctttgccttttaataac

SEQ ID NO: 44955 - DNA, 20 bp, Artificial Sequence
  Description of Artificial Sequence: Synthetic oligonucleotide
  Target: ATXN1; (-) strand; PAM type: NRG; PAM sequence: CAG
ccaaaatctagaaaatgatc

SEQ ID NO: 44956 - DNA, 20 bp, Artificial Sequence
  Description of Artificial Sequence: Synthetic oligonucleotide
  Target: ATXN1; (-) strand; PAM type: NRG; PAM sequence: TAG
ttatcatcacatccaaaatc

SEQ ID NO: 44957 - DNA, 20 bp, Artificial Sequence
  Description of Artificial Sequence: Synthetic oligonucleotide
  Target: ATXN1; (-) strand; PAM type: NRG; PAM sequence: CAG
atgtccctccgtaatgagtt

SEQ ID NO: 44958 - DNA, 20 bp, Artificial Sequence
  Description of Artificial Sequence: Synthetic oligonucleotide
  Target: ATXN1; (-) strand; PAM type: NRG; PAM sequence: GAG
attttatgtccctccgtaat

SEQ ID NO: 44959 - DNA, 20 bp, Artificial Sequence
  Description of Artificial Sequence: Synthetic oligonucleotide
  Target: ATXN1; (-) strand; PAM type: NRG; PAM sequence: CAG
ctcaaggggcagattctttg

SEQ ID NO: 44960 - DNA, 20 bp, Artificial Sequence
  Description of Artificial Sequence: Synthetic oligonucleotide
  Target: ATXN1; (-) strand; PAM type: NRG; PAM sequence: CAG
tgaaatggaatctcaagggg

SEQ ID NO: 44961 - DNA, 20 bp, Artificial Sequence
  Description of Artificial Sequence: Synthetic oligonucleotide
  Target: ATXN1; (-) strand; PAM type: NRG; PAM sequence: GGG
gtttgaaatggaatctcaag

SEQ ID NO: 44962 - DNA, 20 bp, Artificial Sequence
  Description of Artificial Sequence: Synthetic oligonucleotide
  Target: ATXN1; (-) strand; PAM type: NRG; PAM sequence: GGG
tgtttgaaatggaatctcaa

SEQ ID NO: 44963 - DNA, 20 bp, Artificial Sequence
  Description of Artificial Sequence: Synthetic oligonucleotide
  Target: ATXN1; (-) strand; PAM type: NRG; PAM sequence: AGG
atgtttgaaatggaatctca

SEQ ID NO: 44964 - DNA, 20 bp, Artificial Sequence
  Description of Artificial Sequence: Synthetic oligonucleotide
  Target: ATXN1; (-) strand; PAM type: NRG; PAM sequence: AAG
tatgtttgaaatggaatctc

SEQ ID NO: 44965 - DNA, 20 bp, Artificial Sequence
  Description of Artificial Sequence: Synthetic oligonucleotide
  Target: ATXN1; (-) strand; PAM type: NRG; PAM sequence: TGG
gtgagaaagtatgtttgaaa

SEQ ID NO: 44966 - DNA, 20 bp, Artificial Sequence
  Description of Artificial Sequence: Synthetic oligonucleotide
  Target: ATXN1; (-) strand; PAM type: NRG; PAM sequence: AAG
gttaataatctcacgtgaga

SEQ ID NO: 44967 - DNA, 20 bp, Artificial Sequence
  Description of Artificial Sequence: Synthetic oligonucleotide
  Target: ATXN1; (-) strand; PAM type: NRG; PAM sequence: GAG
aggagttaataatctcacgt

SEQ ID NO: 44968 - DNA, 20 bp, Artificial Sequence
  Description of Artificial Sequence: Synthetic oligonucleotide
  Target: ATXN1; (-) strand; PAM type: NRG; PAM sequence: GAG
cctgacccgagaagtaacag

SEQ ID NO: 44969 - DNA, 20 bp, Artificial Sequence
  Description of Artificial Sequence: Synthetic oligonucleotide
  Target: ATXN1; (-) strand; PAM type: NRG; PAM sequence: AGG
ttcctgacccgagaagtaac

SEQ ID NO: 44970 - DNA, 20 bp, Artificial Sequence
  Description of Artificial Sequence: Synthetic oligonucleotide
  Target: ATXN1; (-) strand; PAM type: NRG; PAM sequence: CAG
cttcctgacccgagaagtaa

SEQ ID NO: 44971 - DNA, 20 bp, Artificial Sequence
  Description of Artificial Sequence: Synthetic oligonucleotide
  Target: ATXN1; (-) strand; PAM type: NRG; PAM sequence: AAG
cttgtacttcctgacccgag

SEQ ID NO: 44972 - DNA, 20 bp, Artificial Sequence
  Description of Artificial Sequence: Synthetic oligonucleotide
  Target: ATXN1; (-) strand; PAM type: NRG; PAM sequence: GAG
atacttgtacttcctgaccc

SEQ ID NO: 44973 - DNA, 20 bp, Artificial Sequence
  Description of Artificial Sequence: Synthetic oligonucleotide
  Target: ATXN1; (-) strand; PAM type: NRG; PAM sequence: AAG
tagaggccttcccatatagc

SEQ ID NO: 44974 - DNA, 20 bp, Artificial Sequence
  Description of Artificial Sequence: Synthetic oligonucleotide
  Target: ATXN1; (-) strand; PAM type: NRG; PAM sequence: TAG
tgtttagaggccttcccata

SEQ ID NO: 44975 - DNA, 20 bp, Artificial Sequence
  Description of Artificial Sequence: Synthetic oligonucleotide
  Target: ATXN1; (-) strand; PAM type: NRG; PAM sequence: AGG
aattggatatgaatgtttag

SEQ ID NO: 44976 - DNA, 20 bp, Artificial Sequence
  Description of Artificial Sequence: Synthetic oligonucleotide
  Target: ATXN1; (-) strand; PAM type: NRG; PAM sequence: GAG
taattggatatgaatgttta

SEQ ID NO: 44977 - DNA, 20 bp, Artificial Sequence
  Description of Artificial Sequence: Synthetic oligonucleotide
  Target: ATXN1; (-) strand; PAM type: NRG; PAM sequence: TAG
gataattggatatgaatgtt

SEQ ID NO: 44978 - DNA, 20 bp, Artificial Sequence
  Description of Artificial Sequence: Synthetic oligonucleotide
  Target: ATXN1; (-) strand; PAM type: NRG; PAM sequence: TGG
tttaattagttttggataat

SEQ ID NO: 44979 - DNA, 20 bp, Artificial Sequence
  Description of Artificial Sequence: Synthetic oligonucleotide
  Target: ATXN1; (-) strand; PAM type: NRG; PAM sequence: TGG
agacaatctttaattagttt

SEQ ID NO: 44980 - DNA, 20 bp, Artificial Sequence
  Description of Artificial Sequence: Synthetic oligonucleotide
  Target: ATXN1; (-) strand; PAM type: NRG; PAM sequence: TAG
agcctaagacaatctttaat

SEQ ID NO: 44981 - DNA, 20 bp, Artificial Sequence
  Description of Artificial Sequence: Synthetic oligonucleotide
  Target: ATXN1; (-) strand; PAM type: NRG; PAM sequence: AAG
gtttccttgagattgagcct

SEQ ID NO: 44982 - DNA, 20 bp, Artificial Sequence
  Description of Artificial Sequence: Synthetic oligonucleotide
  Target: ATXN1; (-) strand; PAM type: NRG; PAM sequence: GAG
cgaggtgtttccttgagatt

SEQ ID NO: 44983 - DNA, 20 bp, Artificial Sequence
  Description of Artificial Sequence: Synthetic oligonucleotide
  Target: ATXN1; (-) strand; PAM type: NRG; PAM sequence: GAG
gactaccgaggtgtttcctt

SEQ ID NO: 44984 - DNA, 20 bp, Artificial Sequence
  Description of Artificial Sequence: Synthetic oligonucleotide
  Target: ATXN1; (-) strand; PAM type: NRG; PAM sequence: AGG
agtaaatccagagactaccg

SEQ ID NO: 44985 - DNA, 20 bp, Artificial Sequence
  Description of Artificial Sequence: Synthetic oligonucleotide
  Target: ATXN1; (-) strand; PAM type: NRG; PAM sequence: GAG
cagtaaatccagagactacc

SEQ ID NO: 44986 - DNA, 20 bp, Artificial Sequence
  Description of Artificial Sequence: Synthetic oligonucleotide
  Target: ATXN1; (-) strand; PAM type: NRG; PAM sequence: GAG
cacctcttccagtaaatcca

SEQ ID NO: 44987 - DNA, 20 bp, Artificial Sequence
  Description of Artificial Sequence: Synthetic oligonucleotide
  Target: ATXN1; (-) strand; PAM type: NRG; PAM sequence: CAG
cacacctcttccagtaaatc

SEQ ID NO: 44988 - DNA, 20 bp, Artificial Sequence
  Description of Artificial Sequence: Synthetic oligonucleotide
  Target: ATXN1; (-) strand; PAM type: NRG; PAM sequence: CAG
ttgtaaatacacacctcttc

SEQ ID NO: 44989 - DNA, 20 bp, Artificial Sequence
  Description of Artificial Sequence: Synthetic oligonucleotide
  Target: ATXN1; (-) strand; PAM type: NRG; PAM sequence: TGG
ttcctacgattgatttaggc

SEQ ID NO: 44990 - DNA, 20 bp, Artificial Sequence
  Description of Artificial Sequence: Synthetic oligonucleotide
  Target: ATXN1; (-) strand; PAM type: NRG; PAM sequence: AGG
gtccttcctacgattgattt

SEQ ID NO: 44991 - DNA, 20 bp, Artificial Sequence
  Description of Artificial Sequence: Synthetic oligonucleotide
  Target: ATXN1; (-) strand; PAM type: NRG; PAM sequence: TAG
tgtccttcctacgattgatt

SEQ ID NO: 44992 - DNA, 20 bp, Artificial Sequence
  Description of Artificial Sequence: Synthetic oligonucleotide
  Target: ATXN1; (-) strand; PAM type: NRG; PAM sequence: CAG
cttatcttggccgatgtgta

SEQ ID NO: 44993 - DNA, 20 bp, Artificial Sequence
  Description of Artificial Sequence: Synthetic oligonucleotide
  Target: ATXN1; (-) strand; PAM type: NRG; PAM sequence: TGG
tgcagagagaattcttatct

SEQ ID NO: 44994 - DNA, 20 bp, Artificial Sequence
  Description of Artificial Sequence: Synthetic oligonucleotide
  Target: ATXN1; (-) strand; PAM type: NRG; PAM sequence: GAG
aaacaaacatttattgcaga

SEQ ID NO: 44995 - DNA, 20 bp, Artificial Sequence
  Description of Artificial Sequence: Synthetic oligonucleotide
  Target: ATXN1; (-) strand; PAM type: NRG; PAM sequence: GAG
taaaacaaacatttattgca

SEQ ID NO: 44996 - DNA, 20 bp, Artificial Sequence
  Description of Artificial Sequence: Synthetic oligonucleotide
  Target: ATXN1; (-) strand; PAM type: NRG; PAM sequence: CAG
tttaaaacaaacatttattg

SEQ ID NO: 44997 - DNA, 20 bp, Artificial Sequence
  Description of Artificial Sequence: Synthetic oligonucleotide
  Target: ATXN1; (-) strand; PAM type: NRG; PAM sequence: GAG
gccacccattcaccgagtgt

SEQ ID NO: 44998 - DNA, 20 bp, Artificial Sequence
  Description of Artificial Sequence: Synthetic oligonucleotide
  Target: ATXN1; (-) strand; PAM type: NRG; PAM sequence: GAG
aagtcagccacccattcacc

SEQ ID NO: 44999 - DNA, 20 bp, Artificial Sequence
  Description of Artificial Sequence: Synthetic oligonucleotide
  Target: ATXN1; (-) strand; PAM type: NRG; PAM sequence: CAG
atcttttgagggtcagaagt

SEQ ID NO: 45000 - DNA, 20 bp, Artificial Sequence
  Description of Artificial Sequence: Synthetic oligonucleotide
  Target: ATXN1; (-) strand; PAM type: NRG; PAM sequence: AAG
attcatcttttgagggtcag

SEQ ID NO: 45001 - DNA, 20 bp, Artificial Sequence
  Description of Artificial Sequence: Synthetic oligonucleotide
  Target: ATXN1; (-) strand; PAM type: NRG; PAM sequence: CAG
gccattcatcttttgagggt

SEQ ID NO: 45002 - DNA, 20 bp, Artificial Sequence
  Description of Artificial Sequence: Synthetic oligonucleotide
  Target: ATXN1; (-) strand; PAM type: NRG; PAM sequence: GGG
atgagccattcatcttttga

SEQ ID NO: 45003 - DNA, 20 bp, Artificial Sequence
  Description of Artificial Sequence: Synthetic oligonucleotide
  Target: ATXN1; (-) strand; PAM type: NRG; PAM sequence: AGG
aatgagccattcatcttttg

SEQ ID NO: 45004 - DNA, 20 bp, Artificial Sequence
  Description of Artificial Sequence: Synthetic oligonucleotide
  Target: ATXN1; (-) strand; PAM type: NRG; PAM sequence: GAG
aaatgagccattcatctttt

SEQ ID NO: 45005 - DNA, 20 bp, Artificial Sequence
  Description of Artificial Sequence: Synthetic oligonucleotide
  Target: ATXN1; (-) strand; PAM type: NRG; PAM sequence: GAG
cttgctgggcttttcaaaat

SEQ ID NO: 45006 - DNA, 20 bp, Artificial Sequence
  Description of Artificial Sequence: Synthetic oligonucleotide
  Target: ATXN1; (-) strand; PAM type: NRG; PAM sequence: GGG
aagtaggcttcccacttgct

SEQ ID NO: 45007 - DNA, 20 bp, Artificial Sequence
  Description of Artificial Sequence: Synthetic oligonucleotide
  Target: ATXN1; (-) strand; PAM type: NRG; PAM sequence: TGG
aaagtaggcttcccacttgc

SEQ ID NO: 45008 - DNA, 20 bp, Artificial Sequence
  Description of Artificial Sequence: Synthetic oligonucleotide
  Target: ATXN1; (-) strand; PAM type: NRG; PAM sequence: AGG
agtcagtggaggtagaaagt

SEQ ID NO: 45009 - DNA, 20 bp, Artificial Sequence
  Description of Artificial Sequence: Synthetic oligonucleotide
  Target: ATXN1; (-) strand; PAM type: NRG; PAM sequence: TAG
aagtcagtggaggtagaaag

SEQ ID NO: 45010 - DNA, 20 bp, Artificial Sequence
  Description of Artificial Sequence: Synthetic oligonucleotide
  Target: ATXN1; (-) strand; PAM type: NRG; PAM sequence: AAG
ctgaagtcagtggaggtaga

SEQ ID NO: 45011 - DNA, 20 bp, Artificial Sequence
  Description of Artificial Sequence: Synthetic oligonucleotide
  Target: ATXN1; (-) strand; PAM type: NRG; PAM sequence: TAG
cattctgaagtcagtggagg

SEQ ID NO: 45012 - DNA, 20 bp, Artificial Sequence
  Description of Artificial Sequence: Synthetic oligonucleotide
  Target: ATXN1; (-) strand; PAM type: NRG; PAM sequence: AGG
cctcattctgaagtcagtgg

SEQ ID NO: 45013 - DNA, 20 bp, Artificial Sequence
  Description of Artificial Sequence: Synthetic oligonucleotide
  Target: ATXN1; (-) strand; PAM type: NRG; PAM sequence: GAG
gcctcattctgaagtcagtg

SEQ ID NO: 45014 - DNA, 20 bp, Artificial Sequence
  Description of Artificial Sequence: Synthetic oligonucleotide
  Target: ATXN1; (-) strand; PAM type: NRG; PAM sequence: TGG
cagcctcattctgaagtcag

SEQ ID NO: 45015 - DNA, 20 bp, Artificial Sequence
  Description of Artificial Sequence: Synthetic oligonucleotide
  Target: ATXN1; (-) strand; PAM type: NRG; PAM sequence: CAG
ctgcagcctcattctgaagt

SEQ ID NO: 45016 - DNA, 20 bp, Artificial Sequence
  Description of Artificial Sequence: Synthetic oligonucleotide
  Target: ATXN1; (-) strand; PAM type: NRG; PAM sequence: AAG
tacactgcagcctcattctg

SEQ ID NO: 45017 - DNA, 20 bp, Artificial Sequence
  Description of Artificial Sequence: Synthetic oligonucleotide
  Target: ATXN1; (-) strand; PAM type: NRG; PAM sequence: CAG
tcttgggctccactacactg

SEQ ID NO: 45018 - DNA, 20 bp, Artificial Sequence
  Description of Artificial Sequence: Synthetic oligonucleotide
  Target: ATXN1; (-) strand; PAM type: NRG; PAM sequence: GGG
aaacaactcggggccatctt

SEQ ID NO: 45019 - DNA, 20 bp, Artificial Sequence
  Description of Artificial Sequence: Synthetic oligonucleotide
  Target: ATXN1; (-) strand; PAM type: NRG; PAM sequence: TGG
gaaacaactcggggccatct

SEQ ID NO: 45020 - DNA, 20 bp, Artificial Sequence
  Description of Artificial Sequence: Synthetic oligonucleotide
  Target: ATXN1; (-) strand; PAM type: NRG; PAM sequence: GGG
tagtgactggaaacaactcg

SEQ ID NO: 45021 - DNA, 20 bp, Artificial Sequence
  Description of Artificial Sequence: Synthetic oligonucleotide
  Target: ATXN1; (-) strand; PAM type: NRG; PAM sequence: GGG
ctagtgactggaaacaactc

SEQ ID NO: 45022 - DNA, 20 bp, Artificial Sequence
  Description of Artificial Sequence: Synthetic oligonucleotide
  Target: ATXN1; (-) strand; PAM type: NRG; PAM sequence: CGG
gctagtgactggaaacaact

SEQ ID NO: 45023 - DNA, 20 bp, Artificial Sequence
  Description of Artificial Sequence: Synthetic oligonucleotide
  Target: ATXN1; (-) strand; PAM type: NRG; PAM sequence: TGG
ttgtccatcttgctagtgac

SEQ ID NO: 45024 - DNA, 20 bp, Artificial Sequence
  Description of Artificial Sequence: Synthetic oligonucleotide
  Target: ATXN1; (-) strand; PAM type: NRG; PAM sequence: TAG
catcccattgtccatcttgc

SEQ ID NO: 45025 - DNA, 20 bp, Artificial Sequence
  Description of Artificial Sequence: Synthetic oligonucleotide
  Target: ATXN1; (-) strand; PAM type: NRG; PAM sequence: GAG
tgaaaacagctgcaggtagc

SEQ ID NO: 45026 - DNA, 20 bp, Artificial Sequence
  Description of Artificial Sequence: Synthetic oligonucleotide
  Target: ATXN1; (-) strand; PAM type: NRG; PAM sequence: TAG
ttattgaaaacagctgcagg

SEQ ID NO: 45027 - DNA, 20 bp, Artificial Sequence
  Description of Artificial Sequence: Synthetic oligonucleotide
  Target: ATXN1; (-) strand; PAM type: NRG; PAM sequence: AGG
tttttattgaaaacagctgc

SEQ ID NO: 45028 - DNA, 20 bp, Artificial Sequence
  Description of Artificial Sequence: Synthetic oligonucleotide
  Target: ATXN1; (-) strand; PAM type: NRG; PAM sequence: CAG
ttttttattgaaaacagctg

SEQ ID NO: 45029 - DNA, 20 bp, Artificial Sequence
  Description of Artificial Sequence: Synthetic oligonucleotide
  Target: ATXN1; (-) strand; PAM type: NRG; PAM sequence: CAG
ctcagcttttttattgaaaa

SEQ ID NO: 45030 - DNA, 20 bp, Artificial Sequence
  Description of Artificial Sequence: Synthetic oligonucleotide
  Target: ATXN1; (-) strand; PAM type: NRG; PAM sequence: CAG
gagaggctgctgtaattact

SEQ ID NO: 45031 - DNA, 20 bp, Artificial Sequence
  Description of Artificial Sequence: Synthetic oligonucleotide
  Target: ATXN1; (-) strand; PAM type: NRG; PAM sequence: AGG
ccgcatgtgagccccaggag

SEQ ID NO: 45032 - DNA, 20 bp, Artificial Sequence
  Description of Artificial Sequence: Synthetic oligonucleotide
  Target: ATXN1; (-) strand; PAM type: NRG; PAM sequence: GAG
gccgcatgtgagccccagga

SEQ ID NO: 45033 - DNA, 20 bp, Artificial Sequence
  Description of Artificial Sequence: Synthetic oligonucleotide
  Target: ATXN1; (-) strand; PAM type: NRG; PAM sequence: GAG
gggccgcatgtgagccccag

SEQ ID NO: 45034 - DNA, 20 bp, Artificial Sequence
  Description of Artificial Sequence: Synthetic oligonucleotide
  Target: ATXN1; (-) strand; PAM type: NRG; PAM sequence: AGG
ctgggccgcatgtgagcccc

SEQ ID NO: 45035 - DNA, 20 bp, Artificial Sequence
  Description of Artificial Sequence: Synthetic oligonucleotide
  Target: ATXN1; (-) strand; PAM type: NRG; PAM sequence: CAG
gctgggccgcatgtgagccc

SEQ ID NO: 45036 - DNA, 20 bp, Artificial Sequence
  Description of Artificial Sequence: Synthetic oligonucleotide
  Target: ATXN1; (-) strand; PAM type: NRG; PAM sequence: GAG
ctttgtgctgggccgcatgt

SEQ ID NO: 45037 - DNA, 20 bp, Artificial Sequence
  Description of Artificial Sequence: Synthetic oligonucleotide
  Target: ATXN1; (-) strand; PAM type: NRG; PAM sequence: GGG
tgttccattggctttgtgct

SEQ ID NO: 45038 - DNA, 20 bp, Artificial Sequence
  Description of Artificial Sequence: Synthetic oligonucleotide
  Target: ATXN1; (-) strand; PAM type: NRG; PAM sequence: TGG
atgttccattggctttgtgc

SEQ ID NO: 45039 - DNA, 20 bp, Artificial Sequence
  Description of Artificial Sequence: Synthetic oligonucleotide
  Target: ATXN1; (-) strand; PAM type: NRG; PAM sequence: TGG
cagtgtccttaatgttccat

SEQ ID NO: 45040 - DNA, 20 bp, Artificial Sequence
  Description of Artificial Sequence: Synthetic oligonucleotide
  Target: ATXN1; (-) strand; PAM type: NRG; PAM sequence: CAG
agggcttctggcagctcatt

SEQ ID NO: 45041 - DNA, 20 bp, Artificial Sequence
  Description of Artificial Sequence: Synthetic oligonucleotide
  Target: ATXN1; (-) strand; PAM type: NRG; PAM sequence: CAG
caatgctgaagggcttctgg

SEQ ID NO: 45042 - DNA, 20 bp, Artificial Sequence
  Description of Artificial Sequence: Synthetic oligonucleotide
  Target: ATXN1; (-) strand; PAM type: NRG; PAM sequence: TGG
gcccaatgctgaagggcttc

SEQ ID NO: 45043 - DNA, 20 bp, Artificial Sequence
  Description of Artificial Sequence: Synthetic oligonucleotide
  Target: ATXN1; (-) strand; PAM type: NRG; PAM sequence: GGG
tttggcagcccaatgctgaa

SEQ ID NO: 45044 - DNA, 20 bp, Artificial Sequence
  Description of Artificial Sequence: Synthetic oligonucleotide
  Target: ATXN1; (-) strand; PAM type: NRG; PAM sequence: AGG
gtttggcagcccaatgctga

SEQ ID NO: 45045 - DNA, 20 bp, Artificial Sequence
  Description of Artificial Sequence: Synthetic oligonucleotide
  Target: ATXN1; (-) strand; PAM type: NRG; PAM sequence: AAG
agtttggcagcccaatgctg

SEQ ID NO: 45046 - DNA, 20 bp, Artificial Sequence
  Description of Artificial Sequence: Synthetic oligonucleotide
  Target: ATXN1; (-) strand; PAM type: NRG; PAM sequence: CAG
ggggaggaggagcagtttgg

SEQ ID NO: 45047 - DNA, 20 bp, Artificial Sequence
  Description of Artificial Sequence: Synthetic oligonucleotide
  Target: ATXN1; (-) strand; PAM type: NRG; PAM sequence: TGG
ctgggggaggaggagcagtt

SEQ ID NO: 45048 - DNA, 20 bp, Artificial Sequence
  Description of Artificial Sequence: Synthetic oligonucleotide
  Target: ATXN1; (-) strand; PAM type: NRG; PAM sequence: CAG
ctgagctgggggaggaggag

SEQ ID NO: 45049 - DNA, 20 bp, Artificial Sequence
  Description of Artificial Sequence: Synthetic oligonucleotide
  Target: ATXN1; (-) strand; PAM type: NRG; PAM sequence: GAG
acgctgagctgggggaggag

SEQ ID NO: 45050 - DNA, 20 bp, Artificial Sequence
  Description of Artificial Sequence: Synthetic oligonucleotide
  Target: ATXN1; (-) strand; PAM type: NRG; PAM sequence: AGG
tgacgctgagctgggggagg

SEQ ID NO: 45051 - DNA, 20 bp, Artificial Sequence
  Description of Artificial Sequence: Synthetic oligonucleotide
  Target: ATXN1; (-) strand; PAM type: NRG; PAM sequence: GAG
atgacgctgagctgggggag

SEQ ID NO: 45052 - DNA, 20 bp, Artificial Sequence
  Description of Artificial Sequence: Synthetic oligonucleotide
  Target: ATXN1; (-) strand; PAM type: NRG; PAM sequence: AGG
taatgacgctgagctggggg

SEQ ID NO: 45053 - DNA, 20 bp, Artificial Sequence
  Description of Artificial Sequence: Synthetic oligonucleotide
  Target: ATXN1; (-) strand; PAM type: NRG; PAM sequence: GAG
ttaatgacgctgagctgggg

SEQ ID NO: 45054 - DNA, 20 bp, Artificial Sequence
  Description of Artificial Sequence: Synthetic oligonucleotide
  Target: ATXN1; (-) strand; PAM type: NRG; PAM sequence: GGG
agttaatgacgctgagctgg

SEQ ID NO: 45055 - DNA, 20 bp, Artificial Sequence
  Description of Artificial Sequence: Synthetic oligonucleotide
  Target: ATXN1; (-) strand; PAM type: NRG; PAM sequence: GGG
aagttaatgacgctgagctg

SEQ ID NO: 45056 - DNA, 20 bp, Artificial Sequence
  Description of Artificial Sequence: Synthetic oligonucleotide
  Target: ATXN1; (-) strand; PAM type: NRG; PAM sequence: GGG
taagttaatgacgctgagct

SEQ ID NO: 45057 - DNA, 20 bp, Artificial Sequence
  Description of Artificial Sequence: Synthetic oligonucleotide
  Target: ATXN1; (-) strand; PAM type: NRG; PAM sequence: TGG
ttaagttaatgacgctgagc

SEQ ID NO: 45058 - DNA, 20 bp, Artificial Sequence
  Description of Artificial Sequence: Synthetic oligonucleotide
  Target: ATXN1; (-) strand; PAM type: NRG; PAM sequence: GAG
ctgattaagttaatgacgct

SEQ ID NO: 45059 - DNA, 20 bp, Artificial Sequence
  Description of Artificial Sequence: Synthetic oligonucleotide
  Target: ATXN1; (-) strand; PAM type: NRG; PAM sequence: AAG
tattgaatgaatacctgatt

SEQ ID NO: 45060 - DNA, 20 bp, Artificial Sequence
  Description of Artificial Sequence: Synthetic oligonucleotide
  Target: ATXN1; (-) strand; PAM type: NRG; PAM sequence: GAG
gggtgttgcctacatccagg

SEQ ID NO: 45061 - DNA, 20 bp, Artificial Sequence
  Description of Artificial Sequence: Synthetic oligonucleotide
  Target: ATXN1; (-) strand; PAM type: NRG; PAM sequence: GGG
gagggtgttgcctacatcca

SEQ ID NO: 45062 - DNA, 20 bp, Artificial Sequence
  Description of Artificial Sequence: Synthetic oligonucleotide
  Target: ATXN1; (-) strand; PAM type: NRG; PAM sequence: AGG
agagggtgttgcctacatcc

SEQ ID NO: 45063 - DNA, 20 bp, Artificial Sequence
  Description of Artificial Sequence: Synthetic oligonucleotide
  Target: ATXN1; (-) strand; PAM type: NRG; PAM sequence: CAG
cagagggtgttgcctacatc

SEQ ID NO: 45064 - DNA, 20 bp, Artificial Sequence
  Description of Artificial Sequence: Synthetic oligonucleotide
  Target: ATXN1; (-) strand; PAM type: NRG; PAM sequence: GGG
gacagtgtgcctcattcaga

SEQ ID NO: 45065 - DNA, 20 bp, Artificial Sequence
  Description of Artificial Sequence: Synthetic oligonucleotide
  Target: ATXN1; (-) strand; PAM type: NRG; PAM sequence: AGG
tgacagtgtgcctcattcag

SEQ ID NO: 45066 - DNA, 20 bp, Artificial Sequence
  Description of Artificial Sequence: Synthetic oligonucleotide
  Target: ATXN1; (-) strand; PAM type: NRG; PAM sequence: GAG
ttgacagtgtgcctcattca

SEQ ID NO: 45067 - DNA, 20 bp, Artificial Sequence
  Description of Artificial Sequence: Synthetic oligonucleotide
  Target: ATXN1; (-) strand; PAM type: NRG; PAM sequence: CAG
atttgacagtgtgcctcatt

SEQ ID NO: 45068 - DNA, 20 bp, Artificial Sequence
  Description of Artificial Sequence: Synthetic oligonucleotide
  Target: ATXN1; (-) strand; PAM type: NRG; PAM sequence: CAG
gccggatgcagtcaatttga

SEQ ID NO: 45069 - DNA, 20 bp, Artificial Sequence
  Description of Artificial Sequence: Synthetic oligonucleotide
  Target: ATXN1; (-) strand; PAM type: NRG; PAM sequence: CAG
ctcacacttcctgccggatg

SEQ ID NO: 45070 - DNA, 20 bp, Artificial Sequence
  Description of Artificial Sequence: Synthetic oligonucleotide
  Target: ATXN1; (-) strand; PAM type: NRG; PAM sequence: CGG
accgccctcacacttcctgc

SEQ ID NO: 45071 - DNA, 20 bp, Artificial Sequence
  Description of Artificial Sequence: Synthetic oligonucleotide
  Target: ATXN1; (-) strand; PAM type: NRG; PAM sequence: TAG
aataaataattaaaagaata

SEQ ID NO: 45072 - DNA, 20 bp, Artificial Sequence
  Description of Artificial Sequence: Synthetic oligonucleotide
  Target: ATXN1; (-) strand; PAM type: NRG; PAM sequence: AAG
ataaataaataaataattaa

SEQ ID NO: 45073 - DNA, 20 bp, Artificial Sequence
  Description of Artificial Sequence: Synthetic oligonucleotide
  Target: ATXN1; (-) strand; PAM type: NRG; PAM sequence: TGG
acgtgactgcgctccagctc

SEQ ID NO: 45074 - DNA, 20 bp, Artificial Sequence
  Description of Artificial Sequence: Synthetic oligonucleotide
  Target: ATXN1; (-) strand; PAM type: NRG; PAM sequence: CAG
gggatcacgtgactgcgctc

SEQ ID NO: 45075 - DNA, 20 bp, Artificial Sequence
  Description of Artificial Sequence: Synthetic oligonucleotide
  Target: ATXN1; (-) strand; PAM type: NRG; PAM sequence: GGG
ggcggaggttgcagtgagct

SEQ ID NO: 45076 - DNA, 20 bp, Artificial Sequence
  Description of Artificial Sequence: Synthetic oligonucleotide
  Target: ATXN1; (-) strand; PAM type: NRG; PAM sequence: TGG
aggcggaggttgcagtgagc

SEQ ID NO: 45077 - DNA, 20 bp, Artificial Sequence
  Description of Artificial Sequence: Synthetic oligonucleotide
  Target: ATXN1; (-) strand; PAM type: NRG; PAM sequence: GAG
caggaggcggaggttgcagt

SEQ ID NO: 45078 - DNA, 20 bp, Artificial Sequence
  Description of Artificial Sequence: Synthetic oligonucleotide
  Target: ATXN1; (-) strand; PAM type: NRG; PAM sequence: CAG
aacccaggaggcggaggttg

SEQ ID NO: 45079 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacccaggaggcgg

SEQ ID NO: 45080 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccaggaggcg

SEQ ID NO: 45081 - DNA, 20 bp, Artificial Sequence
  Description of Artificial Sequence: Synthetic oligonucleotide
  Target: ATXN1; (-) strand; PAM type: NRG; PAM sequence: CGG
aatcgcttgaacccaggagg

SEQ ID NO: 45082 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacccagg

SEQ ID NO: 45083 - DNA, 20 bp, Artificial Sequence
  Description of Artificial Sequence: Synthetic oligonucleotide
  Target: ATXN1; (-) strand; PAM type: NRG; PAM sequence: GAG
tgagaatcgcttgaacccag

SEQ ID NO: 45084 - DNA, 20 bp, Artificial Sequence
  Description of Artificial Sequence: Synthetic oligonucleotide
  Target: ATXN1; (-) strand; PAM type: NRG; PAM sequence: AGG
catgagaatcgcttgaaccc

SEQ ID NO: 45085 - DNA, 20 bp, Artificial Sequence
  Description of Artificial Sequence: Synthetic oligonucleotide
  Target: ATXN1; (-) strand; PAM type: NRG; PAM sequence: CAG
gcatgagaatcgcttgaacc

SEQ ID NO: 45086 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggcat

SEQ ID NO: 45087 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 45088 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 45089 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctactcagg

SEQ ID NO: 45090 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctactcag

SEQ ID NO: 45091 - DNA, 20 bp, Artificial Sequence
  Description of Artificial Sequence: Synthetic oligonucleotide
  Target: ATXN1; (-) strand; PAM type: NRG; PAM sequence: AGG
gcctgtaatcccagctactc

SEQ ID NO: 45092 - DNA, 20 bp, Artificial Sequence
  Description of Artificial Sequence: Synthetic oligonucleotide
  Target: ATXN1; (-) strand; PAM type: NRG; PAM sequence: CAG
cgcctgtaatcccagctact

SEQ ID NO: 45093 - DNA, 20 bp, Artificial Sequence
  Description of Artificial Sequence: Synthetic oligonucleotide
  Target: ATXN1; (-) strand; PAM type: NRG; PAM sequence: CAG
gtggcaggcgcctgtaatcc

SEQ ID NO: 45094 - DNA, 20 bp, Artificial Sequence
  Description of Artificial Sequence: Synthetic oligonucleotide
  Target: ATXN1; (-) strand; PAM type: NRG; PAM sequence: AGG
aactagccaggcatggtggc

SEQ ID NO: 45095 - DNA, 20 bp, Artificial Sequence
  Description of Artificial Sequence: Synthetic oligonucleotide
  Target: ATXN1; (-) strand; PAM type: NRG; PAM sequence: CAG
aaactagccaggcatggtgg

SEQ ID NO: 45096 - DNA, 20 bp, Artificial Sequence
  Description of Artificial Sequence: Synthetic oligonucleotide
  Target: ATXN1; (-) strand; PAM type: NRG; PAM sequence: TGG
caaaaactagccaggcatgg

SEQ ID NO: 45097 - DNA, 20 bp, Artificial Sequence
  Description of Artificial Sequence: Synthetic oligonucleotide
  Target: ATXN1; (-) strand; PAM type: NRG; PAM sequence: TGG
gtacaaaaactagccaggca

SEQ ID NO: 45098 - DNA, 20 bp, Artificial Sequence
  Description of Artificial Sequence: Synthetic oligonucleotide
  Target: ATXN1; (-) strand; PAM type: NRG; PAM sequence: AGG
aaaaagtacaaaaactagcc

SEQ ID NO: 45099 - DNA, 20 bp, Artificial Sequence
  Description of Artificial Sequence: Synthetic oligonucleotide
  Target: ATXN1; (-) strand; PAM type: NRG; PAM sequence: CAG
aaaaaagtacaaaaactagc

SEQ ID NO: 45100 - DNA, 20 bp, Artificial Sequence
  Description of Artificial Sequence: Synthetic oligonucleotide
  Target: ATXN1; (-) strand; PAM type: NRG; PAM sequence: TAG
tctgaaaaaagtacaaaaac

SEQ ID NO: 45101 - DNA, 20 bp, Artificial Sequence
  Description of Artificial Sequence: Synthetic oligonucleotide
  Target: ATXN1; (-) strand; PAM type: NRG; PAM sequence: AAG
gatataaccctgtctgaaaa

SEQ ID NO: 45102 - DNA, 20 bp, Artificial Sequence
  Description of Artificial Sequence: Synthetic oligonucleotide
  Target: ATXN1; (-) strand; PAM type: NRG; PAM sequence: TGG
tcaggagtttgagaccagcc

SEQ ID NO: 45103 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagtttgagac

SEQ ID NO: 45104 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttt

SEQ ID NO: 45105 - DNA, 20 bp, Artificial Sequence
  Description of Artificial Sequence: Synthetic oligonucleotide
  Target: ATXN1; (-) strand; PAM type: NRG; PAM sequence: GAG
ggcggatcacctgaggtcag

SEQ ID NO: 45106 - DNA, 20 bp, Artificial Sequence
  Description of Artificial Sequence: Synthetic oligonucleotide
  Target: ATXN1; (-) strand; PAM type: NRG; PAM sequence: AGG
tgggcggatcacctgaggtc

SEQ ID NO: 45107 - DNA, 20 bp, Artificial Sequence
  Description of Artificial Sequence: Synthetic oligonucleotide
  Target: ATXN1; (-) strand; PAM type: NRG; PAM sequence: CAG
atgggcggatcacctgaggt

SEQ ID NO: 45108 - DNA, 20 bp, Artificial Sequence
  Description of Artificial Sequence: Synthetic oligonucleotide
  Target: ATXN1; (-) strand; PAM type: NRG; PAM sequence: AGG
cgagatgggcggatcacctg

SEQ ID NO: 45109 - DNA, 20 bp, Artificial Sequence
  Description of Artificial Sequence: Synthetic oligonucleotide
  Target: ATXN1; (-) strand; PAM type: NRG; PAM sequence: GAG
ccgagatgggcggatcacct

SEQ ID NO: 45110 - DNA, 20 bp, Artificial Sequence
  Description of Artificial Sequence: Synthetic oligonucleotide
  Target: ATXN1; (-) strand; PAM type: NRG; PAM sequence: CGG
ctttgggaggccgagatggg

SEQ ID NO: 45111 - DNA, 20 bp, Artificial Sequence
  Description of Artificial Sequence: Synthetic oligonucleotide
  Target: ATXN1; (-) strand; PAM type: NRG; PAM sequence: GGG
ccactttgggaggccgagat

SEQ ID NO: 45112 - DNA, 20 bp, Artificial Sequence
  Description of Artificial Sequence: Synthetic oligonucleotide
  Target: ATXN1; (-) strand; PAM type: NRG; PAM sequence: TGG
cccactttgggaggccgaga

SEQ ID NO: 45113 - DNA, 20 bp, Artificial Sequence
  Description of Artificial Sequence: Synthetic oligonucleotide
  Target: ATXN1; (-) strand; PAM type: NRG; PAM sequence: GAG
cactcccactttgggaggcc

SEQ ID NO: 45114 - DNA, 20 bp, Artificial Sequence
  Description of Artificial Sequence: Synthetic oligonucleotide
  Target: ATXN1; (-) strand; PAM type: NRG; PAM sequence: AGG
tggctcactcccactttggg

SEQ ID NO: 45115 - DNA, 20 bp, Artificial Sequence
  Description of Artificial Sequence: Synthetic oligonucleotide
  Target: ATXN1; (-) strand; PAM type: NRG; PAM sequence: GAG
gtggctcactcccactttgg

SEQ ID NO: 45116 - DNA, 20 bp, Artificial Sequence
  Description of Artificial Sequence: Synthetic oligonucleotide
  Target: ATXN1; (-) strand; PAM type: NRG; PAM sequence: GGG
cggtggctcactcccacttt

SEQ ID NO: 45117 - DNA, 20 bp, Artificial Sequence
  Description of Artificial Sequence: Synthetic oligonucleotide
  Target: ATXN1; (-) strand; PAM type: NRG; PAM sequence: TGG
gcggtggctcactcccactt

SEQ ID NO: 45118 - DNA, 20 bp, Artificial Sequence
  Description of Artificial Sequence: Synthetic oligonucleotide
  Target: ATXN1; (-) strand; PAM type: NRG; PAM sequence: TGG
agggctgtaatcccaagcgg

SEQ ID NO: 45119 - DNA, 20 bp, Artificial Sequence
  Description of Artificial Sequence: Synthetic oligonucleotide
  Target: ATXN1; (-) strand; PAM type: NRG; PAM sequence: CGG
ctcagggctgtaatcccaag

SEQ ID NO: 45120 - DNA, 20 bp, Artificial Sequence
  Description of Artificial Sequence: Synthetic oligonucleotide
  Target: ATXN1; (-) strand; PAM type: NRG; PAM sequence: AAG
tggctcagggctgtaatccc

SEQ ID NO: 45121 - DNA, 20 bp, Artificial Sequence
  Description of Artificial Sequence: Synthetic oligonucleotide
  Target: ATXN1; (-) strand; PAM type: NRG; PAM sequence: GGG
aggctgagcgtggtggctca

SEQ ID NO: 45122 - DNA, 20 bp, Artificial Sequence
  Description of Artificial Sequence: Synthetic oligonucleotide
  Target: ATXN1; (-) strand; PAM type: NRG; PAM sequence: AGG
taggctgagcgtggtggctc

SEQ ID NO: 45123 - DNA, 20 bp, Artificial Sequence
  Description of Artificial Sequence: Synthetic oligonucleotide
  Target: ATXN1; (-) strand; PAM type: NRG; PAM sequence: CAG
ataggctgagcgtggtggct

SEQ ID NO: 45124 - DNA, 20 bp, Artificial Sequence
  Description of Artificial Sequence: Synthetic oligonucleotide
  Target: ATXN1; (-) strand; PAM type: NRG; PAM sequence: TGG
attaaataggctgagcgtgg

SEQ ID NO: 45125 - DNA, 20 bp, Artificial Sequence
  Description of Artificial Sequence: Synthetic oligonucleotide
  Target: ATXN1; (-) strand; PAM type: NRG; PAM sequence: TGG
taaattaaataggctgagcg

SEQ ID NO: 45126 - DNA, 20 bp, Artificial Sequence
  Description of Artificial Sequence: Synthetic oligonucleotide
  Target: ATXN1; (-) strand; PAM type: NRG; PAM sequence: GAG
aaaaataaattaaataggct

SEQ ID NO: 45127 - DNA, 20 bp, Artificial Sequence
  Description of Artificial Sequence: Synthetic oligonucleotide
  Target: ATXN1; (-) strand; PAM type: NRG; PAM sequence: AGG
aatttaaaaataaattaaat

SEQ ID NO: 45128 - DNA, 20 bp, Artificial Sequence
  Description of Artificial Sequence: Synthetic oligonucleotide
  Target: ATXN1; (-) strand; PAM type: NRG; PAM sequence: TAG
aaatttaaaaataaattaaa

SEQ ID NO: 45129 - DNA, 20 bp, Artificial Sequence
  Description of Artificial Sequence: Synthetic oligonucleotide
  Target: ATXN1; (-) strand; PAM type: NRG; PAM sequence: CAG
gaggaggattcccatcttcc

SEQ ID NO: 45130 - DNA, 20 bp, Artificial Sequence
  Description of Artificial Sequence: Synthetic oligonucleotide
  Target: ATXN1; (-) strand; PAM type: NRG; PAM sequence: AGG
caaggattactgcatagagg

SEQ ID NO: 45131 - DNA, 20 bp, Artificial Sequence
  Description of Artificial Sequence: Synthetic oligonucleotide
  Target: ATXN1; (-) strand; PAM type: NRG; PAM sequence: GAG
ccaaggattactgcatagag

SEQ ID NO: 45132 - DNA, 20 bp, Artificial Sequence
  Description of Artificial Sequence: Synthetic oligonucleotide
  Target: ATXN1; (-) strand; PAM type: NRG; PAM sequence: AGG
gtccaaggattactgcatag

SEQ ID NO: 45133 - DNA, 20 bp, Artificial Sequence
  Description of Artificial Sequence: Synthetic oligonucleotide
  Target: ATXN1; (-) strand; PAM type: NRG; PAM sequence: GAG
tgtccaaggattactgcata

SEQ ID NO: 45134 - DNA, 20 bp, Artificial Sequence
  Description of Artificial Sequence: Synthetic oligonucleotide
  Target: ATXN1; (-) strand; PAM type: NRG; PAM sequence: TAG
catgtccaaggattactgca

SEQ ID NO: 45135 - DNA, 20 bp, Artificial Sequence
  Description of Artificial Sequence: Synthetic oligonucleotide
  Target: ATXN1; (-) strand; PAM type: NRG; PAM sequence: AGG
tctcttccactgcatgtcca

SEQ ID NO: 45136 - DNA, 20 bp, Artificial Sequence
  Description of Artificial Sequence: Synthetic oligonucleotide
  Target: ATXN1; (-) strand; PAM type: NRG; PAM sequence: AAG
ctctcttccactgcatgtcc

SEQ ID NO: 45137 - DNA, 20 bp, Artificial Sequence
  Description of Artificial Sequence: Synthetic oligonucleotide
  Target: ATXN1; (-) strand; PAM type: NRG; PAM sequence: CAG
tctctttagtctgtgaccag

SEQ ID NO: 45138 - DNA, 20 bp, Artificial Sequence
  Description of Artificial Sequence: Synthetic oligonucleotide
  Target: ATXN1; (-) strand; PAM type: NRG; PAM sequence: CAG
tcttctctttagtctgtgac

SEQ ID NO: 45139 - DNA, 20 bp, Artificial Sequence
  Description of Artificial Sequence: Synthetic oligonucleotide
  Target: ATXN1; (-) strand; PAM type: NRG; PAM sequence: TAG
agcaaggtgtttcttctctt

SEQ ID NO: 45140 - DNA, 20 bp, Artificial Sequence
  Description of Artificial Sequence: Synthetic oligonucleotide
  Target: ATXN1; (-) strand; PAM type: NRG; PAM sequence: AGG
ctaaatgcaaagagggagca

SEQ ID NO: 45141 - DNA, 20 bp, Artificial Sequence
  Description of Artificial Sequence: Synthetic oligonucleotide
  Target: ATXN1; (-) strand; PAM type: NRG; PAM sequence: AAG
tctaaatgcaaagagggagc

SEQ ID NO: 45142 - DNA, 20 bp, Artificial Sequence
  Description of Artificial Sequence: Synthetic oligonucleotide
  Target: ATXN1; (-) strand; PAM type: NRG; PAM sequence: GAG
tgcttctaaatgcaaagagg

SEQ ID NO: 45143 - DNA, 20 bp, Artificial Sequence
  Description of Artificial Sequence: Synthetic oligonucleotide
  Target: ATXN1; (-) strand; PAM type: NRG; PAM sequence: GGG
aatgcttctaaatgcaaaga

SEQ ID NO: 45144 - DNA, 20 bp, Artificial Sequence
  Description of Artificial Sequence: Synthetic oligonucleotide
  Target: ATXN1; (-) strand; PAM type: NRG; PAM sequence: AGG
taatgcttctaaatgcaaag

SEQ ID NO: 45145 - DNA, 20 bp, Artificial Sequence
  Description of Artificial Sequence: Synthetic oligonucleotide
  Target: ATXN1; (-) strand; PAM type: NRG; PAM sequence: GAG
ttaatgcttctaaatgcaaa

SEQ ID NO: 45146 - DNA, 20 bp, Artificial Sequence
  Description of Artificial Sequence: Synthetic oligonucleotide
  Target: ATXN1; (-) strand; PAM type: NRG; PAM sequence: AAG
tgttaatgcttctaaatgca

SEQ ID NO: 45147 - DNA, 20 bp, Artificial Sequence
  Description of Artificial Sequence: Synthetic oligonucleotide
  Target: ATXN1; (-) strand; PAM type: NRG; PAM sequence: AAG
ggagtcagaacgatattatc

SEQ ID NO: 45148 - DNA, 20 bp, Artificial Sequence
  Description of Artificial Sequence: Synthetic oligonucleotide
  Target: ATXN1; (-) strand; PAM type: NRG; PAM sequence: CAG
tgtgcttcctgctcaggagt

SEQ ID NO: 45149 - DNA, 20 bp, Artificial Sequence
  Description of Artificial Sequence: Synthetic oligonucleotide
  Target: ATXN1; (-) strand; PAM type: NRG; PAM sequence: GAG
actatgtgcttcctgctcag

SEQ ID NO: 45150 - DNA, 20 bp, Artificial Sequence
  Description of Artificial Sequence: Synthetic oligonucleotide
  Target: ATXN1; (-) strand; PAM type: NRG; PAM sequence: AGG
caactatgtgcttcctgctc

SEQ ID NO: 45151 - DNA, 20 bp, Artificial Sequence
  Description of Artificial Sequence: Synthetic oligonucleotide
  Target: ATXN1; (-) strand; PAM type: NRG; PAM sequence: CAG
tcaactatgtgcttcctgct

SEQ ID NO: 45152 - DNA, 20 bp, Artificial Sequence
  Description of Artificial Sequence: Synthetic oligonucleotide
  Target: ATXN1; (-) strand; PAM type: NRG; PAM sequence: CGG
ttatcaaatgccagttagcc

SEQ ID NO: 45153 - DNA, 20 bp, Artificial Sequence
  Description of Artificial Sequence: Synthetic oligonucleotide
  Target: ATXN1; (-) strand; PAM type: NRG; PAM sequence: TAG
acgagttatcaaatgccagt

SEQ ID NO: 45154 - DNA, 20 bp, Artificial Sequence
  Description of Artificial Sequence: Synthetic oligonucleotide
  Target: ATXN1; (-) strand; PAM type: NRG; PAM sequence: CAG
agtcacgagttatcaaatgc

SEQ ID NO: 45155 - DNA, 20 bp, Artificial Sequence
  Description of Artificial Sequence: Synthetic oligonucleotide
  Target: ATXN1; (-) strand; PAM type: NRG; PAM sequence: GAG
aaagactttcctaaagtcac

SEQ ID NO: 45156 - DNA, 20 bp, Artificial Sequence
  Description of Artificial Sequence: Synthetic oligonucleotide
  Target: ATXN1; (-) strand; PAM type: NRG; PAM sequence: AAG
aaaattgaaagactttccta

SEQ ID NO: 45157 - DNA, 20 bp, Artificial Sequence
  Description of Artificial Sequence: Synthetic oligonucleotide
  Target: ATXN1; (-) strand; PAM type: NRG; PAM sequence: AAG
aaagagggagagaaaattga

SEQ ID NO: 45158 - DNA, 20 bp, Artificial Sequence
  Description of Artificial Sequence: Synthetic oligonucleotide
  Target: ATXN1; (-) strand; PAM type: NRG; PAM sequence: GAG
ccggcgacaaaaaagaggga

SEQ ID NO: 45159 - DNA, 20 bp, Artificial Sequence
  Description of Artificial Sequence: Synthetic oligonucleotide
  Target: ATXN1; (-) strand; PAM type: NRG; PAM sequence: GAG
acccggcgacaaaaaagagg

SEQ ID NO: 45160 - DNA, 20 bp, Artificial Sequence
  Description of Artificial Sequence: Synthetic oligonucleotide
  Target: ATXN1; (-) strand; PAM type: NRG; PAM sequence: GGG
agacccggcgacaaaaaaga

SEQ ID NO: 45161 - DNA, 20 bp, Artificial Sequence
  Description of Artificial Sequence: Synthetic oligonucleotide
  Target: ATXN1; (-) strand; PAM type: NRG; PAM sequence: AGG
gagacccggcgacaaaaaag

SEQ ID NO: 45162 - DNA, 20 bp, Artificial Sequence
  Description of Artificial Sequence: Synthetic oligonucleotide
  Target: ATXN1; (-) strand; PAM type: NRG; PAM sequence: GAG
tgagacccggcgacaaaaaa

SEQ ID NO: 45163 - DNA, 20 bp, Artificial Sequence
  Description of Artificial Sequence: Synthetic oligonucleotide
  Target: ATXN1; (-) strand; PAM type: NRG; PAM sequence: AAG
agtgagacccggcgacaaaa

SEQ ID NO: 45164 - DNA, 20 bp, Artificial Sequence
  Description of Artificial Sequence: Synthetic oligonucleotide
  Target: ATXN1; (-) strand; PAM type: NRG; PAM sequence: CGG
ctgggtgacagagtgagacc

SEQ ID NO: 45165 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggtgacagagt

SEQ ID NO: 45166 - DNA, 20 bp, Artificial Sequence
  Description of Artificial Sequence: Synthetic oligonucleotide
  Target: ATXN1; (-) strand; PAM type: NRG; PAM sequence: GAG
acactccagcctgggtgaca

SEQ ID NO: 45167 - DNA, 20 bp, Artificial Sequence
  Description of Artificial Sequence: Synthetic oligonucleotide
  Target: ATXN1; (-) strand; PAM type: NRG; PAM sequence: CAG
ctacactccagcctgggtga

SEQ ID NO: 45168 - DNA, 20 bp, Artificial Sequence
  Description of Artificial Sequence: Synthetic oligonucleotide
  Target: ATXN1; (-) strand; PAM type: NRG; PAM sequence: GGG
ctctcactacactccagcct

SEQ ID NO: 45169 - DNA, 20 bp, Artificial Sequence
  Description of Artificial Sequence: Synthetic oligonucleotide
  Target: ATXN1; (-) strand; PAM type: NRG; PAM sequence: TGG
cctctcactacactccagcc

SEQ ID NO: 45170 - DNA, 20 bp, Artificial Sequence
  Description of Artificial Sequence: Synthetic oligonucleotide
  Target: ATXN1; (-) strand; PAM type: NRG; PAM sequence: CAG
tgtcacctctcactacactc

SEQ ID NO: 45171 - DNA, 20 bp, Artificial Sequence
  Description of Artificial Sequence: Synthetic oligonucleotide
  Target: ATXN1; (-) strand; PAM type: NRG; PAM sequence: CAG
gtgagggctgtgagggctgc

SEQ ID NO: 45172 - DNA, 20 bp, Artificial Sequence
  Description of Artificial Sequence: Synthetic oligonucleotide
  Target: ATXN1; (-) strand; PAM type: NRG; PAM sequence: GGG
agagcaagtgagggctgtga

SEQ ID NO: 45173 - DNA, 20 bp, Artificial Sequence
  Description of Artificial Sequence: Synthetic oligonucleotide
  Target: ATXN1; (-) strand; PAM type: NRG; PAM sequence: AGG
gagagcaagtgagggctgtg

SEQ ID NO: 45174 - DNA, 20 bp, Artificial Sequence
  Description of Artificial Sequence: Synthetic oligonucleotide
  Target: ATXN1; (-) strand; PAM type: NRG; PAM sequence: GAG
agagagcaagtgagggctgt

SEQ ID NO: 45175 - DNA, 20 bp, Artificial Sequence
  Description of Artificial Sequence: Synthetic oligonucleotide
  Target: ATXN1; (-) strand; PAM type: NRG; PAM sequence: GGG
gaggcgcagagagcaagtga

SEQ ID NO: 45176 - DNA, 20 bp, Artificial Sequence
  Description of Artificial Sequence: Synthetic oligonucleotide
  Target: ATXN1; (-) strand; PAM type: NRG; PAM sequence: AGG
ggaggcgcagagagcaagtg

SEQ ID NO: 45177 - DNA, 20 bp, Artificial Sequence
  Description of Artificial Sequence: Synthetic oligonucleotide
  Target: ATXN1; (-) strand; PAM type: NRG; PAM sequence: GAG
aggaggcgcagagagcaagt

SEQ ID NO: 45178 - DNA, 20 bp, Artificial Sequence
  Description of Artificial Sequence: Synthetic oligonucleotide
  Target: ATXN1; (-) strand; PAM type: NRG; PAM sequence: AAG
gcagaggaggcgcagagagc

SEQ ID NO: 45179 - DNA, 20 bp, Artificial Sequence
  Description of Artificial Sequence: Synthetic oligonucleotide
  Target: ATXN1; (-) strand; PAM type: NRG; PAM sequence: GAG
ccaggcagaggaggcgcaga

SEQ ID NO: 45180 - DNA, 20 bp, Artificial Sequence
  Description of Artificial Sequence: Synthetic oligonucleotide
  Target: ATXN1; (-) strand; PAM type: NRG; PAM sequence: GAG
gcccaggcagaggaggcgca

SEQ ID NO: 45181 - DNA, 20 bp, Artificial Sequence
  Description of Artificial Sequence: Synthetic oligonucleotide
  Target: ATXN1; (-) strand; PAM type: NRG; PAM sequence: CAG
gagcccaggcagaggaggcg

SEQ ID NO: 45182 - DNA, 20 bp, Artificial Sequence
  Description of Artificial Sequence: Synthetic oligonucleotide
  Target: ATXN1; (-) strand; PAM type: NRG; PAM sequence: AGG
agtgggagcccaggcagagg

SEQ ID NO: 45183 - DNA, 20 bp, Artificial Sequence
  Description of Artificial Sequence: Synthetic oligonucleotide
  Target: ATXN1; (-) strand; PAM type: NRG; PAM sequence: GAG
aagtgggagcccaggcagag

SEQ ID NO: 45184 - DNA, 20 bp, Artificial Sequence
  Description of Artificial Sequence: Synthetic oligonucleotide
  Target: ATXN1; (-) strand; PAM type: NRG; PAM sequence: AGG
caaagtgggagcccaggcag

SEQ ID NO: 45185 - DNA, 20 bp, Artificial Sequence
  Description of Artificial Sequence: Synthetic oligonucleotide
  Target: ATXN1; (-) strand; PAM type: NRG; PAM sequence: GAG
ccaaagtgggagcccaggca

SEQ ID NO: 45186 - DNA, 20 bp, Artificial Sequence
  Description of Artificial Sequence: Synthetic oligonucleotide
  Target: ATXN1; (-) strand; PAM type: NRG; PAM sequence: CAG
cgccaaagtgggagcccagg

SEQ ID NO: 45187 - DNA, 20 bp, Artificial Sequence
  Description of Artificial Sequence: Synthetic oligonucleotide
  Target: ATXN1; (-) strand; PAM type: NRG; PAM sequence: AGG
agccgccaaagtgggagccc

SEQ ID NO: 45188 - DNA, 20 bp, Artificial Sequence
  Description of Artificial Sequence: Synthetic oligonucleotide
  Target: ATXN1; (-) strand; PAM type: NRG; PAM sequence: CAG
gagccgccaaagtgggagcc

SEQ ID NO: 45189 - DNA, 20 bp, Artificial Sequence
  Description of Artificial Sequence: Synthetic oligonucleotide
  Target: ATXN1; (-) strand; PAM type: NRG; PAM sequence: GAG
ctcaagagccgccaaagtgg

SEQ ID NO: 45190 - DNA, 20 bp, Artificial Sequence
  Description of Artificial Sequence: Synthetic oligonucleotide
  Target: ATXN1; (-) strand; PAM type: NRG; PAM sequence: GGG
tcctcaagagccgccaaagt

SEQ ID NO: 45191 - DNA, 20 bp, Artificial Sequence
  Description of Artificial Sequence: Synthetic oligonucleotide
  Target: ATXN1; (-) strand; PAM type: NRG; PAM sequence: TGG
ctcctcaagagccgccaaag

SEQ ID NO: 45192 - DNA, 20 bp, Artificial Sequence
  Description of Artificial Sequence: Synthetic oligonucleotide
  Target: ATXN1; (-) strand; PAM type: NRG; PAM sequence: AAG
gggctcctcaagagccgcca

SEQ ID NO: 45193 - DNA, 20 bp, Artificial Sequence
  Description of Artificial Sequence: Synthetic oligonucleotide
  Target: ATXN1; (-) strand; PAM type: NRG; PAM sequence: GAG
cggggtgaagggctcctcaa

SEQ ID NO: 45194 - DNA, 20 bp, Artificial Sequence
  Description of Artificial Sequence: Synthetic oligonucleotide
  Target: ATXN1; (-) strand; PAM type: NRG; PAM sequence: AAG
ggcggggtgaagggctcctc

SEQ ID NO: 45195 - DNA, 20 bp, Artificial Sequence
  Description of Artificial Sequence: Synthetic oligonucleotide
  Target: ATXN1; (-) strand; PAM type: NRG; PAM sequence: GGG
cagtgcagcggcggggtgaa

SEQ ID NO: 45196 - DNA, 20 bp, Artificial Sequence
  Description of Artificial Sequence: Synthetic oligonucleotide
  Target: ATXN1; (-) strand; PAM type: NRG; PAM sequence: AGG
acagtgcagcggcggggtga

SEQ ID NO: 45197 - DNA, 20 bp, Artificial Sequence
  Description of Artificial Sequence: Synthetic oligonucleotide
  Target: ATXN1; (-) strand; PAM type: NRG; PAM sequence: AAG
cacagtgcagcggcggggtg

SEQ ID NO: 45198 - DNA, 20 bp, Artificial Sequence
  Description of Artificial Sequence: Synthetic oligonucleotide
  Target: ATXN1; (-) strand; PAM type: NRG; PAM sequence: GGG
ggtcccacagtgcagcggcg

SEQ ID NO: 45199 - DNA, 20 bp, Artificial Sequence
  Description of Artificial Sequence: Synthetic oligonucleotide
  Target: ATXN1; (-) strand; PAM type: NRG; PAM sequence: GGG
aggtcccacagtgcagcggc

SEQ ID NO: 45200 - DNA, 20 bp, Artificial Sequence
  Description of Artificial Sequence: Synthetic oligonucleotide
  Target: ATXN1; (-) strand; PAM type: NRG; PAM sequence: CGG
gaggtcccacagtgcagcgg

SEQ ID NO: 45201 - DNA, 20 bp, Artificial Sequence
  Description of Artificial Sequence: Synthetic oligonucleotide
  Target: ATXN1; (-) strand; PAM type: NRG; PAM sequence: CGG
aaagaggtcccacagtgcag

SEQ ID NO: 45202 - DNA, 20 bp, Artificial Sequence
  Description of Artificial Sequence: Synthetic oligonucleotide
  Target: ATXN1; (-) strand; PAM type: NRG; PAM sequence: CAG
cagaaagaggtcccacagtg

SEQ ID NO: 45203 - DNA, 20 bp, Artificial Sequence
  Description of Artificial Sequence: Synthetic oligonucleotide
  Target: ATXN1; (-) strand; PAM type: NRG; PAM sequence: CAG
cagcccagaaagaggtccca

SEQ ID NO: 45204 - DNA, 20 bp, Artificial Sequence
  Description of Artificial Sequence: Synthetic oligonucleotide
  Target: ATXN1; (-) strand; PAM type: NRG; PAM sequence: AGG
gccttggccagcccagaaag

SEQ ID NO: 45205 - DNA, 20 bp, Artificial Sequence
  Description of Artificial Sequence: Synthetic oligonucleotide
  Target: ATXN1; (-) strand; PAM type: NRG; PAM sequence: GAG
ggccttggccagcccagaaa

SEQ ID NO: 45206 - DNA, 20 bp, Artificial Sequence
  Description of Artificial Sequence: Synthetic oligonucleotide
  Target: ATXN1; (-) strand; PAM type: NRG; PAM sequence: AAG
ctggccttggccagcccaga

SEQ ID NO: 45207 - DNA, 20 bp, Artificial Sequence
  Description of Artificial Sequence: Synthetic oligonucleotide
  Target: ATXN1; (-) strand; PAM type: NRG; PAM sequence: CAG
ggctctggccttggccagcc

SEQ ID NO: 45208 - DNA, 20 bp, Artificial Sequence
  Description of Artificial Sequence: Synthetic oligonucleotide
  Target: ATXN1; (-) strand; PAM type: NRG; PAM sequence: CAG
gagccggctctggccttggc

SEQ ID NO: 45209 - DNA, 20 bp, Artificial Sequence
  Description of Artificial Sequence: Synthetic oligonucleotide
  Target: ATXN1; (-) strand; PAM type: NRG; PAM sequence: TGG
gagggagccggctctggcct

SEQ ID NO: 45210 - DNA, 20 bp, Artificial Sequence
  Description of Artificial Sequence: Synthetic oligonucleotide
  Target: ATXN1; (-) strand; PAM type: NRG; PAM sequence: TGG
caagctgagggagccggctc

SEQ ID NO: 45211 - DNA, 20 bp, Artificial Sequence
  Description of Artificial Sequence: Synthetic oligonucleotide
  Target: ATXN1; (-) strand; PAM type: NRG; PAM sequence: CGG
tccgcgcaagctgagggagc

SEQ ID NO: 45212 - DNA, 20 bp, Artificial Sequence
  Description of Artificial Sequence: Synthetic oligonucleotide
  Target: ATXN1; (-) strand; PAM type: NRG; PAM sequence: GAG
cacctccgcgcaagctgagg

SEQ ID NO: 45213 - DNA, 20 bp, Artificial Sequence
  Description of Artificial Sequence: Synthetic oligonucleotide
  Target: ATXN1; (-) strand; PAM type: NRG; PAM sequence: GGG
cacacctccgcgcaagctga

SEQ ID NO: 45214 - DNA, 20 bp, Artificial Sequence
  Description of Artificial Sequence: Synthetic oligonucleotide
  Target: ATXN1; (-) strand; PAM type: NRG; PAM sequence: AGG
ccacacctccgcgcaagctg

SEQ ID NO: 45215 - DNA, 20 bp, Artificial Sequence
  Description of Artificial Sequence: Synthetic oligonucleotide
  Target: ATXN1; (-) strand; PAM type: NRG; PAM sequence: GAG
tccacacctccgcgcaagct

SEQ ID NO: 45216 - DNA, 20 bp, Artificial Sequence
  Description of Artificial Sequence: Synthetic oligonucleotide
  Target: ATXN1; (-) strand; PAM type: NRG; PAM sequence: AAG
ctccttccacacctccgcgc

SEQ ID NO: 45217 - DNA, 20 bp, Artificial Sequence
  Description of Artificial Sequence: Synthetic oligonucleotide
  Target: ATXN1; (-) strand; PAM type: NRG; PAM sequence: GGG
acaagcaacgcgcgcagccc

SEQ ID NO: 45218 - DNA, 20 bp, Artificial Sequence
  Description of Artificial Sequence: Synthetic oligonucleotide
  Target: ATXN1; (-) strand; PAM type: NRG; PAM sequence: CGG
cacaagcaacgcgcgcagcc

SEQ ID NO: 45219 - DNA, 20 bp, Artificial Sequence
  Description of Artificial Sequence: Synthetic oligonucleotide
  Target: ATXN1; (-) strand; PAM type: NRG; PAM sequence: CAG
tggcccacaagcaacgcgcg

SEQ ID NO: 45220 - DNA, 20 bp, Artificial Sequence
  Description of Artificial Sequence: Synthetic oligonucleotide
  Target: ATXN1; (-) strand; PAM type: NRG; PAM sequence: AAG
tggaacgcgcgctggcccac

SEQ ID NO: 45221 - DNA, 20 bp, Artificial Sequence
  Description of Artificial Sequence: Synthetic oligonucleotide
  Target: ATXN1; (-) strand; PAM type: NRG; PAM sequence: TGG
cagccacctggaacgcgcgc

SEQ ID NO: 45222 - DNA, 20 bp, Artificial Sequence
  Description of Artificial Sequence: Synthetic oligonucleotide
  Target: ATXN1; (-) strand; PAM type: NRG; PAM sequence: TGG
ccacggagcccacagccacc

SEQ ID NO: 45223 - DNA, 20 bp, Artificial Sequence
  Description of Artificial Sequence: Synthetic oligonucleotide
  Target: ATXN1; (-) strand; PAM type: NRG; PAM sequence: CAG
tgcggggcccacggagccca

SEQ ID NO: 45224 - DNA, 20 bp, Artificial Sequence
  Description of Artificial Sequence: Synthetic oligonucleotide
  Target: ATXN1; (-) strand; PAM type: NRG; PAM sequence: GAG
ctccgagtgcggggcccacg

SEQ ID NO: 45225 - DNA, 20 bp, Artificial Sequence
  Description of Artificial Sequence: Synthetic oligonucleotide
  Target: ATXN1; (-) strand; PAM type: NRG; PAM sequence: CGG
tgctccgagtgcggggccca

SEQ ID NO: 45226 - DNA, 20 bp, Artificial Sequence
  Description of Artificial Sequence: Synthetic oligonucleotide
  Target: ATXN1; (-) strand; PAM type: NRG; PAM sequence: GGG
ccgccgctgctccgagtgcg

SEQ ID NO: 45227 - DNA, 20 bp, Artificial Sequence
  Description of Artificial Sequence: Synthetic oligonucleotide
  Target: ATXN1; (-) strand; PAM type: NRG; PAM sequence: GGG
tccgccgctgctccgagtgc

SEQ ID NO: 45228 - DNA, 20 bp, Artificial Sequence
  Description of Artificial Sequence: Synthetic oligonucleotide
  Target: ATXN1; (-) strand; PAM type: NRG; PAM sequence: CGG
gtccgccgctgctccgagtg

SEQ ID NO: 45229 - DNA, 20 bp, Artificial Sequence
  Description of Artificial Sequence: Synthetic oligonucleotide
  Target: ATXN1; (-) strand; PAM type: NRG; PAM sequence: GAG
gcggggtccgccgctgctcc

SEQ ID NO: 45230 - DNA, 20 bp, Artificial Sequence
  Description of Artificial Sequence: Synthetic oligonucleotide
  Target: ATXN1; (-) strand; PAM type: NRG; PAM sequence: GGG
tcactgccctagggccggcg

SEQ ID NO: 45231 - DNA, 20 bp, Artificial Sequence
  Description of Artificial Sequence: Synthetic oligonucleotide
  Target: ATXN1; (-) strand; PAM type: NRG; PAM sequence: GGG
ctcactgccctagggccggc

SEQ ID NO: 45232 - DNA, 20 bp, Artificial Sequence
  Description of Artificial Sequence: Synthetic oligonucleotide
  Target: ATXN1; (-) strand; PAM type: NRG; PAM sequence: CGG
cctcactgccctagggccgg

SEQ ID NO: 45233 - DNA, 20 bp, Artificial Sequence
  Description of Artificial Sequence: Synthetic oligonucleotide
  Target: ATXN1; (-) strand; PAM type: NRG; PAM sequence: CGG
gcccctcactgccctagggc

SEQ ID NO: 45234 - DNA, 20 bp, Artificial Sequence
  Description of Artificial Sequence: Synthetic oligonucleotide
  Target: ATXN1; (-) strand; PAM type: NRG; PAM sequence: GGG
ctaagcccctcactgcccta

SEQ ID NO: 45235 - DNA, 20 bp, Artificial Sequence
  Description of Artificial Sequence: Synthetic oligonucleotide
  Target: ATXN1; (-) strand; PAM type: NRG; PAM sequence: AGG
gctaagcccctcactgccct

SEQ ID NO: 45236 - DNA, 20 bp, Artificial Sequence
  Description of Artificial Sequence: Synthetic oligonucleotide
  Target: ATXN1; (-) strand; PAM type: NRG; PAM sequence: TAG
tgctaagcccctcactgccc

SEQ ID NO: 45237 - DNA, 20 bp, Artificial Sequence
  Description of Artificial Sequence: Synthetic oligonucleotide
  Target: ATXN1; (-) strand; PAM type: NRG; PAM sequence: AAG
cggctgctggcccaactgct

SEQ ID NO: 45238 - DNA, 20 bp, Artificial Sequence
  Description of Artificial Sequence: Synthetic oligonucleotide
  Target: ATXN1; (-) strand; PAM type: NRG; PAM sequence: TGG
aaattgagcacagcggctgc

SEQ ID NO: 45239 - DNA, 20 bp, Artificial Sequence
  Description of Artificial Sequence: Synthetic oligonucleotide
  Target: ATXN1; (-) strand; PAM type: NRG; PAM sequence: CGG
tggcgagaaattgagcacag

SEQ ID NO: 45240 - DNA, 20 bp, Artificial Sequence
  Description of Artificial Sequence: Synthetic oligonucleotide
  Target: ATXN1; (-) strand; PAM type: NRG; PAM sequence: CAG
gcctggcgagaaattgagca

SEQ ID NO: 45241 - DNA, 20 bp, Artificial Sequence
  Description of Artificial Sequence: Synthetic oligonucleotide
  Target: ATXN1; (-) strand; PAM type: NRG; PAM sequence: GAG
ctaaggcctggcgagaaatt

SEQ ID NO: 45242 - DNA, 20 bp, Artificial Sequence
  Description of Artificial Sequence: Synthetic oligonucleotide
  Target: ATXN1; (-) strand; PAM type: NRG; PAM sequence: GAG
gaaggcagctaaggcctggc

SEQ ID NO: 45243 - DNA, 20 bp, Artificial Sequence
  Description of Artificial Sequence: Synthetic oligonucleotide
  Target: ATXN1; (-) strand; PAM type: NRG; PAM sequence: TGG
gccagaaggcagctaaggcc

SEQ ID NO: 45244 - DNA, 20 bp, Artificial Sequence
  Description of Artificial Sequence: Synthetic oligonucleotide
  Target: ATXN1; (-) strand; PAM type: NRG; PAM sequence: AGG
tgcccgccagaaggcagcta

SEQ ID NO: 45245 - DNA, 20 bp, Artificial Sequence
  Description of Artificial Sequence: Synthetic oligonucleotide
  Target: ATXN1; (-) strand; PAM type: NRG; PAM sequence: AAG
ctgcccgccagaaggcagct

SEQ ID NO: 45246 - DNA, 20 bp, Artificial Sequence
  Description of Artificial Sequence: Synthetic oligonucleotide
  Target: ATXN1; (-) strand; PAM type: NRG; PAM sequence: CAG
gagccctgcccgccagaagg

SEQ ID NO: 45247 - DNA, 20 bp, Artificial Sequence
  Description of Artificial Sequence: Synthetic oligonucleotide
  Target: ATXN1; (-) strand; PAM type: NRG; PAM sequence: AGG
cccgagccctgcccgccaga

SEQ ID NO: 45248 - DNA, 20 bp, Artificial Sequence
  Description of Artificial Sequence: Synthetic oligonucleotide
  Target: ATXN1; (-) strand; PAM type: NRG; PAM sequence: AAG
tcccgagccctgcccgccag

SEQ ID NO: 45249 - DNA, 20 bp, Artificial Sequence
  Description of Artificial Sequence: Synthetic oligonucleotide
  Target: ATXN1; (-) strand; PAM type: NRG; PAM sequence: CAG
aggtcccgagccctgcccgc

SEQ ID NO: 45250 - DNA, 20 bp, Artificial Sequence
  Description of Artificial Sequence: Synthetic oligonucleotide
  Target: ATXN1; (-) strand; PAM type: NRG; PAM sequence: GAG
catggcgggctgcaggtccc

SEQ ID NO: 45251 - DNA, 20 bp, Artificial Sequence
  Description of Artificial Sequence: Synthetic oligonucleotide
  Target: ATXN1; (-) strand; PAM type: NRG; PAM sequence: AGG
gttcaggcatggcgggctgc

SEQ ID NO: 45252 - DNA, 20 bp, Artificial Sequence
  Description of Artificial Sequence: Synthetic oligonucleotide
  Target: ATXN1; (-) strand; PAM type: NRG; PAM sequence: CAG
ggttcaggcatggcgggctg

SEQ ID NO: 45253 - DNA, 20 bp, Artificial Sequence
  Description of Artificial Sequence: Synthetic oligonucleotide
  Target: ATXN1; (-) strand; PAM type: NRG; PAM sequence: GGG
gggggaggttcaggcatggc

SEQ ID NO: 45254 - DNA, 20 bp, Artificial Sequence
  Description of Artificial Sequence: Synthetic oligonucleotide
  Target: ATXN1; (-) strand; PAM type: NRG; PAM sequence: CGG
agggggaggttcaggcatgg

SEQ ID NO: 45255 - DNA, 20 bp, Artificial Sequence
  Description of Artificial Sequence: Synthetic oligonucleotide
  Target: ATXN1; (-) strand; PAM type: NRG; PAM sequence: TGG
ggcagggggaggttcaggca

SEQ ID NO: 45256 - DNA, 20 bp, Artificial Sequence
  Description of Artificial Sequence: Synthetic oligonucleotide
  Target: ATXN1; (-) strand; PAM type: NRG; PAM sequence: AGG
ggaggggcagggggaggttc

SEQ ID NO: 45257 - DNA, 20 bp, Artificial Sequence
  Description of Artificial Sequence: Synthetic oligonucleotide
  Target: ATXN1; (-) strand; PAM type: NRG; PAM sequence: CAG
cggaggggcagggggaggtt

SEQ ID NO: 45258 - DNA, 20 bp, Artificial Sequence
  Description of Artificial Sequence: Synthetic oligonucleotide
  Target: ATXN1; (-) strand; PAM type: NRG; PAM sequence: AGG
gcccacggaggggcaggggg

SEQ ID NO: 45259 - DNA, 20 bp, Artificial Sequence
  Description of Artificial Sequence: Synthetic oligonucleotide
  Target: ATXN1; (-) strand; PAM type: NRG; PAM sequence: GAG
agcccacggaggggcagggg

SEQ ID NO: 45260 - DNA, 20 bp, Artificial Sequence
  Description of Artificial Sequence: Synthetic oligonucleotide
  Target: ATXN1; (-) strand; PAM type: NRG; PAM sequence: GGG
ggagcccacggaggggcagg

SEQ ID NO: 45261 - DNA, 20 bp, Artificial Sequence
  Description of Artificial Sequence: Synthetic oligonucleotide
  Target: ATXN1; (-) strand; PAM type: NRG; PAM sequence: GGG
aggagcccacggaggggcag

SEQ ID NO: 45262 - DNA, 20 bp, Artificial Sequence
  Description of Artificial Sequence: Synthetic oligonucleotide
  Target: ATXN1; (-) strand; PAM type: NRG; PAM sequence: GGG
caggagcccacggaggggca

SEQ ID NO: 45263 - DNA, 20 bp, Artificial Sequence
  Description of Artificial Sequence: Synthetic oligonucleotide
  Target: ATXN1; (-) strand; PAM type: NRG; PAM sequence: AGG
acaggagcccacggaggggc

SEQ ID NO: 45264 - DNA, 20 bp, Artificial Sequence
  Description of Artificial Sequence: Synthetic oligonucleotide
  Target: ATXN1; (-) strand; PAM type: NRG; PAM sequence: CAG
cacaggagcccacggagggg

SEQ ID NO: 45265 - DNA, 20 bp, Artificial Sequence
  Description of Artificial Sequence: Synthetic oligonucleotide
  Target: ATXN1; (-) strand; PAM type: NRG; PAM sequence: GGG
ctgcacaggagcccacggag

SEQ ID NO: 45266 - DNA, 20 bp, Artificial Sequence
  Description of Artificial Sequence: Synthetic oligonucleotide
  Target: ATXN1; (-) strand; PAM type: NRG; PAM sequence: GGG
gctgcacaggagcccacgga

SEQ ID NO: 45267 - DNA, 20 bp, Artificial Sequence
  Description of Artificial Sequence: Synthetic oligonucleotide
  Target: ATXN1; (-) strand; PAM type: NRG; PAM sequence: AGG
ggctgcacaggagcccacgg

SEQ ID NO: 45268 - DNA, 20 bp, Artificial Sequence
  Description of Artificial Sequence: Synthetic oligonucleotide
  Target: ATXN1; (-) strand; PAM type: NRG; PAM sequence: GAG
tggctgcacaggagcccacg

SEQ ID NO: 45269 - DNA, 20 bp, Artificial Sequence
  Description of Artificial Sequence: Synthetic oligonucleotide
  Target: ATXN1; (-) strand; PAM type: NRG; PAM sequence: CGG
tctggctgcacaggagccca

SEQ ID NO: 45270 - DNA, 20 bp, Artificial Sequence
  Description of Artificial Sequence: Synthetic oligonucleotide
  Target: ATXN1; (-) strand; PAM type: NRG; PAM sequence: GAG
gggaggctctggctgcacag

SEQ ID NO: 45271 - DNA, 20 bp, Artificial Sequence
  Description of Artificial Sequence: Synthetic oligonucleotide
  Target: ATXN1; (-) strand; PAM type: NRG; PAM sequence: AGG
cggggaggctctggctgcac

SEQ ID NO: 45272 - DNA, 20 bp, Artificial Sequence
  Description of Artificial Sequence: Synthetic oligonucleotide
  Target: ATXN1; (-) strand; PAM type: NRG; PAM sequence: CAG
tcggggaggctctggctgca

SEQ ID NO: 45273 - DNA, 20 bp, Artificial Sequence
  Description of Artificial Sequence: Synthetic oligonucleotide
  Target: ATXN1; (-) strand; PAM type: NRG; PAM sequence: TGG
ggcgctcgtcggggaggctc

SEQ ID NO: 45274 - DNA, 20 bp, Artificial Sequence
  Description of Artificial Sequence: Synthetic oligonucleotide
  Target: ATXN1; (-) strand; PAM type: NRG; PAM sequence: AGG
gggggcggcgctcgtcgggg

SEQ ID NO: 45275 - DNA, 20 bp, Artificial Sequence
  Description of Artificial Sequence: Synthetic oligonucleotide
  Target: ATXN1; (-) strand; PAM type: NRG; PAM sequence: GAG
agggggcggcgctcgtcggg

SEQ ID NO: 45276 - DNA, 20 bp, Artificial Sequence
  Description of Artificial Sequence: Synthetic oligonucleotide
  Target: ATXN1; (-) strand; PAM type: NRG; PAM sequence: GGG
gcagggggcggcgctcgtcg

SEQ ID NO: 45277 - DNA, 20 bp, Artificial Sequence
  Description of Artificial Sequence: Synthetic oligonucleotide
  Target: ATXN1; (-) strand; PAM type: NRG; PAM sequence: GGG
agcagggggcggcgctcgtc

SEQ ID NO: 45278 - DNA, 20 bp, Artificial Sequence
  Description of Artificial Sequence: Synthetic oligonucleotide
  Target: ATXN1; (-) strand; PAM type: NRG; PAM sequence: CGG
gagcagggggcggcgctcgt

SEQ ID NO: 45279 - DNA, 20 bp, Artificial Sequence
  Description of Artificial Sequence: Synthetic oligonucleotide
  Target: ATXN1; (-) strand; PAM type: NRG; PAM sequence: CGG
gggcgctgtggagcaggggg

SEQ ID NO: 45280 - DNA, 20 bp, Artificial Sequence
  Description of Artificial Sequence: Synthetic oligonucleotide
  Target: ATXN1; (-) strand; PAM type: NRG; PAM sequence: GGG
actgggcgctgtggagcagg

SEQ ID NO: 45281 - DNA, 20 bp, Artificial Sequence
  Description of Artificial Sequence: Synthetic oligonucleotide
  Target: ATXN1; (-) strand; PAM type: NRG; PAM sequence: GGG
gactgggcgctgtggagcag

SEQ ID NO: 45282 - DNA, 20 bp, Artificial Sequence
  Description of Artificial Sequence: Synthetic oligonucleotide
  Target: ATXN1; (-) strand; PAM type: NRG; PAM sequence: GGG
ggactgggcgctgtggagca

SEQ ID NO: 45283 - DNA, 20 bp, Artificial Sequence
  Description of Artificial Sequence: Synthetic oligonucleotide
  Target: ATXN1; (-) strand; PAM type: NRG; PAM sequence: AGG
gggactgggcgctgtggagc

SEQ ID NO: 45284 - DNA, 20 bp, Artificial Sequence
  Description of Artificial Sequence: Synthetic oligonucleotide
  Target: ATXN1; (-) strand; PAM type: NRG; PAM sequence: CAG
tgggactgggcgctgtggag

SEQ ID NO: 45285 - DNA, 20 bp, Artificial Sequence
  Description of Artificial Sequence: Synthetic oligonucleotide
  Target: ATXN1; (-) strand; PAM type: NRG; PAM sequence: GAG
cgatgggactgggcgctgtg

SEQ ID NO: 45286 - DNA, 20 bp, Artificial Sequence
  Description of Artificial Sequence: Synthetic oligonucleotide
  Target: ATXN1; (-) strand; PAM type: NRG; PAM sequence: TGG
gtcgatgggactgggcgctg

SEQ ID NO: 45287 - DNA, 20 bp, Artificial Sequence
  Description of Artificial Sequence: Synthetic oligonucleotide
  Target: ATXN1; (-) strand; PAM type: NRG; PAM sequence: GGG
cttgggtggtcgatgggact

SEQ ID NO: 45288 - DNA, 20 bp, Artificial Sequence
  Description of Artificial Sequence: Synthetic oligonucleotide
  Target: ATXN1; (-) strand; PAM type: NRG; PAM sequence: TGG
ccttgggtggtcgatgggac

SEQ ID NO: 45289 - DNA, 20 bp, Artificial Sequence
  Description of Artificial Sequence: Synthetic oligonucleotide
  Target: ATXN1; (-) strand; PAM type: NRG; PAM sequence: GGG
tcagtccttgggtggtcgat

SEQ ID NO: 45290 - DNA, 20 bp, Artificial Sequence
  Description of Artificial Sequence: Synthetic oligonucleotide
  Target: ATXN1; (-) strand; PAM type: NRG; PAM sequence: TGG
ctcagtccttgggtggtcga

SEQ ID NO: 45291 - DNA, 20 bp, Artificial Sequence
  Description of Artificial Sequence: Synthetic oligonucleotide
  Target: ATXN1; (-) strand; PAM type: NRG; PAM sequence: TGG
cgcactcctcagtccttggg

SEQ ID NO: 45292 - DNA, 20 bp, Artificial Sequence
  Description of Artificial Sequence: Synthetic oligonucleotide
  Target: ATXN1; (-) strand; PAM type: NRG; PAM sequence: GGG
gcccgcactcctcagtcctt

SEQ ID NO: 45293 - DNA, 20 bp, Artificial Sequence
  Description of Artificial Sequence: Synthetic oligonucleotide
  Target: ATXN1; (-) strand; PAM type: NRG; PAM sequence: TGG
cgcccgcactcctcagtcct

SEQ ID NO: 45294 - DNA, 20 bp, Artificial Sequence
  Description of Artificial Sequence: Synthetic oligonucleotide
  Target: ATXN1; (-) strand; PAM type: NRG; PAM sequence: CAG
tgccgtgcgcccgcactcct

SEQ ID NO: 45295 - DNA, 20 bp, Artificial Sequence
  Description of Artificial Sequence: Synthetic oligonucleotide
  Target: ATXN1; (-) strand; PAM type: NRG; PAM sequence: CAG
cagtaggtggagctgcctgc

SEQ ID NO: 45296 - DNA, 20 bp, Artificial Sequence
  Description of Artificial Sequence: Synthetic oligonucleotide
  Target: ATXN1; (-) strand; PAM type: NRG; PAM sequence: GAG
cttcacagaggcagtaggtg

SEQ ID NO: 45297 - DNA, 20 bp, Artificial Sequence
  Description of Artificial Sequence: Synthetic oligonucleotide
  Target: ATXN1; (-) strand; PAM type: NRG; PAM sequence: TGG
atcttcacagaggcagtagg

SEQ ID NO: 45298 - DNA, 20 bp, Artificial Sequence
  Description of Artificial Sequence: Synthetic oligonucleotide
  Target: ATXN1; (-) strand; PAM type: NRG; PAM sequence: AGG
tggatcttcacagaggcagt

SEQ ID NO: 45299 - DNA, 20 bp, Artificial Sequence
  Description of Artificial Sequence: Synthetic oligonucleotide
  Target: ATXN1; (-) strand; PAM type: NRG; PAM sequence: TAG
gtggatcttcacagaggcag

SEQ ID NO: 45300 - DNA, 20 bp, Artificial Sequence
  Description of Artificial Sequence: Synthetic oligonucleotide
  Target: ATXN1; (-) strand; PAM type: NRG; PAM sequence: CAG
ctagtggatcttcacagagg

SEQ ID NO: 45301 - DNA, 20 bp, Artificial Sequence
  Description of Artificial Sequence: Synthetic oligonucleotide
  Target: ATXN1; (-) strand; PAM type: NRG; PAM sequence: AGG
cacctagtggatcttcacag

SEQ ID NO: 45302 - DNA, 20 bp, Artificial Sequence
  Description of Artificial Sequence: Synthetic oligonucleotide
  Target: ATXN1; (-) strand; PAM type: NRG; PAM sequence: GAG
tcacctagtggatcttcaca

SEQ ID NO: 45303 - DNA, 20 bp, Artificial Sequence
  Description of Artificial Sequence: Synthetic oligonucleotide
  Target: ATXN1; (-) strand; PAM type: NRG; PAM sequence: CAG
cttcacctagtggatcttca

SEQ ID NO: 45304 - DNA, 20 bp, Artificial Sequence
  Description of Artificial Sequence: Synthetic oligonucleotide
  Target: ATXN1; (-) strand; PAM type: NRG; PAM sequence: TGG
gcccagctggcttcacctag

SEQ ID NO: 45305 - DNA, 20 bp, Artificial Sequence
  Description of Artificial Sequence: Synthetic oligonucleotide
  Target: ATXN1; (-) strand; PAM type: NRG; PAM sequence: TAG
ggagcccagctggcttcacc

SEQ ID NO: 45306 - DNA, 20 bp, Artificial Sequence
  Description of Artificial Sequence: Synthetic oligonucleotide
  Target: ATXN1; (-) strand; PAM type: NRG; PAM sequence: TGG
accagactcaggagcccagc

SEQ ID NO: 45307 - DNA, 20 bp, Artificial Sequence
  Description of Artificial Sequence: Synthetic oligonucleotide
  Target: ATXN1; (-) strand; PAM type: NRG; PAM sequence: CAG
ccccaccagactcaggagcc

SEQ ID NO: 45308 - DNA, 20 bp, Artificial Sequence
  Description of Artificial Sequence: Synthetic oligonucleotide
  Target: ATXN1; (-) strand; PAM type: NRG; PAM sequence: GAG
caaggccccaccagactcag

SEQ ID NO: 45309 - DNA, 20 bp, Artificial Sequence
  Description of Artificial Sequence: Synthetic oligonucleotide
  Target: ATXN1; (-) strand; PAM type: NRG; PAM sequence: AGG
tccaaggccccaccagactc

SEQ ID NO: 45310 - DNA, 20 bp, Artificial Sequence
  Description of Artificial Sequence: Synthetic oligonucleotide
  Target: ATXN1; (-) strand; PAM type: NRG; PAM sequence: CAG
ctccaaggccccaccagact

SEQ ID NO: 45311 - DNA, 20 bp, Artificial Sequence
  Description of Artificial Sequence: Synthetic oligonucleotide
  Target: ATXN1; (-) strand; PAM type: NRG; PAM sequence: CAG
aaggttctccaaggccccac

SEQ ID NO: 45312 - DNA, 20 bp, Artificial Sequence
  Description of Artificial Sequence: Synthetic oligonucleotide
  Target: ATXN1; (-) strand; PAM type: NRG; PAM sequence: AGG
ctagacataaaggttctcca

SEQ ID NO: 45313 - DNA, 20 bp, Artificial Sequence
  Description of Artificial Sequence: Synthetic oligonucleotide
  Target: ATXN1; (-) strand; PAM type: NRG; PAM sequence: AAG
gctagacataaaggttctcc

SEQ ID NO: 45314 - DNA, 20 bp, Artificial Sequence
  Description of Artificial Sequence: Synthetic oligonucleotide
  Target: ATXN1; (-) strand; PAM type: NRG; PAM sequence: AGG
aatcccttagctagacataa

SEQ ID NO: 45315 - DNA, 20 bp, Artificial Sequence
  Description of Artificial Sequence: Synthetic oligonucleotide
  Target: ATXN1; (-) strand; PAM type: NRG; PAM sequence: AAG
aaatcccttagctagacata

SEQ ID NO: 45316 - DNA, 20 bp, Artificial Sequence
  Description of Artificial Sequence: Synthetic oligonucleotide
  Target: ATXN1; (-) strand; PAM type: NRG; PAM sequence: TAG
tgtatttaaaatcccttagc

SEQ ID NO: 45317 - DNA, 20 bp, Artificial Sequence
  Description of Artificial Sequence: Synthetic oligonucleotide
  Target: ATXN1; (-) strand; PAM type: NRG; PAM sequence: TAG
ttggtgtatttaaaatccct

SEQ ID NO: 45318 - DNA, 20 bp, Artificial Sequence
  Description of Artificial Sequence: Synthetic oligonucleotide
  Target: ATXN1; (-) strand; PAM type: NRG; PAM sequence: TGG
gctagatatagagtgctgat

SEQ ID NO: 45319 - DNA, 20 bp, Artificial Sequence
  Description of Artificial Sequence: Synthetic oligonucleotide
  Target: ATXN1; (-) strand; PAM type: NRG; PAM sequence: GAG
caaaccttgagctagatata

SEQ ID NO: 45320 - DNA, 20 bp, Artificial Sequence
  Description of Artificial Sequence: Synthetic oligonucleotide
  Target: ATXN1; (-) strand; PAM type: NRG; PAM sequence: TAG
tacaaaccttgagctagata

SEQ ID NO: 45321 - DNA, 20 bp, Artificial Sequence
  Description of Artificial Sequence: Synthetic oligonucleotide
  Target: ATXN1; (-) strand; PAM type: NRG; PAM sequence: TAG
tgtgtttacaaaccttgagc

SEQ ID NO: 45322 - DNA, 20 bp, Artificial Sequence
  Description of Artificial Sequence: Synthetic oligonucleotide
  Target: ATXN1; (-) strand; PAM type: NRG; PAM sequence: GAG
ttggtgtgtttacaaacctt

SEQ ID NO: 45323 - DNA, 20 bp, Artificial Sequence
  Description of Artificial Sequence: Synthetic oligonucleotide
  Target: ATXN1; (-) strand; PAM type: NRG; PAM sequence: TGG
gctagacacagggtgctgat

SEQ ID NO: 45324 - DNA, 20 bp, Artificial Sequence
  Description of Artificial Sequence: Synthetic oligonucleotide
  Target: ATXN1; (-) strand; PAM type: NRG; PAM sequence: GGG
caaaccctgagctagacaca

SEQ ID NO: 45325 - DNA, 20 bp, Artificial Sequence
  Description of Artificial Sequence: Synthetic oligonucleotide
  Target: ATXN1; (-) strand; PAM type: NRG; PAM sequence: AGG
acaaaccctgagctagacac

SEQ ID NO: 45326 - DNA, 20 bp, Artificial Sequence
  Description of Artificial Sequence: Synthetic oligonucleotide
  Target: ATXN1; (-) strand; PAM type: NRG; PAM sequence: CAG
cacaaaccctgagctagaca

SEQ ID NO: 45327 - DNA, 20 bp, Artificial Sequence
  Description of Artificial Sequence: Synthetic oligonucleotide
  Target: ATXN1; (-) strand; PAM type: NRG; PAM sequence: TAG
tgcattcacaaaccctgagc

SEQ ID NO: 45328 - DNA, 20 bp, Artificial Sequence
  Description of Artificial Sequence: Synthetic oligonucleotide
  Target: ATXN1; (-) strand; PAM type: NRG; PAM sequence: GAG
ttggtgcattcacaaaccct

SEQ ID NO: 45329 - DNA, 20 bp, Artificial Sequence
  Description of Artificial Sequence: Synthetic oligonucleotide
  Target: ATXN1; (-) strand; PAM type: NRG; PAM sequence: TGG
gctagttacagagtgtggat

SEQ ID NO: 45330 - DNA, 20 bp, Artificial Sequence
  Description of Artificial Sequence: Synthetic oligonucleotide
  Target: ATXN1; (-) strand; PAM type: NRG; PAM sequence: TGG
gagtagctagttacagagtg

SEQ ID NO: 45331 - DNA, 20 bp, Artificial Sequence
  Description of Artificial Sequence: Synthetic oligonucleotide
  Target: ATXN1; (-) strand; PAM type: NRG; PAM sequence: GAG
caccagagtagctagttaca

SEQ ID NO: 45332 - DNA, 20 bp, Artificial Sequence
  Description of Artificial Sequence: Synthetic oligonucleotide
  Target: ATXN1; (-) strand; PAM type: NRG; PAM sequence: CAG
cccaccagagtagctagtta

SEQ ID NO: 45333 - DNA, 20 bp, Artificial Sequence
  Description of Artificial Sequence: Synthetic oligonucleotide
  Target: ATXN1; (-) strand; PAM type: NRG; PAM sequence: TAG
caagtccccaccagagtagc

SEQ ID NO: 45334 - DNA, 20 bp, Artificial Sequence
  Description of Artificial Sequence: Synthetic oligonucleotide
  Target: ATXN1; (-) strand; PAM type: NRG; PAM sequence: TAG
tctccaagtccccaccagag

SEQ ID NO: 45335 - DNA, 20 bp, Artificial Sequence
  Description of Artificial Sequence: Synthetic oligonucleotide
  Target: ATXN1; (-) strand; PAM type: NRG; PAM sequence: GAG
ggttctccaagtccccacca

SEQ ID NO: 45336 - DNA, 20 bp, Artificial Sequence
  Description of Artificial Sequence: Synthetic oligonucleotide
  Target: ATXN1; (-) strand; PAM type: NRG; PAM sequence: CAG
aaggttctccaagtccccac

SEQ ID NO: 45337 - DNA, 20 bp, Artificial Sequence
  Description of Artificial Sequence: Synthetic oligonucleotide
  Target: ATXN1; (-) strand; PAM type: NRG; PAM sequence: AAG
gctagacataaaggttctcc

SEQ ID NO: 45338 - DNA, 20 bp, Artificial Sequence
  Description of Artificial Sequence: Synthetic oligonucleotide
  Target: ATXN1; (-) strand; PAM type: NRG; PAM sequence: AGG
aatcccttagctagacataa

SEQ ID NO: 45339 - DNA, 20 bp, Artificial Sequence
  Description of Artificial Sequence: Synthetic oligonucleotide
  Target: ATXN1; (-) strand; PAM type: NRG; PAM sequence: AAG
caatcccttagctagacata

SEQ ID NO: 45340 - DNA, 20 bp, Artificial Sequence
  Description of Artificial Sequence: Synthetic oligonucleotide
  Target: ATXN1; (-) strand; PAM type: NRG; PAM sequence: TAG
tgtatttacaatcccttagc

SEQ ID NO: 45341 - DNA, 20 bp, Artificial Sequence
  Description of Artificial Sequence: Synthetic oligonucleotide
  Target: ATXN1; (-) strand; PAM type: NRG; PAM sequence: TAG
ttggtgtatttacaatccct

SEQ ID NO: 45342 - DNA, 20 bp, Artificial Sequence
  Description of Artificial Sequence: Synthetic oligonucleotide
  Target: ATXN1; (-) strand; PAM type: NRG; PAM sequence: TGG
gctagatacagagtgccgat

SEQ ID NO: 45343 - DNA, 20 bp, Artificial Sequence
  Description of Artificial Sequence: Synthetic oligonucleotide
  Target: ATXN1; (-) strand; PAM type: NRG; PAM sequence: GAG
caaaccttgagctagataca

SEQ ID NO: 45344 - DNA, 20 bp, Artificial Sequence
  Description of Artificial Sequence: Synthetic oligonucleotide
  Target: ATXN1; (-) strand; PAM type: NRG; PAM sequence: CAG
tacaaaccttgagctagata

SEQ ID NO: 45345 - DNA, 20 bp, Artificial Sequence
  Description of Artificial Sequence: Synthetic oligonucleotide
  Target: ATXN1; (-) strand; PAM type: NRG; PAM sequence: TAG
tgtgtttacaaaccttgagc

SEQ ID NO: 45346 - DNA, 20 bp, Artificial Sequence
  Description of Artificial Sequence: Synthetic oligonucleotide
  Target: ATXN1; (-) strand; PAM type: NRG; PAM sequence: GAG
ttggtgtgtttacaaacctt

SEQ ID NO: 45347 - DNA, 20 bp, Artificial Sequence
  Description of Artificial Sequence: Synthetic oligonucleotide
  Target: ATXN1; (-) strand; PAM type: NRG; PAM sequence: TGG
gctagacacagggtgctgat

SEQ ID NO: 45348 - DNA, 20 bp, Artificial Sequence
  Description of Artificial Sequence: Synthetic oligonucleotide
  Target: ATXN1; (-) strand; PAM type: NRG; PAM sequence: GGG
caaaccctgagctagacaca

SEQ ID NO: 45349 - DNA, 20 bp, Artificial Sequence
  Description of Artificial Sequence: Synthetic oligonucleotide
  Target: ATXN1; (-) strand; PAM type: NRG; PAM sequence: AGG
acaaaccctgagctagacac

SEQ ID NO: 45350 - DNA, 20 bp, Artificial Sequence
  Description of Artificial Sequence: Synthetic oligonucleotide
  Target: ATXN1; (-) strand; PAM type: NRG; PAM sequence: CAG
cacaaaccctgagctagaca

SEQ ID NO: 45351 - DNA, 20 bp, Artificial Sequence
  Description of Artificial Sequence: Synthetic oligonucleotide
  Target: ATXN1; (-) strand; PAM type: NRG; PAM sequence: TAG
tgcattcacaaaccctgagc

SEQ ID NO: 45352 - DNA, 20 bp, Artificial Sequence
  Description of Artificial Sequence: Synthetic oligonucleotide
  Target: ATXN1; (-) strand; PAM type: NRG; PAM sequence: GAG
ttggtgcattcacaaaccct

SEQ ID NO: 45353 - DNA, 20 bp, Artificial Sequence
  Description of Artificial Sequence: Synthetic oligonucleotide
  Target: ATXN1; (-) strand; PAM type: NRG; PAM sequence: TGG
gctagatacagagtgtggat

SEQ ID NO: 45354 - DNA, 20 bp, Artificial Sequence
  Description of Artificial Sequence: Synthetic oligonucleotide
  Target: ATXN1; (-) strand; PAM type: NRG; PAM sequence: TGG
gagtagctagatacagagtg

SEQ ID NO: 45355 - DNA, 20 bp, Artificial Sequence
  Description of Artificial Sequence: Synthetic oligonucleotide
  Target: ATXN1; (-) strand; PAM type: NRG; PAM sequence: GAG
caccagagtagctagataca

SEQ ID NO: 45356 - DNA, 20 bp, Artificial Sequence
  Description of Artificial Sequence: Synthetic oligonucleotide
  Target: ATXN1; (-) strand; PAM type: NRG; PAM sequence: CAG
cccaccagagtagctagata

SEQ ID NO: 45357 - DNA, 20 bp, Artificial Sequence
  Description of Artificial Sequence: Synthetic oligonucleotide
  Target: ATXN1; (-) strand; PAM type: NRG; PAM sequence: TAG
caagtccccaccagagtagc

SEQ ID NO: 45358 - DNA, 20 bp, Artificial Sequence
  Description of Artificial Sequence: Synthetic oligonucleotide
  Target: ATXN1; (-) strand; PAM type: NRG; PAM sequence: TAG
tctccaagtccccaccagag

SEQ ID NO: 45359 - DNA, 20 bp, Artificial Sequence
  Description of Artificial Sequence: Synthetic oligonucleotide
  Target: ATXN1; (-) strand; PAM type: NRG; PAM sequence: GAG
ggttctccaagtccccacca

SEQ ID NO: 45360 - DNA, 20 bp, Artificial Sequence
  Description of Artificial Sequence: Synthetic oligonucleotide
  Target: ATXN1; (-) strand; PAM type: NRG; PAM sequence: CAG
aaggttctccaagtccccac

SEQ ID NO: 45361 - DNA, 20 bp, Artificial Sequence
  Description of Artificial Sequence: Synthetic oligonucleotide
  Target: ATXN1; (-) strand; PAM type: NRG; PAM sequence: AAG
tgtcgacacaaaggttctcc

SEQ ID NO: 45362 - DNA, 20 bp, Artificial Sequence
  Description of Artificial Sequence: Synthetic oligonucleotide
  Target: ATXN1; (-) strand; PAM type: NRG; PAM sequence: AGG
aataaagagtgtcgacacaa

SEQ ID NO: 45363 - DNA, 20 bp, Artificial Sequence
  Description of Artificial Sequence: Synthetic oligonucleotide
  Target: ATXN1; (-) strand; PAM type: NRG; PAM sequence: AAG
aaataaagagtgtcgacaca

SEQ ID NO: 45364 - DNA, 20 bp, Artificial Sequence
  Description of Artificial Sequence: Synthetic oligonucleotide
  Target: ATXN1; (-) strand; PAM type: NRG; PAM sequence: GAG
cactagattagctaaataaa

SEQ ID NO: 45365 - DNA, 20 bp, Artificial Sequence
  Description of Artificial Sequence: Synthetic oligonucleotide
  Target: ATXN1; (-) strand; PAM type: NRG; PAM sequence: AAG
cccactagattagctaaata

SEQ ID NO: 45366 - DNA, 20 bp, Artificial Sequence
  Description of Artificial Sequence: Synthetic oligonucleotide
  Target: ATXN1; (-) strand; PAM type: NRG; PAM sequence: TAG
tctccagggccccactagat

SEQ ID NO: 45367 - DNA, 20 bp, Artificial Sequence
  Description of Artificial Sequence: Synthetic oligonucleotide
  Target: ATXN1; (-) strand; PAM type: NRG; PAM sequence: TAG
aaggttctccagggccccac

SEQ ID NO: 45368 - DNA, 20 bp, Artificial Sequence
  Description of Artificial Sequence: Synthetic oligonucleotide
  Target: ATXN1; (-) strand; PAM type: NRG; PAM sequence: GGG
ctagacacaaaggttctcca

SEQ ID NO: 45369 - DNA, 20 bp, Artificial Sequence
  Description of Artificial Sequence: Synthetic oligonucleotide
  Target: ATXN1; (-) strand; PAM type: NRG; PAM sequence: AGG
gctagacacaaaggttctcc

SEQ ID NO: 45370 - DNA, 20 bp, Artificial Sequence
  Description of Artificial Sequence: Synthetic oligonucleotide
  Target: ATXN1; (-) strand; PAM type: NRG; PAM sequence: CAG
agctagacacaaaggttctc

SEQ ID NO: 45371 - DNA, 20 bp, Artificial Sequence
  Description of Artificial Sequence: Synthetic oligonucleotide
  Target: ATXN1; (-) strand; PAM type: NRG; PAM sequence: AGG
aatccctgagctagacacaa

SEQ ID NO: 45372 - DNA, 20 bp, Artificial Sequence
  Description of Artificial Sequence: Synthetic oligonucleotide
  Target: ATXN1; (-) strand; PAM type: NRG; PAM sequence: AAG
caatccctgagctagacaca

SEQ ID NO: 45373 - DNA, 20 bp, Artificial Sequence
  Description of Artificial Sequence: Synthetic oligonucleotide
  Target: ATXN1; (-) strand; PAM type: NRG; PAM sequence: TAG
tgcatttacaatccctgagc

SEQ ID NO: 45374 - DNA, 20 bp, Artificial Sequence
  Description of Artificial Sequence: Synthetic oligonucleotide
  Target: ATXN1; (-) strand; PAM type: NRG; PAM sequence: GAG
ttggtgcatttacaatccct

SEQ ID NO: 45375 - DNA, 20 bp, Artificial Sequence
  Description of Artificial Sequence: Synthetic oligonucleotide
  Target: ATXN1; (-) strand; PAM type: NRG; PAM sequence: TGG
tgttttgacagggtactgat

SEQ ID NO: 45376 - DNA, 20 bp, Artificial Sequence
  Description of Artificial Sequence: Synthetic oligonucleotide
  Target: ATXN1; (-) strand; PAM type: NRG; PAM sequence: GGG
cccagtggtctgttttgaca

SEQ ID NO: 45377 - DNA, 20 bp, Artificial Sequence
  Description of Artificial Sequence: Synthetic oligonucleotide
  Target: ATXN1; (-) strand; PAM type: NRG; PAM sequence: AGG
gcccagtggtctgttttgac

SEQ ID NO: 45378 - DNA, 20 bp, Artificial Sequence
  Description of Artificial Sequence: Synthetic oligonucleotide
  Target: ATXN1; (-) strand; PAM type: NRG; PAM sequence: CAG
agcccagtggtctgttttga

SEQ ID NO: 45379 - DNA, 20 bp, Artificial Sequence
  Description of Artificial Sequence: Synthetic oligonucleotide
  Target: ATXN1; (-) strand; PAM type: NRG; PAM sequence: TGG
ccattttacagagagcccag

SEQ ID NO: 45380 - DNA, 20 bp, Artificial Sequence
  Description of Artificial Sequence: Synthetic oligonucleotide
  Target: ATXN1; (-) strand; PAM type: NRG; PAM sequence: CAG
ggtccattttacagagagcc

SEQ ID NO: 45381 - DNA, 20 bp, Artificial Sequence
  Description of Artificial Sequence: Synthetic oligonucleotide
  Target: ATXN1; (-) strand; PAM type: NRG; PAM sequence: GAG
tgattggtccattttacaga

SEQ ID NO: 45382 - DNA, 20 bp, Artificial Sequence
  Description of Artificial Sequence: Synthetic oligonucleotide
  Target: ATXN1; (-) strand; PAM type: NRG; PAM sequence: GAG
gctgattggtccattttaca

SEQ ID NO: 45383 - DNA, 20 bp, Artificial Sequence
  Description of Artificial Sequence: Synthetic oligonucleotide
  Target: ATXN1; (-) strand; PAM type: NRG; PAM sequence: CAG
ctgctgattggtccatttta

SEQ ID NO: 45384 - DNA, 20 bp, Artificial Sequence
  Description of Artificial Sequence: Synthetic oligonucleotide
  Target: ATXN1; (-) strand; PAM type: NRG; PAM sequence: TGG
cctacccatgttctgctgat

SEQ ID NO: 45385 - DNA, 20 bp, Artificial Sequence
  Description of Artificial Sequence: Synthetic oligonucleotide
  Target: ATXN1; (-) strand; PAM type: NRG; PAM sequence: TGG
cctgcttttattctcttatc

SEQ ID NO: 45386 - DNA, 20 bp, Artificial Sequence
  Description of Artificial Sequence: Synthetic oligonucleotide
  Target: ATXN1; (-) strand; PAM type: NRG; PAM sequence: CAG
gttaccactgctggctcggg

SEQ ID NO: 45387 - DNA, 20 bp, Artificial Sequence
  Description of Artificial Sequence: Synthetic oligonucleotide
  Target: ATXN1; (-) strand; PAM type: NRG; PAM sequence: GGG
aaggttaccactgctggctc

SEQ ID NO: 45388 - DNA, 20 bp, Artificial Sequence
  Description of Artificial Sequence: Synthetic oligonucleotide
  Target: ATXN1; (-) strand; PAM type: NRG; PAM sequence: CGG
gaaggttaccactgctggct

SEQ ID NO: 45389 - DNA, 20 bp, Artificial Sequence
  Description of Artificial Sequence: Synthetic oligonucleotide
  Target: ATXN1; (-) strand; PAM type: NRG; PAM sequence: TGG
tcggagaaggttaccactgc

SEQ ID NO: 45390 - DNA, 20 bp, Artificial Sequence
  Description of Artificial Sequence: Synthetic oligonucleotide
  Target: ATXN1; (-) strand; PAM type: NRG; PAM sequence: AGG
gtgtggaaagggatcggaga

SEQ ID NO: 45391 - DNA, 20 bp, Artificial Sequence
  Description of Artificial Sequence: Synthetic oligonucleotide
  Target: ATXN1; (-) strand; PAM type: NRG; PAM sequence: AAG
agtgtggaaagggatcggag

SEQ ID NO: 45392 - DNA, 20 bp, Artificial Sequence
  Description of Artificial Sequence: Synthetic oligonucleotide
  Target: ATXN1; (-) strand; PAM type: NRG; PAM sequence: GAG
cacagtgtggaaagggatcg

SEQ ID NO: 45393 - DNA, 20 bp, Artificial Sequence
  Description of Artificial Sequence: Synthetic oligonucleotide
  Target: ATXN1; (-) strand; PAM type: NRG; PAM sequence: CGG
tccacagtgtggaaagggat

SEQ ID NO: 45394 - DNA, 20 bp, Artificial Sequence
  Description of Artificial Sequence: Synthetic oligonucleotide
  Target: ATXN1; (-) strand; PAM type: NRG; PAM sequence: GGG
aagcttccacagtgtggaaa

SEQ ID NO: 45395 - DNA, 20 bp, Artificial Sequence
  Description of Artificial Sequence: Synthetic oligonucleotide
  Target: ATXN1; (-) strand; PAM type: NRG; PAM sequence: AGG
aaagcttccacagtgtggaa

SEQ ID NO: 45396 - DNA, 20 bp, Artificial Sequence
  Description of Artificial Sequence: Synthetic oligonucleotide
  Target: ATXN1; (-) strand; PAM type: NRG; PAM sequence: AAG
caaagcttccacagtgtgga

SEQ ID NO: 45397 - DNA, 20 bp, Artificial Sequence
  Description of Artificial Sequence: Synthetic oligonucleotide
  Target: ATXN1; (-) strand; PAM type: NRG; PAM sequence: TGG
agaacaaagcttccacagtg

SEQ ID NO: 45398 - DNA, 20 bp, Artificial Sequence
  Description of Artificial Sequence: Synthetic oligonucleotide
  Target: ATXN1; (-) strand; PAM type: NRG; PAM sequence: CAG
caaaaagaacaaagcttcca

SEQ ID NO: 45399 - DNA, 20 bp, Artificial Sequence
  Description of Artificial Sequence: Synthetic oligonucleotide
  Target: ATXN1; (-) strand; PAM type: NRG; PAM sequence: AAG
ttgcaaagacaaaaagaaca

SEQ ID NO: 45400 - DNA, 20 bp, Artificial Sequence
  Description of Artificial Sequence: Synthetic oligonucleotide
  Target: ATXN1; (-) strand; PAM type: NRG; PAM sequence: AAG
agatttattgcaaagacaaa

SEQ ID NO: 45401 - DNA, 20 bp, Artificial Sequence
  Description of Artificial Sequence: Synthetic oligonucleotide
  Target: ATXN1; (-) strand; PAM type: NRG; PAM sequence: AAG
cagcagcaagatttattgca

SEQ ID NO: 45402 - DNA, 20 bp, Artificial Sequence
  Description of Artificial Sequence: Synthetic oligonucleotide
  Target: ATXN1; (-) strand; PAM type: NRG; PAM sequence: AAG
aaagagtgaacagcagcagc

SEQ ID NO: 45403 - DNA, 20 bp, Artificial Sequence
  Description of Artificial Sequence: Synthetic oligonucleotide
  Target: ATXN1; (-) strand; PAM type: NRG; PAM sequence: CAG
atccaaagagtgaacagcag

SEQ ID NO: 45404 - DNA, 20 bp, Artificial Sequence
  Description of Artificial Sequence: Synthetic oligonucleotide
  Target: ATXN1; (-) strand; PAM type: NRG; PAM sequence: CAG
tagatccaaagagtgaacag

SEQ ID NO: 45405 - DNA, 20 bp, Artificial Sequence
  Description of Artificial Sequence: Synthetic oligonucleotide
  Target: ATXN1; (-) strand; PAM type: NRG; PAM sequence: CAG
gtatagatccaaagagtgaa

SEQ ID NO: 45406 - DNA, 20 bp, Artificial Sequence
  Description of Artificial Sequence: Synthetic oligonucleotide
  Target: ATXN1; (-) strand; PAM type: NRG; PAM sequence: GAG
acaggcagtatagatccaaa

SEQ ID NO: 45407 - DNA, 20 bp, Artificial Sequence
  Description of Artificial Sequence: Synthetic oligonucleotide
  Target: ATXN1; (-) strand; PAM type: NRG; PAM sequence: AAG
atacaggcagtatagatcca

SEQ ID NO: 45408 - DNA, 20 bp, Artificial Sequence
  Description of Artificial Sequence: Synthetic oligonucleotide
  Target: ATXN1; (-) strand; PAM type: NRG; PAM sequence: TAG
tatagctcatacaggcagta

SEQ ID NO: 45409 - DNA, 20 bp, Artificial Sequence
  Description of Artificial Sequence: Synthetic oligonucleotide
  Target: ATXN1; (-) strand; PAM type: NRG; PAM sequence: CAG
agtgttatagctcatacagg

SEQ ID NO: 45410 - DNA, 20 bp, Artificial Sequence
  Description of Artificial Sequence: Synthetic oligonucleotide
  Target: ATXN1; (-) strand; PAM type: NRG; PAM sequence: AGG
gtgagtgttatagctcatac

SEQ ID NO: 45411 - DNA, 20 bp, Artificial Sequence
  Description of Artificial Sequence: Synthetic oligonucleotide
  Target: ATXN1; (-) strand; PAM type: NRG; PAM sequence: CAG
ggtgagtgttatagctcata

SEQ ID NO: 45412 - DNA, 20 bp, Artificial Sequence
  Description of Artificial Sequence: Synthetic oligonucleotide
  Target: ATXN1; (-) strand; PAM type: NRG; PAM sequence: TAG
gacctttccggtgagtgtta

SEQ ID NO: 45413 - DNA, 20 bp, Artificial Sequence
  Description of Artificial Sequence: Synthetic oligonucleotide
  Target: ATXN1; (-) strand; PAM type: NRG; PAM sequence: GAG
aagctgcagacctttccggt

SEQ ID NO: 45414 - DNA, 20 bp, Artificial Sequence
  Description of Artificial Sequence: Synthetic oligonucleotide
  Target: ATXN1; (-) strand; PAM type: NRG; PAM sequence: CGG
aatgaagctgcagacctttc

SEQ ID NO: 45415 - DNA, 20 bp, Artificial Sequence
  Description of Artificial Sequence: Synthetic oligonucleotide
  Target: ATXN1; (-) strand; PAM type: NRG; PAM sequence: CAG
tggcttcaggaatgaagctg

SEQ ID NO: 45416 - DNA, 20 bp, Artificial Sequence
  Description of Artificial Sequence: Synthetic oligonucleotide
  Target: ATXN1; (-) strand; PAM type: NRG; PAM sequence: AAG
tctcactggcttcaggaatg

SEQ ID NO: 45417 - DNA, 20 bp, Artificial Sequence
  Description of Artificial Sequence: Synthetic oligonucleotide
  Target: ATXN1; (-) strand; PAM type: NRG; PAM sequence: AGG
ttcatggtctcactggcttc

SEQ ID NO: 45418 - DNA, 20 bp, Artificial Sequence
  Description of Artificial Sequence: Synthetic oligonucleotide
  Target: ATXN1; (-) strand; PAM type: NRG; PAM sequence: CAG
gttcatggtctcactggctt

SEQ ID NO: 45419 - DNA, 20 bp, Artificial Sequence
  Description of Artificial Sequence: Synthetic oligonucleotide
  Target: ATXN1; (-) strand; PAM type: NRG; PAM sequence: TGG
ctgtgggttcatggtctcac

SEQ ID NO: 45420 - DNA, 20 bp, Artificial Sequence
  Description of Artificial Sequence: Synthetic oligonucleotide
  Target: ATXN1; (-) strand; PAM type: NRG; PAM sequence: TGG
cattcctccctgtgggttca

SEQ ID NO: 45421 - DNA, 20 bp, Artificial Sequence
  Description of Artificial Sequence: Synthetic oligonucleotide
  Target: ATXN1; (-) strand; PAM type: NRG; PAM sequence: GGG
agttgttcattcctccctgt

SEQ ID NO: 45422 - DNA, 20 bp, Artificial Sequence
  Description of Artificial Sequence: Synthetic oligonucleotide
  Target: ATXN1; (-) strand; PAM type: NRG; PAM sequence: TGG
gagttgttcattcctccctg

SEQ ID NO: 45423 - DNA, 20 bp, Artificial Sequence
  Description of Artificial Sequence: Synthetic oligonucleotide
  Target: ATXN1; (-) strand; PAM type: NRG; PAM sequence: GAG
ttcttaaagcggcatgtctg

SEQ ID NO: 45424 - DNA, 20 bp, Artificial Sequence
  Description of Artificial Sequence: Synthetic oligonucleotide
  Target: ATXN1; (-) strand; PAM type: NRG; PAM sequence: TGG
agttcttaaagcggcatgtc

SEQ ID NO: 45425 - DNA, 20 bp, Artificial Sequence
  Description of Artificial Sequence: Synthetic oligonucleotide
  Target: ATXN1; (-) strand; PAM type: NRG; PAM sequence: CGG
gagtgttacagttcttaaag

SEQ ID NO: 45426 - DNA, 20 bp, Artificial Sequence
  Description of Artificial Sequence: Synthetic oligonucleotide
  Target: ATXN1; (-) strand; PAM type: NRG; PAM sequence: AAG
ggtgagtgttacagttctta

SEQ ID NO: 45427 - DNA, 20 bp, Artificial Sequence
  Description of Artificial Sequence: Synthetic oligonucleotide
  Target: ATXN1; (-) strand; PAM type: NRG; PAM sequence: CAG
gacccttgcggtgagtgtta

SEQ ID NO: 45428 - DNA, 20 bp, Artificial Sequence
  Description of Artificial Sequence: Synthetic oligonucleotide
  Target: ATXN1; (-) strand; PAM type: NRG; PAM sequence: GAG
aagccgtggacccttgcggt

SEQ ID NO: 45429 - DNA, 20 bp, Artificial Sequence
  Description of Artificial Sequence: Synthetic oligonucleotide
  Target: ATXN1; (-) strand; PAM type: NRG; PAM sequence: CGG
aattaagccgtggacccttg

SEQ ID NO: 45430 - DNA, 20 bp, Artificial Sequence
  Description of Artificial Sequence: Synthetic oligonucleotide
  Target: ATXN1; (-) strand; PAM type: NRG; PAM sequence: TGG
tgacttcaagaattaagccg

SEQ ID NO: 45431 - DNA, 20 bp, Artificial Sequence
  Description of Artificial Sequence: Synthetic oligonucleotide
  Target: ATXN1; (-) strand; PAM type: NRG; PAM sequence: AAG
tctcactgacttcaagaatt

SEQ ID NO: 45432 - DNA, 20 bp, Artificial Sequence
  Description of Artificial Sequence: Synthetic oligonucleotide
  Target: ATXN1; (-) strand; PAM type: NRG; PAM sequence: AAG
ttcttggtctcactgacttc

SEQ ID NO: 45433 - DNA, 20 bp, Artificial Sequence
  Description of Artificial Sequence: Synthetic oligonucleotide
  Target: ATXN1; (-) strand; PAM type: NRG; PAM sequence: TGG
tccagaattaggtgcgttct

SEQ ID NO: 45434 - DNA, 20 bp, Artificial Sequence
  Description of Artificial Sequence: Synthetic oligonucleotide
  Target: ATXN1; (-) strand; PAM type: NRG; PAM sequence: AGG
gtgctactgtgtccagaatt

SEQ ID NO: 45435 - DNA, 20 bp, Artificial Sequence
  Description of Artificial Sequence: Synthetic oligonucleotide
  Target: ATXN1; (-) strand; PAM type: NRG; PAM sequence: TAG
tgtgctactgtgtccagaat

SEQ ID NO: 45436 - DNA, 20 bp, Artificial Sequence
  Description of Artificial Sequence: Synthetic oligonucleotide
  Target: ATXN1; (-) strand; PAM type: NRG; PAM sequence: CAG
tatggttgtgctactgtgtc

SEQ ID NO: 45437 - DNA, 20 bp, Artificial Sequence
  Description of Artificial Sequence: Synthetic oligonucleotide
  Target: ATXN1; (-) strand; PAM type: NRG; PAM sequence: TGG
gtcgaggctacagtaaacta

SEQ ID NO: 45438 - DNA, 20 bp, Artificial Sequence
  Description of Artificial Sequence: Synthetic oligonucleotide
  Target: ATXN1; (-) strand; PAM type: NRG; PAM sequence: CAG
gcacagggaggtcgaggcta

SEQ ID NO: 45439 - DNA, 20 bp, Artificial Sequence
  Description of Artificial Sequence: Synthetic oligonucleotide
  Target: ATXN1; (-) strand; PAM type: NRG; PAM sequence: AGG
acttgagcacagggaggtcg

SEQ ID NO: 45440 - DNA, 20 bp, Artificial Sequence
  Description of Artificial Sequence: Synthetic oligonucleotide
  Target: ATXN1; (-) strand; PAM type: NRG; PAM sequence: GAG
cacttgagcacagggaggtc

SEQ ID NO: 45441 - DNA, 20 bp, Artificial Sequence
  Description of Artificial Sequence: Synthetic oligonucleotide
  Target: ATXN1; (-) strand; PAM type: NRG; PAM sequence: AGG
aggatcacttgagcacaggg

SEQ ID NO: 45442 - DNA, 20 bp, Artificial Sequence
  Description of Artificial Sequence: Synthetic oligonucleotide
  Target: ATXN1; (-) strand; PAM type: NRG; PAM sequence: GAG
gaggatcacttgagcacagg

SEQ ID NO: 45443 - DNA, 20 bp, Artificial Sequence
  Description of Artificial Sequence: Synthetic oligonucleotide
  Target: ATXN1; (-) strand; PAM type: NRG; PAM sequence: GGG
ctgaggatcacttgagcaca

SEQ ID NO: 45444 - DNA, 20 bp, Artificial Sequence
  Description of Artificial Sequence: Synthetic oligonucleotide
  Target: ATXN1; (-) strand; PAM type: NRG; PAM sequence: AGG
gctgaggatcacttgagcac

SEQ ID NO: 45445 - DNA, 20 bp, Artificial Sequence
  Description of Artificial Sequence: Synthetic oligonucleotide
  Target: ATXN1; (-) strand; PAM type: NRG; PAM sequence: CAG
agctgaggatcacttgagca

SEQ ID NO: 45446 - DNA, 20 bp, Artificial Sequence
  Description of Artificial Sequence: Synthetic oligonucleotide
  Target: ATXN1; (-) strand; PAM type: NRG; PAM sequence: GAG
aaggaagctgaggatcactt

SEQ ID NO: 45447 - DNA, 20 bp, Artificial Sequence
  Description of Artificial Sequence: Synthetic oligonucleotide
  Target: ATXN1; (-) strand; PAM type: NRG; PAM sequence: AGG
cccagctactaaggaagctg

SEQ ID NO: 45448 - DNA, 20 bp, Artificial Sequence
  Description of Artificial Sequence: Synthetic oligonucleotide
  Target: ATXN1; (-) strand; PAM type: NRG; PAM sequence: GAG
tcccagctactaaggaagct

SEQ ID NO: 45449 - DNA, 20 bp, Artificial Sequence
  Description of Artificial Sequence: Synthetic oligonucleotide
  Target: ATXN1; (-) strand; PAM type: NRG; PAM sequence: AAG
tgtaatcccagctactaagg

SEQ ID NO: 45450 - DNA, 20 bp, Artificial Sequence
  Description of Artificial Sequence: Synthetic oligonucleotide
  Target: ATXN1; (-) strand; PAM type: NRG; PAM sequence: AGG
gtctgtaatcccagctacta

SEQ ID NO: 45451 - DNA, 20 bp, Artificial Sequence
  Description of Artificial Sequence: Synthetic oligonucleotide
  Target: ATXN1; (-) strand; PAM type: NRG; PAM sequence: AAG
agtctgtaatcccagctact

SEQ ID NO: 45452 - DNA, 20 bp, Artificial Sequence
  Description of Artificial Sequence: Synthetic oligonucleotide
  Target: ATXN1; (-) strand; PAM type: NRG; PAM sequence: CAG
gcggcacaagtctgtaatcc

SEQ ID NO: 45453 - DNA, 20 bp, Artificial Sequence
  Description of Artificial Sequence: Synthetic oligonucleotide
  Target: ATXN1; (-) strand; PAM type: NRG; PAM sequence: AAG
gtagctagatgtggcggcac

SEQ ID NO: 45454 - DNA, 20 bp, Artificial Sequence
  Description of Artificial Sequence: Synthetic oligonucleotide
  Target: ATXN1; (-) strand; PAM type: NRG; PAM sequence: CGG
taaaatgtagctagatgtgg

SEQ ID NO: 45455 - DNA, 20 bp, Artificial Sequence
  Description of Artificial Sequence: Synthetic oligonucleotide
  Target: ATXN1; (-) strand; PAM type: NRG; PAM sequence: TGG
gtttaaaatgtagctagatg

SEQ ID NO: 45456 - DNA, 20 bp, Artificial Sequence
  Description of Artificial Sequence: Synthetic oligonucleotide
  Target: ATXN1; (-) strand; PAM type: NRG; PAM sequence: TAG
aaaaaagtttaaaatgtagc

SEQ ID NO: 45457 - DNA, 20 bp, Artificial Sequence
  Description of Artificial Sequence: Synthetic oligonucleotide
  Target: ATXN1; (-) strand; PAM type: NRG; PAM sequence: TAG
gaataaaaaagtttaaaatg

SEQ ID NO: 45458 - DNA, 20 bp, Artificial Sequence
  Description of Artificial Sequence: Synthetic oligonucleotide
  Target: ATXN1; (-) strand; PAM type: NRG; PAM sequence: AAG
gaaaccctatctgaataaaa

SEQ ID NO: 45459 - DNA, 20 bp, Artificial Sequence
  Description of Artificial Sequence: Synthetic oligonucleotide
  Target: ATXN1; (-) strand; PAM type: NRG; PAM sequence: CAG
gagtttgagaccagcctgca

SEQ ID NO: 45460 - DNA, 20 bp, Artificial Sequence
  Description of Artificial Sequence: Synthetic oligonucleotide
  Target: ATXN1; (-) strand; PAM type: NRG; PAM sequence: CAG
taagcccaggagtttgagac

SEQ ID NO: 45461 - DNA, 20 bp, Artificial Sequence
  Description of Artificial Sequence: Synthetic oligonucleotide
  Target: ATXN1; (-) strand; PAM type: NRG; PAM sequence: GAG
tcgcttaagcccaggagttt

SEQ ID NO: 45462 - DNA, 20 bp, Artificial Sequence
  Description of Artificial Sequence: Synthetic oligonucleotide
  Target: ATXN1; (-) strand; PAM type: NRG; PAM sequence: GAG
ggaggatcgcttaagcccag

SEQ ID NO: 45463 - DNA, 20 bp, Artificial Sequence
  Description of Artificial Sequence: Synthetic oligonucleotide
  Target: ATXN1; (-) strand; PAM type: NRG; PAM sequence: AGG
tgggaggatcgcttaagccc

SEQ ID NO: 45464 - DNA, 20 bp, Artificial Sequence
  Description of Artificial Sequence: Synthetic oligonucleotide
  Target: ATXN1; (-) strand; PAM type: NRG; PAM sequence: CAG
atgggaggatcgcttaagcc

SEQ ID NO: 45465 - DNA, 20 bp, Artificial Sequence
  Description of Artificial Sequence: Synthetic oligonucleotide
  Target: ATXN1; (-) strand; PAM type: NRG; PAM sequence: AAG
ccaaaatgggaggatcgctt

SEQ ID NO: 45466 - DNA, 20 bp, Artificial Sequence
  Description of Artificial Sequence: Synthetic oligonucleotide
  Target: ATXN1; (-) strand; PAM type: NRG; PAM sequence: AGG
ctatggaaagccaaaatggg

SEQ ID NO: 45467 - DNA, 20 bp, Artificial Sequence
  Description of Artificial Sequence: Synthetic oligonucleotide
  Target: ATXN1; (-) strand; PAM type: NRG; PAM sequence: GAG
actatggaaagccaaaatgg

SEQ ID NO: 45468 - DNA, 20 bp, Artificial Sequence
  Description of Artificial Sequence: Synthetic oligonucleotide
  Target: ATXN1; (-) strand; PAM type: NRG; PAM sequence: GGG
acactatggaaagccaaaat

SEQ ID NO: 45469 - DNA, 20 bp, Artificial Sequence
  Description of Artificial Sequence: Synthetic oligonucleotide
  Target: ATXN1; (-) strand; PAM type: NRG; PAM sequence: TGG
aacactatggaaagccaaaa

SEQ ID NO: 45470 - DNA, 20 bp, Artificial Sequence
  Description of Artificial Sequence: Synthetic oligonucleotide
  Target: ATXN1; (-) strand; PAM type: NRG; PAM sequence: AAG
tgtaattctaacactatgga

SEQ ID NO: 45471 - DNA, 20 bp, Artificial Sequence
  Description of Artificial Sequence: Synthetic oligonucleotide
  Target: ATXN1; (-) strand; PAM type: NRG; PAM sequence: TGG
tatctgtaattctaacacta

SEQ ID NO: 45472 - DNA, 20 bp, Artificial Sequence
  Description of Artificial Sequence: Synthetic oligonucleotide
  Target: ATXN1; (-) strand; PAM type: NRG; PAM sequence: TGG
gttgaatgggcccggtgctg

SEQ ID NO: 45473 - DNA, 20 bp, Artificial Sequence
  Description of Artificial Sequence: Synthetic oligonucleotide
  Target: ATXN1; (-) strand; PAM type: NRG; PAM sequence: CGG
cttagaaagttgaatgggcc

SEQ ID NO: 45474 - DNA, 20 bp, Artificial Sequence
  Description of Artificial Sequence: Synthetic oligonucleotide
  Target: ATXN1; (-) strand; PAM type: NRG; PAM sequence: GGG
caaagcttagaaagttgaat

SEQ ID NO: 45475 - DNA, 20 bp, Artificial Sequence
  Description of Artificial Sequence: Synthetic oligonucleotide
  Target: ATXN1; (-) strand; PAM type: NRG; PAM sequence: TGG
tcaaagcttagaaagttgaa

SEQ ID NO: 45476 - DNA, 20 bp, Artificial Sequence
  Description of Artificial Sequence: Synthetic oligonucleotide
  Target: ATXN1; (-) strand; PAM type: NRG; PAM sequence: AAG
agaggaaatcaaagcttaga

SEQ ID NO: 45477 - DNA, 20 bp, Artificial Sequence
  Description of Artificial Sequence: Synthetic oligonucleotide
  Target: ATXN1; (-) strand; PAM type: NRG; PAM sequence: TAG
ttaaagaggaaatcaaagct

SEQ ID NO: 45478 - DNA, 20 bp, Artificial Sequence
  Description of Artificial Sequence: Synthetic oligonucleotide
  Target: ATXN1; (-) strand; PAM type: NRG; PAM sequence: AAG
ttttcttaaagaggaaatca

SEQ ID NO: 45479 - DNA, 20 bp, Artificial Sequence
  Description of Artificial Sequence: Synthetic oligonucleotide
  Target: ATXN1; (-) strand; PAM type: NRG; PAM sequence: AGG
ctatcttcattttcttaaag

SEQ ID NO: 45480 - DNA, 20 bp, Artificial Sequence
  Description of Artificial Sequence: Synthetic oligonucleotide
  Target: ATXN1; (-) strand; PAM type: NRG; PAM sequence: GAG
actatcttcattttcttaaa

SEQ ID NO: 45481 - DNA, 20 bp, Artificial Sequence
  Description of Artificial Sequence: Synthetic oligonucleotide
  Target: ATXN1; (-) strand; PAM type: NRG; PAM sequence: AAG
atactatcttcattttctta

SEQ ID NO: 45482 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattatatgtgt

SEQ ID NO: 45483 - DNA, 20 bp, Artificial Sequence
  Description of Artificial Sequence: Synthetic oligonucleotide
  Target: ATXN1; (-) strand; PAM type: NRG; PAM sequence: GGG
cctcggcctctgaaagtgct

SEQ ID NO: 45484 - DNA, 20 bp, Artificial Sequence
  Description of Artificial Sequence: Synthetic oligonucleotide
  Target: ATXN1; (-) strand; PAM type: NRG; PAM sequence: TGG
ccctcggcctctgaaagtgc

SEQ ID NO: 45485 - DNA, 20 bp, Artificial Sequence
  Description of Artificial Sequence: Synthetic oligonucleotide
  Target: ATXN1; (-) strand; PAM type: NRG; PAM sequence: AAG
tgccccccctcggcctctga

SEQ ID NO: 45486 - DNA, 20 bp, Artificial Sequence
  Description of Artificial Sequence: Synthetic oligonucleotide
  Target: ATXN1; (-) strand; PAM type: NRG; PAM sequence: CGG
tcacatgatctgccccccct

SEQ ID NO: 45487 - DNA, 20 bp, Artificial Sequence
  Description of Artificial Sequence: Synthetic oligonucleotide
  Target: ATXN1; (-) strand; PAM type: NRG; PAM sequence: TGG
accaggctggtctcgaactc

SEQ ID NO: 45488 - DNA, 20 bp, Artificial Sequence
  Description of Artificial Sequence: Synthetic oligonucleotide
  Target: ATXN1; (-) strand; PAM type: NRG; PAM sequence: TGG
ctttgccacattgaccaggc

SEQ ID NO: 45489 - DNA, 20 bp, Artificial Sequence
  Description of Artificial Sequence: Synthetic oligonucleotide
  Target: ATXN1; (-) strand; PAM type: NRG; PAM sequence: AGG
ggggctttgccacattgacc

SEQ ID NO: 45490 - DNA, 20 bp, Artificial Sequence
  Description of Artificial Sequence: Synthetic oligonucleotide
  Target: ATXN1; (-) strand; PAM type: NRG; PAM sequence: CAG
cggggctttgccacattgac

SEQ ID NO: 45491 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagacg

SEQ ID NO: 45492 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagac

SEQ ID NO: 45493 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 45494 - DNA, 20 bp, Artificial Sequence
  Description of Artificial Sequence: Synthetic oligonucleotide
  Target: ATXN1; (-) strand; PAM type: NRG; PAM sequence: GAG
ttttttttgtatttttagta

SEQ ID NO: 45495 - DNA, 20 bp, Artificial Sequence
  Description of Artificial Sequence: Synthetic oligonucleotide
  Target: ATXN1; (-) strand; PAM type: NRG; PAM sequence: TAG
aattttttttgtatttttag

SEQ ID NO: 45496 - DNA, 20 bp, Artificial Sequence
  Description of Artificial Sequence: Synthetic oligonucleotide
  Target: ATXN1; (-) strand; PAM type: NRG; PAM sequence: TAG
gctaattttttttgtatttt

SEQ ID NO: 45497 - DNA, 20 bp, Artificial Sequence
  Description of Artificial Sequence: Synthetic oligonucleotide
  Target: ATXN1; (-) strand; PAM type: NRG; PAM sequence: CGG
caggcactcaccaccaagcc

SEQ ID NO: 45498 - DNA, 20 bp, Artificial Sequence
  Description of Artificial Sequence: Synthetic oligonucleotide
  Target: ATXN1; (-) strand; PAM type: NRG; PAM sequence: AAG
aattacaggcactcaccacc

SEQ ID NO: 45499 - DNA, 20 bp, Artificial Sequence
  Description of Artificial Sequence: Synthetic oligonucleotide
  Target: ATXN1; (-) strand; PAM type: NRG; PAM sequence: AGG
ctcagcctccctggaattac

SEQ ID NO: 45500 - DNA, 20 bp, Artificial Sequence
  Description of Artificial Sequence: Synthetic oligonucleotide
  Target: ATXN1; (-) strand; PAM type: NRG; PAM sequence: CAG
cctcagcctccctggaatta

SEQ ID NO: 45501 - DNA, 20 bp, Artificial Sequence
  Description of Artificial Sequence: Synthetic oligonucleotide
  Target: ATXN1; (-) strand; PAM type: NRG; PAM sequence: TGG
ttcttctgcctcagcctccc

SEQ ID NO: 45502 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattcttctgcct

SEQ ID NO: 45503 - DNA, 20 bp, Artificial Sequence
  Description of Artificial Sequence: Synthetic oligonucleotide
  Target: ATXN1; (-) strand; PAM type: NRG; PAM sequence: AAG
aacctccacctcgcgggttc

SEQ ID NO: 45504 - DNA, 20 bp, Artificial Sequence
  Description of Artificial Sequence: Synthetic oligonucleotide
  Target: ATXN1; (-) strand; PAM type: NRG; PAM sequence: GGG
cgctgcaacctccacctcgc

SEQ ID NO: 45505 - DNA, 20 bp, Artificial Sequence
  Description of Artificial Sequence: Synthetic oligonucleotide
  Target: ATXN1; (-) strand; PAM type: NRG; PAM sequence: CGG
tcgctgcaacctccacctcg

SEQ ID NO: 45506 - DNA, 20 bp, Artificial Sequence
  Description of Artificial Sequence: Synthetic oligonucleotide
  Target: ATXN1; (-) strand; PAM type: NRG; PAM sequence: TGG
agagtgcaatggtacaatct

SEQ ID NO: 45507 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctagagtgcaa

SEQ ID NO: 45508 - DNA, 20 bp, Artificial Sequence
  Description of Artificial Sequence: Synthetic oligonucleotide
  Target: ATXN1; (-) strand; PAM type: NRG; PAM sequence: GAG
cactcctgtcgcccaggcta

SEQ ID NO: 45509 - DNA, 20 bp, Artificial Sequence
  Description of Artificial Sequence: Synthetic oligonucleotide
  Target: ATXN1; (-) strand; PAM type: NRG; PAM sequence: TAG
ttcactcctgtcgcccaggc

SEQ ID NO: 45510 - DNA, 20 bp, Artificial Sequence
  Description of Artificial Sequence: Synthetic oligonucleotide
  Target: ATXN1; (-) strand; PAM type: NRG; PAM sequence: AGG
gagtttcactcctgtcgccc

SEQ ID NO: 45511 - DNA, 20 bp, Artificial Sequence
  Description of Artificial Sequence: Synthetic oligonucleotide
  Target: ATXN1; (-) strand; PAM type: NRG; PAM sequence: CAG
agagtttcactcctgtcgcc

SEQ ID NO: 45512 - DNA, 20 bp, Artificial Sequence
  Description of Artificial Sequence: Synthetic oligonucleotide
  Target: ATXN1; (-) strand; PAM type: NRG; PAM sequence: GAG
atttttttttttctaaggca

SEQ ID NO: 45513 - DNA, 20 bp, Artificial Sequence
  Description of Artificial Sequence: Synthetic oligonucleotide
  Target: ATXN1; (-) strand; PAM type: NRG; PAM sequence: CAG
tcatttttttttttctaagg

SEQ ID NO: 45514 - DNA, 20 bp, Artificial Sequence
  Description of Artificial Sequence: Synthetic oligonucleotide
  Target: ATXN1; (-) strand; PAM type: NRG; PAM sequence: AGG
tcttcatttttttttttcta

SEQ ID NO: 45515 - DNA, 20 bp, Artificial Sequence
  Description of Artificial Sequence: Synthetic oligonucleotide
  Target: ATXN1; (-) strand; PAM type: NRG; PAM sequence: AAG
atcttcatttttttttttct

SEQ ID NO: 45516 - DNA, 20 bp, Artificial Sequence
  Description of Artificial Sequence: Synthetic oligonucleotide
  Target: ATXN1; (-) strand; PAM type: NRG; PAM sequence: AGG
cataacaacttcatgaaata

SEQ ID NO: 45517 - DNA, 20 bp, Artificial Sequence
  Description of Artificial Sequence: Synthetic oligonucleotide
  Target: ATXN1; (-) strand; PAM type: NRG; PAM sequence: AAG
tcataacaacttcatgaaat

SEQ ID NO: 45518 - DNA, 20 bp, Artificial Sequence
  Description of Artificial Sequence: Synthetic oligonucleotide
  Target: ATXN1; (-) strand; PAM type: NRG; PAM sequence: AGG
ctactgcctgcttgcatgct

SEQ ID NO: 45519 - DNA, 20 bp, Artificial Sequence
  Description of Artificial Sequence: Synthetic oligonucleotide
  Target: ATXN1; (-) strand; PAM type: NRG; PAM sequence: TAG
actactgcctgcttgcatgc

SEQ ID NO: 45520 - DNA, 20 bp, Artificial Sequence
  Description of Artificial Sequence: Synthetic oligonucleotide
  Target: ATXN1; (-) strand; PAM type: NRG; PAM sequence: AGG
atgagaggtagcattttttg

SEQ ID NO: 45521 - DNA, 20 bp, Artificial Sequence
  Description of Artificial Sequence: Synthetic oligonucleotide
  Target: ATXN1; (-) strand; PAM type: NRG; PAM sequence: GAG
catgagaggtagcatttttt

SEQ ID NO: 45522 - DNA, 20 bp, Artificial Sequence
  Description of Artificial Sequence: Synthetic oligonucleotide
  Target: ATXN1; (-) strand; PAM type: NRG; PAM sequence: TAG
aagcagttcatcatgagagg

SEQ ID NO: 45523 - DNA, 20 bp, Artificial Sequence
  Description of Artificial Sequence: Synthetic oligonucleotide
  Target: ATXN1; (-) strand; PAM type: NRG; PAM sequence: AGG
ggaaagcagttcatcatgag

SEQ ID NO: 45524 - DNA, 20 bp, Artificial Sequence
  Description of Artificial Sequence: Synthetic oligonucleotide
  Target: ATXN1; (-) strand; PAM type: NRG; PAM sequence: GAG
tggaaagcagttcatcatga

SEQ ID NO: 45525 - DNA, 20 bp, Artificial Sequence
  Description of Artificial Sequence: Synthetic oligonucleotide
  Target: ATXN1; (-) strand; PAM type: NRG; PAM sequence: GAG
actggaaagcagttcatcat

SEQ ID NO: 45526 - DNA, 20 bp, Artificial Sequence
  Description of Artificial Sequence: Synthetic oligonucleotide
  Target: ATXN1; (-) strand; PAM type: NRG; PAM sequence: CAG
aggtagtttgaactggaaag

SEQ ID NO: 45527 - DNA, 20 bp, Artificial Sequence
  Description of Artificial Sequence: Synthetic oligonucleotide
  Target: ATXN1; (-) strand; PAM type: NRG; PAM sequence: AAG
aggaggtagtttgaactgga

SEQ ID NO: 45528 - DNA, 20 bp, Artificial Sequence
  Description of Artificial Sequence: Synthetic oligonucleotide
  Target: ATXN1; (-) strand; PAM type: NRG; PAM sequence: TGG
tcataggaggtagtttgaac

SEQ ID NO: 45529 - DNA, 20 bp, Artificial Sequence
  Description of Artificial Sequence: Synthetic oligonucleotide
  Target: ATXN1; (-) strand; PAM type: NRG; PAM sequence: TAG
gctgcagcagtcataggagg

SEQ ID NO: 45530 - DNA, 20 bp, Artificial Sequence
  Description of Artificial Sequence: Synthetic oligonucleotide
  Target: ATXN1; (-) strand; PAM type: NRG; PAM sequence: AGG
tttgctgcagcagtcatagg

SEQ ID NO: 45531 - DNA, 20 bp, Artificial Sequence
  Description of Artificial Sequence: Synthetic oligonucleotide
  Target: ATXN1; (-) strand; PAM type: NRG; PAM sequence: GAG
gtttgctgcagcagtcatag

SEQ ID NO: 45532 - DNA, 20 bp, Artificial Sequence
  Description of Artificial Sequence: Synthetic oligonucleotide
  Target: ATXN1; (-) strand; PAM type: NRG; PAM sequence: AGG
ctgtttgctgcagcagtcat

SEQ ID NO: 45533 - DNA, 20 bp, Artificial Sequence
  Description of Artificial Sequence: Synthetic oligonucleotide
  Target: ATXN1; (-) strand; PAM type: NRG; PAM sequence: TAG
gctgtttgctgcagcagtca

SEQ ID NO: 45534 - DNA, 20 bp, Artificial Sequence
  Description of Artificial Sequence: Synthetic oligonucleotide
  Target: ATXN1; (-) strand; PAM type: NRG; PAM sequence: CAG
gcctgtgctgtttgctgcag

SEQ ID NO: 45535 - DNA, 20 bp, Artificial Sequence
  Description of Artificial Sequence: Synthetic oligonucleotide
  Target: ATXN1; (-) strand; PAM type: NRG; PAM sequence: CAG
caggcctgtgctgtttgctg

SEQ ID NO: 45536 - DNA, 20 bp, Artificial Sequence
  Description of Artificial Sequence: Synthetic oligonucleotide
  Target: ATXN1; (-) strand; PAM type: NRG; PAM sequence: AGG
aatcaggtggcctagatccc

SEQ ID NO: 45537 - DNA, 20 bp, Artificial Sequence
  Description of Artificial Sequence: Synthetic oligonucleotide
  Target: ATXN1; (-) strand; PAM type: NRG; PAM sequence: CAG
aaatcaggtggcctagatcc

SEQ ID NO: 45538 - DNA, 20 bp, Artificial Sequence
  Description of Artificial Sequence: Synthetic oligonucleotide
  Target: ATXN1; (-) strand; PAM type: NRG; PAM sequence: TAG
ggattccaaatcaggtggcc

SEQ ID NO: 45539 - DNA, 20 bp, Artificial Sequence
  Description of Artificial Sequence: Synthetic oligonucleotide
  Target: ATXN1; (-) strand; PAM type: NRG; PAM sequence: TGG
caccaggattccaaatcagg

SEQ ID NO: 45540 - DNA, 20 bp, Artificial Sequence
  Description of Artificial Sequence: Synthetic oligonucleotide
  Target: ATXN1; (-) strand; PAM type: NRG; PAM sequence: AGG
ggccaccaggattccaaatc

SEQ ID NO: 45541 - DNA, 20 bp, Artificial Sequence
  Description of Artificial Sequence: Synthetic oligonucleotide
  Target: ATXN1; (-) strand; PAM type: NRG; PAM sequence: CAG
aggccaccaggattccaaat

SEQ ID NO: 45542 - DNA, 20 bp, Artificial Sequence
  Description of Artificial Sequence: Synthetic oligonucleotide
  Target: ATXN1; (-) strand; PAM type: NRG; PAM sequence: AGG
agctgaggagtaaggccacc

SEQ ID NO: 45543 - DNA, 20 bp, Artificial Sequence
  Description of Artificial Sequence: Synthetic oligonucleotide
  Target: ATXN1; (-) strand; PAM type: NRG; PAM sequence: CAG
cagctgaggagtaaggccac

SEQ ID NO: 45544 - DNA, 20 bp, Artificial Sequence
  Description of Artificial Sequence: Synthetic oligonucleotide
  Target: ATXN1; (-) strand; PAM type: NRG; PAM sequence: AGG
atatacacagctgaggagta

SEQ ID NO: 45545 - DNA, 20 bp, Artificial Sequence
  Description of Artificial Sequence: Synthetic oligonucleotide
  Target: ATXN1; (-) strand; PAM type: NRG; PAM sequence: AAG
gatatacacagctgaggagt

SEQ ID NO: 45546 - DNA, 20 bp, Artificial Sequence
  Description of Artificial Sequence: Synthetic oligonucleotide
  Target: ATXN1; (-) strand; PAM type: NRG; PAM sequence: GAG
atcagatatacacagctgag

SEQ ID NO: 45547 - DNA, 20 bp, Artificial Sequence
  Description of Artificial Sequence: Synthetic oligonucleotide
  Target: ATXN1; (-) strand; PAM type: NRG; PAM sequence: AGG
gcatcagatatacacagctg

SEQ ID NO: 45548 - DNA, 20 bp, Artificial Sequence
  Description of Artificial Sequence: Synthetic oligonucleotide
  Target: ATXN1; (-) strand; PAM type: NRG; PAM sequence: GAG
tgcatcagatatacacagct

SEQ ID NO: 45549 - DNA, 20 bp, Artificial Sequence
  Description of Artificial Sequence: Synthetic oligonucleotide
  Target: ATXN1; (-) strand; PAM type: NRG; PAM sequence: CAG
taacttgcatcagatataca

SEQ ID NO: 45550 - DNA, 20 bp, Artificial Sequence
  Description of Artificial Sequence: Synthetic oligonucleotide
  Target: ATXN1; (-) strand; PAM type: NRG; PAM sequence: CAG
agaaattaattaacttgcat

SEQ ID NO: 45551 - DNA, 20 bp, Artificial Sequence
  Description of Artificial Sequence: Synthetic oligonucleotide
  Target: ATXN1; (-) strand; PAM type: NRG; PAM sequence: GAG
cctggttagtacttagatca

SEQ ID NO: 45552 - DNA, 20 bp, Artificial Sequence
  Description of Artificial Sequence: Synthetic oligonucleotide
  Target: ATXN1; (-) strand; PAM type: NRG; PAM sequence: CAG
ggcctggttagtacttagat

SEQ ID NO: 45553 - DNA, 20 bp, Artificial Sequence
  Description of Artificial Sequence: Synthetic oligonucleotide
  Target: ATXN1; (-) strand; PAM type: NRG; PAM sequence: TAG
agttaggcctggttagtact

SEQ ID NO: 45554 - DNA, 20 bp, Artificial Sequence
  Description of Artificial Sequence: Synthetic oligonucleotide
  Target: ATXN1; (-) strand; PAM type: NRG; PAM sequence: TAG
atgaattagttaggcctggt

SEQ ID NO: 45555 - DNA, 20 bp, Artificial Sequence
  Description of Artificial Sequence: Synthetic oligonucleotide
  Target: ATXN1; (-) strand; PAM type: NRG; PAM sequence: TGG
agaaatgaattagttaggcc

SEQ ID NO: 45556 - DNA, 20 bp, Artificial Sequence
  Description of Artificial Sequence: Synthetic oligonucleotide
  Target: ATXN1; (-) strand; PAM type: NRG; PAM sequence: AGG
cacagagaaatgaattagtt

SEQ ID NO: 45557 - DNA, 20 bp, Artificial Sequence
  Description of Artificial Sequence: Synthetic oligonucleotide
  Target: ATXN1; (-) strand; PAM type: NRG; PAM sequence: TAG
gcacagagaaatgaattagt

SEQ ID NO: 45558 - DNA, 20 bp, Artificial Sequence
  Description of Artificial Sequence: Synthetic oligonucleotide
  Target: ATXN1; (-) strand; PAM type: NRG; PAM sequence: TAG
tgaggcacagagaaatgaat

SEQ ID NO: 45559 - DNA, 20 bp, Artificial Sequence
  Description of Artificial Sequence: Synthetic oligonucleotide
  Target: ATXN1; (-) strand; PAM type: NRG; PAM sequence: GAG
gatgagcaaactgaggcaca

SEQ ID NO: 45560 - DNA, 20 bp, Artificial Sequence
  Description of Artificial Sequence: Synthetic oligonucleotide
  Target: ATXN1; (-) strand; PAM type: NRG; PAM sequence: CAG
gagatgagcaaactgaggca

SEQ ID NO: 45561 - DNA, 20 bp, Artificial Sequence
  Description of Artificial Sequence: Synthetic oligonucleotide
  Target: ATXN1; (-) strand; PAM type: NRG; PAM sequence: AGG
ctttggagatgagcaaactg

SEQ ID NO: 45562 - DNA, 20 bp, Artificial Sequence
  Description of Artificial Sequence: Synthetic oligonucleotide
  Target: ATXN1; (-) strand; PAM type: NRG; PAM sequence: GAG
actttggagatgagcaaact

SEQ ID NO: 45563 - DNA, 20 bp, Artificial Sequence
  Description of Artificial Sequence: Synthetic oligonucleotide
  Target: ATXN1; (-) strand; PAM type: NRG; PAM sequence: GAG
attattcccactttggagat

SEQ ID NO: 45564 - DNA, 20 bp, Artificial Sequence
  Description of Artificial Sequence: Synthetic oligonucleotide
  Target: ATXN1; (-) strand; PAM type: NRG; PAM sequence: GAG
ctagtattattcccactttg

SEQ ID NO: 45565 - DNA, 20 bp, Artificial Sequence
  Description of Artificial Sequence: Synthetic oligonucleotide
  Target: ATXN1; (-) strand; PAM type: NRG; PAM sequence: TGG
aactagtattattcccactt

SEQ ID NO: 45566 - DNA, 20 bp, Artificial Sequence
  Description of Artificial Sequence: Synthetic oligonucleotide
  Target: ATXN1; (-) strand; PAM type: NRG; PAM sequence: TAG
caagcctgtggggtaggaac

SEQ ID NO: 45567 - DNA, 20 bp, Artificial Sequence
  Description of Artificial Sequence: Synthetic oligonucleotide
  Target: ATXN1; (-) strand; PAM type: NRG; PAM sequence: AGG
tcacagcaagcctgtggggt

SEQ ID NO: 45568 - DNA, 20 bp, Artificial Sequence
  Description of Artificial Sequence: Synthetic oligonucleotide
  Target: ATXN1; (-) strand; PAM type: NRG; PAM sequence: TAG
ctcacagcaagcctgtgggg

SEQ ID NO: 45569 - DNA, 20 bp, Artificial Sequence
  Description of Artificial Sequence: Synthetic oligonucleotide
  Target: ATXN1; (-) strand; PAM type: NRG; PAM sequence: GGG
gaactcacagcaagcctgtg

SEQ ID NO: 45570 - DNA, 20 bp, Artificial Sequence
  Description of Artificial Sequence: Synthetic oligonucleotide
  Target: ATXN1; (-) strand; PAM type: NRG; PAM sequence: GGG
tgaactcacagcaagcctgt

SEQ ID NO: 45571 - DNA, 20 bp, Artificial Sequence
  Description of Artificial Sequence: Synthetic oligonucleotide
  Target: ATXN1; (-) strand; PAM type: NRG; PAM sequence: TGG
gtgaactcacagcaagcctg

SEQ ID NO: 45572 - DNA, 20 bp, Artificial Sequence
  Description of Artificial Sequence: Synthetic oligonucleotide
  Target: ATXN1; (-) strand; PAM type: NRG; PAM sequence: AAG
cttatgtgtgaactcacagc

SEQ ID NO: 45573 - DNA, 20 bp, Artificial Sequence
  Description of Artificial Sequence: Synthetic oligonucleotide
  Target: ATXN1; (-) strand; PAM type: NRG; PAM sequence: CAG
tcttcttatgtgtgaactca

SEQ ID NO: 45574 - DNA, 20 bp, Artificial Sequence
  Description of Artificial Sequence: Synthetic oligonucleotide
  Target: ATXN1; (-) strand; PAM type: NRG; PAM sequence: AGG
ttgtaggtcttgagtacgcc

SEQ ID NO: 45575 - DNA, 20 bp, Artificial Sequence
  Description of Artificial Sequence: Synthetic oligonucleotide
  Target: ATXN1; (-) strand; PAM type: NRG; PAM sequence: CAG
attgtaggtcttgagtacgc

SEQ ID NO: 45576 - DNA, 20 bp, Artificial Sequence
  Description of Artificial Sequence: Synthetic oligonucleotide
  Target: ATXN1; (-) strand; PAM type: NRG; PAM sequence: GAG
agccagtaattgtaggtctt

SEQ ID NO: 45577 - DNA, 20 bp, Artificial Sequence
  Description of Artificial Sequence: Synthetic oligonucleotide
  Target: ATXN1; (-) strand; PAM type: NRG; PAM sequence: AGG
caaccacagccagtaattgt

SEQ ID NO: 45578 - DNA, 20 bp, Artificial Sequence
  Description of Artificial Sequence: Synthetic oligonucleotide
  Target: ATXN1; (-) strand; PAM type: NRG; PAM sequence: TAG
acaaccacagccagtaattg

SEQ ID NO: 45579 - DNA, 20 bp, Artificial Sequence
  Description of Artificial Sequence: Synthetic oligonucleotide
  Target: ATXN1; (-) strand; PAM type: NRG; PAM sequence: CAG
ataatcggaacaaccacagc

SEQ ID NO: 45580 - DNA, 20 bp, Artificial Sequence
  Description of Artificial Sequence: Synthetic oligonucleotide
  Target: ATXN1; (-) strand; PAM type: NRG; PAM sequence: CAG
gaaaataatcggaacaacca

SEQ ID NO: 45581 - DNA, 20 bp, Artificial Sequence
  Description of Artificial Sequence: Synthetic oligonucleotide
  Target: ATXN1; (-) strand; PAM type: NRG; PAM sequence: CGG
ggcctttcttagaaaataat

SEQ ID NO: 45582 - DNA, 20 bp, Artificial Sequence
  Description of Artificial Sequence: Synthetic oligonucleotide
  Target: ATXN1; (-) strand; PAM type: NRG; PAM sequence: TAG
gtagagaagagggcctttct

SEQ ID NO: 45583 - DNA, 20 bp, Artificial Sequence
  Description of Artificial Sequence: Synthetic oligonucleotide
  Target: ATXN1; (-) strand; PAM type: NRG; PAM sequence: GGG
agtgaaggaggtagagaaga

SEQ ID NO: 45584 - DNA, 20 bp, Artificial Sequence
  Description of Artificial Sequence: Synthetic oligonucleotide
  Target: ATXN1; (-) strand; PAM type: NRG; PAM sequence: AGG
cagtgaaggaggtagagaag

SEQ ID NO: 45585 - DNA, 20 bp, Artificial Sequence
  Description of Artificial Sequence: Synthetic oligonucleotide
  Target: ATXN1; (-) strand; PAM type: NRG; PAM sequence: GAG
acagtgaaggaggtagagaa

SEQ ID NO: 45586 - DNA, 20 bp, Artificial Sequence
  Description of Artificial Sequence: Synthetic oligonucleotide
  Target: ATXN1; (-) strand; PAM type: NRG; PAM sequence: AAG
ccacagtgaaggaggtagag

SEQ ID NO: 45587 - DNA, 20 bp, Artificial Sequence
  Description of Artificial Sequence: Synthetic oligonucleotide
  Target: ATXN1; (-) strand; PAM type: NRG; PAM sequence: GAG
ggaccacagtgaaggaggta

SEQ ID NO: 45588 - DNA, 20 bp, Artificial Sequence
  Description of Artificial Sequence: Synthetic oligonucleotide
  Target: ATXN1; (-) strand; PAM type: NRG; PAM sequence: TAG
taggaccacagtgaaggagg

SEQ ID NO: 45589 - DNA, 20 bp, Artificial Sequence
  Description of Artificial Sequence: Synthetic oligonucleotide
  Target: ATXN1; (-) strand; PAM type: NRG; PAM sequence: AGG
aaataggaccacagtgaagg

SEQ ID NO: 45590 - DNA, 20 bp, Artificial Sequence
  Description of Artificial Sequence: Synthetic oligonucleotide
  Target: ATXN1; (-) strand; PAM type: NRG; PAM sequence: GAG
aaaataggaccacagtgaag

SEQ ID NO: 45591 - DNA, 20 bp, Artificial Sequence
  Description of Artificial Sequence: Synthetic oligonucleotide
  Target: ATXN1; (-) strand; PAM type: NRG; PAM sequence: AGG
tgaaaataggaccacagtga

SEQ ID NO: 45592 - DNA, 20 bp, Artificial Sequence
  Description of Artificial Sequence: Synthetic oligonucleotide
  Target: ATXN1; (-) strand; PAM type: NRG; PAM sequence: AAG
atgaaaataggaccacagtg

SEQ ID NO: 45593 - DNA, 20 bp, Artificial Sequence
  Description of Artificial Sequence: Synthetic oligonucleotide
  Target: ATXN1; (-) strand; PAM type: NRG; PAM sequence: CAG
tgcagatgaaaataggacca

SEQ ID NO: 45594 - DNA, 20 bp, Artificial Sequence
  Description of Artificial Sequence: Synthetic oligonucleotide
  Target: ATXN1; (-) strand; PAM type: NRG; PAM sequence: AGG
ttttttatgcagatgaaaat

SEQ ID NO: 45595 - DNA, 20 bp, Artificial Sequence
  Description of Artificial Sequence: Synthetic oligonucleotide
  Target: ATXN1; (-) strand; PAM type: NRG; PAM sequence: TAG
tttttttatgcagatgaaaa

SEQ ID NO: 45596 - DNA, 20 bp, Artificial Sequence
  Description of Artificial Sequence: Synthetic oligonucleotide
  Target: ATXN1; (-) strand; PAM type: NRG; PAM sequence: CAG
gaaaatgtgatttttttatg

SEQ ID NO: 45597 - DNA, 20 bp, Artificial Sequence
  Description of Artificial Sequence: Synthetic oligonucleotide
  Target: ATXN1; (-) strand; PAM type: NRG; PAM sequence: CAG
caggcgtgagccaccatgcc

SEQ ID NO: 45598 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 45599 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 45600 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 45601 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 45602 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaagtgc

SEQ ID NO: 45603 - DNA, 20 bp, Artificial Sequence
  Description of Artificial Sequence: Synthetic oligonucleotide
  Target: ATXN1; (-) strand; PAM type: NRG; PAM sequence: AAG
ccaccagcctcagcctccca

SEQ ID NO: 45604 - DNA, 20 bp, Artificial Sequence
  Description of Artificial Sequence: Synthetic oligonucleotide
  Target: ATXN1; (-) strand; PAM type: NRG; PAM sequence: CAG
atctcgtgatccaccagcct

SEQ ID NO: 45605 - DNA, 20 bp, Artificial Sequence
  Description of Artificial Sequence: Synthetic oligonucleotide
  Target: ATXN1; (-) strand; PAM type: NRG; PAM sequence: CAG
ctcttcatctcgtgatccac

SEQ ID NO: 45606 - DNA, 20 bp, Artificial Sequence
  Description of Artificial Sequence: Synthetic oligonucleotide
  Target: ATXN1; (-) strand; PAM type: NRG; PAM sequence: TGG
tgtcaccatgttggccagga

SEQ ID NO: 45607 - DNA, 20 bp, Artificial Sequence
  Description of Artificial Sequence: Synthetic oligonucleotide
  Target: ATXN1; (-) strand; PAM type: NRG; PAM sequence: AGG
aagatgtcaccatgttggcc

SEQ ID NO: 45608 - DNA, 20 bp, Artificial Sequence
  Description of Artificial Sequence: Synthetic oligonucleotide
  Target: ATXN1; (-) strand; PAM type: NRG; PAM sequence: CAG
caagatgtcaccatgttggc

SEQ ID NO: 45609 - DNA, 20 bp, Artificial Sequence
  Description of Artificial Sequence: Synthetic oligonucleotide
  Target: ATXN1; (-) strand; PAM type: NRG; PAM sequence: TGG
gaaacaagatgtcaccatgt

SEQ ID NO: 45610 - DNA, 20 bp, Artificial Sequence
  Description of Artificial Sequence: Synthetic oligonucleotide
  Target: ATXN1; (-) strand; PAM type: NRG; PAM sequence: AAG
tttgtatttttagtagaaac

SEQ ID NO: 45611 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 45612 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 45613 - DNA, 20 bp, Artificial Sequence
  Description of Artificial Sequence: Synthetic oligonucleotide
  Target: ATXN1; (-) strand; PAM type: NRG; PAM sequence: CAG
caggcacgtgccaccatgcc

SEQ ID NO: 45614 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctggaactac

SEQ ID NO: 45615 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctggaacta

SEQ ID NO: 45616 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtagc

SEQ ID NO: 45617 - DNA, 20 bp, Artificial Sequence
  Description of Artificial Sequence: Synthetic oligonucleotide
  Target: ATXN1; (-) strand; PAM type: NRG; PAM sequence: TAG
ttctgcctcagcctcccgag

SEQ ID NO: 45618 - DNA, 20 bp, Artificial Sequence
  Description of Artificial Sequence: Synthetic oligonucleotide
  Target: ATXN1; (-) strand; PAM type: NRG; PAM sequence: GAG
ttcttctgcctcagcctccc

SEQ ID NO: 45619 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattcttctgcct

SEQ ID NO: 45620 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccgggttc

SEQ ID NO: 45621 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctgcctccc

SEQ ID NO: 45622 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctctgcctcc

SEQ ID NO: 45623 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcatgatct

SEQ ID NO: 45624 - DNA, 20 bp, Artificial Sequence
  Description of Artificial Sequence: Synthetic oligonucleotide
  Target: ATXN1; (-) strand; PAM type: NRG; PAM sequence: TGG
gtcaccaggctggagtgcag

SEQ ID NO: 45625 - DNA, 20 bp, Artificial Sequence
  Description of Artificial Sequence: Synthetic oligonucleotide
  Target: ATXN1; (-) strand; PAM type: NRG; PAM sequence: CAG
tctgtcaccaggctggagtg

SEQ ID NO: 45626 - DNA, 20 bp, Artificial Sequence
  Description of Artificial Sequence: Synthetic oligonucleotide
  Target: ATXN1; (-) strand; PAM type: NRG; PAM sequence: GAG
ctcgctctgtcaccaggctg

SEQ ID NO: 45627 - DNA, 20 bp, Artificial Sequence
  Description of Artificial Sequence: Synthetic oligonucleotide
  Target: ATXN1; (-) strand; PAM type: NRG; PAM sequence: TGG
gtctcgctctgtcaccaggc

SEQ ID NO: 45628 - DNA, 20 bp, Artificial Sequence
  Description of Artificial Sequence: Synthetic oligonucleotide
  Target: ATXN1; (-) strand; PAM type: NRG; PAM sequence: AGG
cacagtctcgctctgtcacc

SEQ ID NO: 45629 - DNA, 20 bp, Artificial Sequence
  Description of Artificial Sequence: Synthetic oligonucleotide
  Target: ATXN1; (-) strand; PAM type: NRG; PAM sequence: CAG
acacagtctcgctctgtcac

SEQ ID NO: 45630 - DNA, 20 bp, Artificial Sequence
  Description of Artificial Sequence: Synthetic oligonucleotide
  Target: ATXN1; (-) strand; PAM type: NRG; PAM sequence: CAG
tttctttcttttttgagaca

SEQ ID NO: 45631 - DNA, 20 bp, Artificial Sequence
  Description of Artificial Sequence: Synthetic oligonucleotide
  Target: ATXN1; (-) strand; PAM type: NRG; PAM sequence: GAG
tttttctttctttctttttt

SEQ ID NO: 45632 - DNA, 20 bp, Artificial Sequence
  Description of Artificial Sequence: Synthetic oligonucleotide
  Target: ATXN1; (-) strand; PAM type: NRG; PAM sequence: AGG
cctgagaaagaattctaggg

SEQ ID NO: 45633 - DNA, 20 bp, Artificial Sequence
  Description of Artificial Sequence: Synthetic oligonucleotide
  Target: ATXN1; (-) strand; PAM type: NRG; PAM sequence: GAG
acctgagaaagaattctagg

SEQ ID NO: 45634 - DNA, 20 bp, Artificial Sequence
  Description of Artificial Sequence: Synthetic oligonucleotide
  Target: ATXN1; (-) strand; PAM type: NRG; PAM sequence: GGG
taacctgagaaagaattcta

SEQ ID NO: 45635 - DNA, 20 bp, Artificial Sequence
  Description of Artificial Sequence: Synthetic oligonucleotide
  Target: ATXN1; (-) strand; PAM type: NRG; PAM sequence: AGG
gtaacctgagaaagaattct

SEQ ID NO: 45636 - DNA, 20 bp, Artificial Sequence
  Description of Artificial Sequence: Synthetic oligonucleotide
  Target: ATXN1; (-) strand; PAM type: NRG; PAM sequence: TAG
agtaacctgagaaagaattc

SEQ ID NO: 45637 - DNA, 20 bp, Artificial Sequence
  Description of Artificial Sequence: Synthetic oligonucleotide
  Target: ATXN1; (-) strand; PAM type: NRG; PAM sequence: AAG
atgcaggaagtaacctgaga

SEQ ID NO: 45638 - DNA, 20 bp, Artificial Sequence
  Description of Artificial Sequence: Synthetic oligonucleotide
  Target: ATXN1; (-) strand; PAM type: NRG; PAM sequence: GAG
tatgatgcaggaagtaacct

SEQ ID NO: 45639 - DNA, 20 bp, Artificial Sequence
  Description of Artificial Sequence: Synthetic oligonucleotide
  Target: ATXN1; (-) strand; PAM type: NRG; PAM sequence: AAG
actggtgtctatgatgcagg

SEQ ID NO: 45640 - DNA, 20 bp, Artificial Sequence
  Description of Artificial Sequence: Synthetic oligonucleotide
  Target: ATXN1; (-) strand; PAM type: NRG; PAM sequence: AGG
ctgactggtgtctatgatgc

SEQ ID NO: 45641 - DNA, 20 bp, Artificial Sequence
  Description of Artificial Sequence: Synthetic oligonucleotide
  Target: ATXN1; (-) strand; PAM type: NRG; PAM sequence: CAG
gctgactggtgtctatgatg

SEQ ID NO: 45642 - DNA, 20 bp, Artificial Sequence
  Description of Artificial Sequence: Synthetic oligonucleotide
  Target: ATXN1; (-) strand; PAM type: NRG; PAM sequence: TGG
ccatctttgctggagctgac

SEQ ID NO: 45643 - DNA, 20 bp, Artificial Sequence
  Description of Artificial Sequence: Synthetic oligonucleotide
  Target: ATXN1; (-) strand; PAM type: NRG; PAM sequence: GAG
tccattcaccatctttgctg

SEQ ID NO: 45644 - DNA, 20 bp, Artificial Sequence
  Description of Artificial Sequence: Synthetic oligonucleotide
  Target: ATXN1; (-) strand; PAM type: NRG; PAM sequence: TGG
attccattcaccatctttgc

SEQ ID NO: 45645 - DNA, 20 bp, Artificial Sequence
  Description of Artificial Sequence: Synthetic oligonucleotide
  Target: ATXN1; (-) strand; PAM type: NRG; PAM sequence: GAG
ggcagggaaacttttaatga

SEQ ID NO: 45646 - DNA, 20 bp, Artificial Sequence
  Description of Artificial Sequence: Synthetic oligonucleotide
  Target: ATXN1; (-) strand; PAM type: NRG; PAM sequence: GAG
gaggcagggaaacttttaat

SEQ ID NO: 45647 - DNA, 20 bp, Artificial Sequence
  Description of Artificial Sequence: Synthetic oligonucleotide
  Target: ATXN1; (-) strand; PAM type: NRG; PAM sequence: GGG
tcatgaagggaagtgaggca

SEQ ID NO: 45648 - DNA, 20 bp, Artificial Sequence
  Description of Artificial Sequence: Synthetic oligonucleotide
  Target: ATXN1; (-) strand; PAM type: NRG; PAM sequence: AGG
ctcatgaagggaagtgaggc

SEQ ID NO: 45649 - DNA, 20 bp, Artificial Sequence
  Description of Artificial Sequence: Synthetic oligonucleotide
  Target: ATXN1; (-) strand; PAM type: NRG; PAM sequence: CAG
cctcatgaagggaagtgagg

SEQ ID NO: 45650 - DNA, 20 bp, Artificial Sequence
  Description of Artificial Sequence: Synthetic oligonucleotide
  Target: ATXN1; (-) strand; PAM type: NRG; PAM sequence: AGG
atgcctcatgaagggaagtg

SEQ ID NO: 45651 - DNA, 20 bp, Artificial Sequence
  Description of Artificial Sequence: Synthetic oligonucleotide
  Target: ATXN1; (-) strand; PAM type: NRG; PAM sequence: GAG
aatgcctcatgaagggaagt

SEQ ID NO: 45652 - DNA, 20 bp, Artificial Sequence
  Description of Artificial Sequence: Synthetic oligonucleotide
  Target: ATXN1; (-) strand; PAM type: NRG; PAM sequence: AAG
ttgaaatgcctcatgaaggg

SEQ ID NO: 45653 - DNA, 20 bp, Artificial Sequence
  Description of Artificial Sequence: Synthetic oligonucleotide
  Target: ATXN1; (-) strand; PAM type: NRG; PAM sequence: GGG
gacttgaaatgcctcatgaa

SEQ ID NO: 45654 - DNA, 20 bp, Artificial Sequence
  Description of Artificial Sequence: Synthetic oligonucleotide
  Target: ATXN1; (-) strand; PAM type: NRG; PAM sequence: AGG
agacttgaaatgcctcatga

SEQ ID NO: 45655 - DNA, 20 bp, Artificial Sequence
  Description of Artificial Sequence: Synthetic oligonucleotide
  Target: ATXN1; (-) strand; PAM type: NRG; PAM sequence: AAG
aagacttgaaatgcctcatg

SEQ ID NO: 45656 - DNA, 20 bp, Artificial Sequence
  Description of Artificial Sequence: Synthetic oligonucleotide
  Target: ATXN1; (-) strand; PAM type: NRG; PAM sequence: AAG
agtaaactttctgaaccggt

SEQ ID NO: 45657 - DNA, 20 bp, Artificial Sequence
  Description of Artificial Sequence: Synthetic oligonucleotide
  Target: ATXN1; (-) strand; PAM type: NRG; PAM sequence: CGG
acttagtaaactttctgaac

SEQ ID NO: 45658 - DNA, 20 bp, Artificial Sequence
  Description of Artificial Sequence: Synthetic oligonucleotide
  Target: ATXN1; (-) strand; PAM type: NRG; PAM sequence: TAG
agaagacaattttagagact

SEQ ID NO: 45659 - DNA, 20 bp, Artificial Sequence
  Description of Artificial Sequence: Synthetic oligonucleotide
  Target: ATXN1; (-) strand; PAM type: NRG; PAM sequence: GAG
tctaaaagaagacaatttta

SEQ ID NO: 45660 - DNA, 20 bp, Artificial Sequence
  Description of Artificial Sequence: Synthetic oligonucleotide
  Target: ATXN1; (-) strand; PAM type: NRG; PAM sequence: TAG
tttctaaaagaagacaattt

SEQ ID NO: 45661 - DNA, 20 bp, Artificial Sequence
  Description of Artificial Sequence: Synthetic oligonucleotide
  Target: ATXN1; (-) strand; PAM type: NRG; PAM sequence: AAG
tgtggagtattttctaaaag

SEQ ID NO: 45662 - DNA, 20 bp, Artificial Sequence
  Description of Artificial Sequence: Synthetic oligonucleotide
  Target: ATXN1; (-) strand; PAM type: NRG; PAM sequence: AAG
tagtgtggagtattttctaa

SEQ ID NO: 45663 - DNA, 20 bp, Artificial Sequence
  Description of Artificial Sequence: Synthetic oligonucleotide
  Target: ATXN1; (-) strand; PAM type: NRG; PAM sequence: GAG
aaaatcagtgcactagtgtg

SEQ ID NO: 45664 - DNA, 20 bp, Artificial Sequence
  Description of Artificial Sequence: Synthetic oligonucleotide
  Target: ATXN1; (-) strand; PAM type: NRG; PAM sequence: TGG
aaaaaatcagtgcactagtg

SEQ ID NO: 45665 - DNA, 20 bp, Artificial Sequence
  Description of Artificial Sequence: Synthetic oligonucleotide
  Target: ATXN1; (-) strand; PAM type: NRG; PAM sequence: TAG
ggaaaaaaaaatcagtgcac

SEQ ID NO: 45666 - DNA, 20 bp, Artificial Sequence
  Description of Artificial Sequence: Synthetic oligonucleotide
  Target: ATXN1; (-) strand; PAM type: NRG; PAM sequence: CAG
gtttagggggaaaaaaaaat

SEQ ID NO: 45667 - DNA, 20 bp, Artificial Sequence
  Description of Artificial Sequence: Synthetic oligonucleotide
  Target: ATXN1; (-) strand; PAM type: NRG; PAM sequence: GGG
aggctttggtccagtttagg

SEQ ID NO: 45668 - DNA, 20 bp, Artificial Sequence
  Description of Artificial Sequence: Synthetic oligonucleotide
  Target: ATXN1; (-) strand; PAM type: NRG; PAM sequence: GGG
aaggctttggtccagtttag

SEQ ID NO: 45669 - DNA, 20 bp, Artificial Sequence
  Description of Artificial Sequence: Synthetic oligonucleotide
  Target: ATXN1; (-) strand; PAM type: NRG; PAM sequence: GGG
caaggctttggtccagttta

SEQ ID NO: 45670 - DNA, 20 bp, Artificial Sequence
  Description of Artificial Sequence: Synthetic oligonucleotide
  Target: ATXN1; (-) strand; PAM type: NRG; PAM sequence: AGG
acaaggctttggtccagttt

SEQ ID NO: 45671 - DNA, 20 bp, Artificial Sequence
  Description of Artificial Sequence: Synthetic oligonucleotide
  Target: ATXN1; (-) strand; PAM type: NRG; PAM sequence: TAG
aacaaggctttggtccagtt

SEQ ID NO: 45672 - DNA, 20 bp, Artificial Sequence
  Description of Artificial Sequence: Synthetic oligonucleotide
  Target: ATXN1; (-) strand; PAM type: NRG; PAM sequence: CAG
ctgcaaacaaggctttggtc

SEQ ID NO: 45673 - DNA, 20 bp, Artificial Sequence
  Description of Artificial Sequence: Synthetic oligonucleotide
  Target: ATXN1; (-) strand; PAM type: NRG; PAM sequence: TGG
ttgttctgcaaacaaggctt

SEQ ID NO: 45674 - DNA, 20 bp, Artificial Sequence
  Description of Artificial Sequence: Synthetic oligonucleotide
  Target: ATXN1; (-) strand; PAM type: NRG; PAM sequence: AGG
gaccatttgttctgcaaaca

SEQ ID NO: 45675 - DNA, 20 bp, Artificial Sequence
  Description of Artificial Sequence: Synthetic oligonucleotide
  Target: ATXN1; (-) strand; PAM type: NRG; PAM sequence: AAG
tgaccatttgttctgcaaac

SEQ ID NO: 45676 - DNA, 20 bp, Artificial Sequence
  Description of Artificial Sequence: Synthetic oligonucleotide
  Target: ATXN1; (-) strand; PAM type: NRG; PAM sequence: TAG
ttgaattttatttttgaatg

SEQ ID NO: 45677 - DNA, 20 bp, Artificial Sequence
  Description of Artificial Sequence: Synthetic oligonucleotide
  Target: ATXN1; (-) strand; PAM type: NRG; PAM sequence: GAG
catacttaaattgaaaacat

SEQ ID NO: 45678 - DNA, 20 bp, Artificial Sequence
  Description of Artificial Sequence: Synthetic oligonucleotide
  Target: ATXN1; (-) strand; PAM type: NRG; PAM sequence: CAG
aaggaataaacagcaaacaa

SEQ ID NO: 45679 - DNA, 20 bp, Artificial Sequence
  Description of Artificial Sequence: Synthetic oligonucleotide
  Target: ATXN1; (-) strand; PAM type: NRG; PAM sequence: CAG
atttataccaaaggaataaa

SEQ ID NO: 45680 - DNA, 20 bp, Artificial Sequence
  Description of Artificial Sequence: Synthetic oligonucleotide
  Target: ATXN1; (-) strand; PAM type: NRG; PAM sequence: AGG
aaagcttctatttataccaa

SEQ ID NO: 45681 - DNA, 20 bp, Artificial Sequence
  Description of Artificial Sequence: Synthetic oligonucleotide
  Target: ATXN1; (-) strand; PAM type: NRG; PAM sequence: AAG
gaaagcttctatttatacca

SEQ ID NO: 45682 - DNA, 20 bp, Artificial Sequence
  Description of Artificial Sequence: Synthetic oligonucleotide
  Target: ATXN1; (-) strand; PAM type: NRG; PAM sequence: AAG
ctgcgttcaaataagccaga

SEQ ID NO: 45683 - DNA, 20 bp, Artificial Sequence
  Description of Artificial Sequence: Synthetic oligonucleotide
  Target: ATXN1; (-) strand; PAM type: NRG; PAM sequence: CAG
tgttctgcgttcaaataagc

SEQ ID NO: 45684 - DNA, 20 bp, Artificial Sequence
  Description of Artificial Sequence: Synthetic oligonucleotide
  Target: ATXN1; (-) strand; PAM type: NRG; PAM sequence: AAG
tatgtgttctgcgttcaaat

SEQ ID NO: 45685 - DNA, 20 bp, Artificial Sequence
  Description of Artificial Sequence: Synthetic oligonucleotide
  Target: ATXN1; (-) strand; PAM type: NRG; PAM sequence: CAG
aatgaataattgtatctaaa

SEQ ID NO: 45686 - DNA, 20 bp, Artificial Sequence
  Description of Artificial Sequence: Synthetic oligonucleotide
  Target: ATXN1; (-) strand; PAM type: NRG; PAM sequence: AAG
catggtattctaaaaaggaa

SEQ ID NO: 45687 - DNA, 20 bp, Artificial Sequence
  Description of Artificial Sequence: Synthetic oligonucleotide
  Target: ATXN1; (-) strand; PAM type: NRG; PAM sequence: AGG
tagggcatggtattctaaaa

SEQ ID NO: 45688 - DNA, 20 bp, Artificial Sequence
  Description of Artificial Sequence: Synthetic oligonucleotide
  Target: ATXN1; (-) strand; PAM type: NRG; PAM sequence: AAG
ttagggcatggtattctaaa

SEQ ID NO: 45689 - DNA, 20 bp, Artificial Sequence
  Description of Artificial Sequence: Synthetic oligonucleotide
  Target: ATXN1; (-) strand; PAM type: NRG; PAM sequence: TGG
tagagattctagttagggca

SEQ ID NO: 45690 - DNA, 20 bp, Artificial Sequence
  Description of Artificial Sequence: Synthetic oligonucleotide
  Target: ATXN1; (-) strand; PAM type: NRG; PAM sequence: GGG
tgttgtagagattctagtta

SEQ ID NO: 45691 - DNA, 20 bp, Artificial Sequence
  Description of Artificial Sequence: Synthetic oligonucleotide
  Target: ATXN1; (-) strand; PAM type: NRG; PAM sequence: AGG
atgttgtagagattctagtt

SEQ ID NO: 45692 - DNA, 20 bp, Artificial Sequence
  Description of Artificial Sequence: Synthetic oligonucleotide
  Target: ATXN1; (-) strand; PAM type: NRG; PAM sequence: TAG
aatgttgtagagattctagt

SEQ ID NO: 45693 - DNA, 20 bp, Artificial Sequence
  Description of Artificial Sequence: Synthetic oligonucleotide
  Target: ATXN1; (-) strand; PAM type: NRG; PAM sequence: TAG
ttataatgttgtagagattc

SEQ ID NO: 45694 - DNA, 20 bp, Artificial Sequence
  Description of Artificial Sequence: Synthetic oligonucleotide
  Target: ATXN1; (-) strand; PAM type: NRG; PAM sequence: GAG
tatgtttttataatgttgta

SEQ ID NO: 45695 - DNA, 20 bp, Artificial Sequence
  Description of Artificial Sequence: Synthetic oligonucleotide
  Target: ATXN1; (-) strand; PAM type: NRG; PAM sequence: TAG
tttatgtttttataatgttg

SEQ ID NO: 45696 - DNA, 20 bp, Artificial Sequence
  Description of Artificial Sequence: Synthetic oligonucleotide
  Target: ATXN1; (-) strand; PAM type: NRG; PAM sequence: TAG
agggccttaaattaaatcgt

SEQ ID NO: 45697 - DNA, 20 bp, Artificial Sequence
  Description of Artificial Sequence: Synthetic oligonucleotide
  Target: ATXN1; (-) strand; PAM type: NRG; PAM sequence: GGG
ttatctttcattgggaatta

SEQ ID NO: 45698 - DNA, 20 bp, Artificial Sequence
  Description of Artificial Sequence: Synthetic oligonucleotide
  Target: ATXN1; (-) strand; PAM type: NRG; PAM sequence: AGG
tttatctttcattgggaatt

SEQ ID NO: 45699 - DNA, 20 bp, Artificial Sequence
  Description of Artificial Sequence: Synthetic oligonucleotide
  Target: ATXN1; (-) strand; PAM type: NRG; PAM sequence: TAG
atttatctttcattgggaat

SEQ ID NO: 45700 - DNA, 20 bp, Artificial Sequence
  Description of Artificial Sequence: Synthetic oligonucleotide
  Target: ATXN1; (-) strand; PAM type: NRG; PAM sequence: GGG
agcattatttatctttcatt

SEQ ID NO: 45701 - DNA, 20 bp, Artificial Sequence
  Description of Artificial Sequence: Synthetic oligonucleotide
  Target: ATXN1; (-) strand; PAM type: NRG; PAM sequence: TGG
cagcattatttatctttcat

SEQ ID NO: 45702 - DNA, 20 bp, Artificial Sequence
  Description of Artificial Sequence: Synthetic oligonucleotide
  Target: ATXN1; (-) strand; PAM type: NRG; PAM sequence: CAG
acagtcattggtgcctacag

SEQ ID NO: 45703 - DNA, 20 bp, Artificial Sequence
  Description of Artificial Sequence: Synthetic oligonucleotide
  Target: ATXN1; (-) strand; PAM type: NRG; PAM sequence: CAG
attacagtcattggtgccta

SEQ ID NO: 45704 - DNA, 20 bp, Artificial Sequence
  Description of Artificial Sequence: Synthetic oligonucleotide
  Target: ATXN1; (-) strand; PAM type: NRG; PAM sequence: TGG
cctgtttagattacagtcat

SEQ ID NO: 45705 - DNA, 20 bp, Artificial Sequence
  Description of Artificial Sequence: Synthetic oligonucleotide
  Target: ATXN1; (-) strand; PAM type: NRG; PAM sequence: CAG
tttattgcctgtttagatta

SEQ ID NO: 45706 - DNA, 20 bp, Artificial Sequence
  Description of Artificial Sequence: Synthetic oligonucleotide
  Target: ATXN1; (-) strand; PAM type: NRG; PAM sequence: TAG
taaatattttattgcctgtt

SEQ ID NO: 45707 - DNA, 20 bp, Artificial Sequence
  Description of Artificial Sequence: Synthetic oligonucleotide
  Target: ATXN1; (-) strand; PAM type: NRG; PAM sequence: GAG
atgagctttgttgtaaacag

SEQ ID NO: 45708 - DNA, 20 bp, Artificial Sequence
  Description of Artificial Sequence: Synthetic oligonucleotide
  Target: ATXN1; (-) strand; PAM type: NRG; PAM sequence: AGG
aaatgagctttgttgtaaac

SEQ ID NO: 45709 - DNA, 20 bp, Artificial Sequence
  Description of Artificial Sequence: Synthetic oligonucleotide
  Target: ATXN1; (-) strand; PAM type: NRG; PAM sequence: CAG
aaaatgagctttgttgtaaa

SEQ ID NO: 45710 - DNA, 20 bp, Artificial Sequence
  Description of Artificial Sequence: Synthetic oligonucleotide
  Target: ATXN1; (-) strand; PAM type: NRG; PAM sequence: GAG
acagtgctagtatagaaaat

SEQ ID NO: 45711 - DNA, 20 bp, Artificial Sequence
  Description of Artificial Sequence: Synthetic oligonucleotide
  Target: ATXN1; (-) strand; PAM type: NRG; PAM sequence: TAG
ccacgtccacagtgctagta

SEQ ID NO: 45712 - DNA, 20 bp, Artificial Sequence
  Description of Artificial Sequence: Synthetic oligonucleotide
  Target: ATXN1; (-) strand; PAM type: NRG; PAM sequence: TAG
atcttccacgtccacagtgc

SEQ ID NO: 45713 - DNA, 20 bp, Artificial Sequence
  Description of Artificial Sequence: Synthetic oligonucleotide
  Target: ATXN1; (-) strand; PAM type: NRG; PAM sequence: CAG
aactgcatcttccacgtcca

SEQ ID NO: 45714 - DNA, 20 bp, Artificial Sequence
  Description of Artificial Sequence: Synthetic oligonucleotide
  Target: ATXN1; (-) strand; PAM type: NRG; PAM sequence: AGG
gaggaaactgaggcttacag

SEQ ID NO: 45715 - DNA, 20 bp, Artificial Sequence
  Description of Artificial Sequence: Synthetic oligonucleotide
  Target: ATXN1; (-) strand; PAM type: NRG; PAM sequence: GAG
tgaggaaactgaggcttaca

SEQ ID NO: 45716 - DNA, 20 bp, Artificial Sequence
  Description of Artificial Sequence: Synthetic oligonucleotide
  Target: ATXN1; (-) strand; PAM type: NRG; PAM sequence: CAG
gatgaggaaactgaggctta

SEQ ID NO: 45717 - DNA, 20 bp, Artificial Sequence
  Description of Artificial Sequence: Synthetic oligonucleotide
  Target: ATXN1; (-) strand; PAM type: NRG; PAM sequence: AGG
tattccagatgaggaaactg

SEQ ID NO: 45718 - DNA, 20 bp, Artificial Sequence
  Description of Artificial Sequence: Synthetic oligonucleotide
  Target: ATXN1; (-) strand; PAM type: NRG; PAM sequence: GAG
atattccagatgaggaaact

SEQ ID NO: 45719 - DNA, 20 bp, Artificial Sequence
  Description of Artificial Sequence: Synthetic oligonucleotide
  Target: ATXN1; (-) strand; PAM type: NRG; PAM sequence: AGG
tcattcacatattccagatg

SEQ ID NO: 45720 - DNA, 20 bp, Artificial Sequence
  Description of Artificial Sequence: Synthetic oligonucleotide
  Target: ATXN1; (-) strand; PAM type: NRG; PAM sequence: GAG
atcattcacatattccagat

SEQ ID NO: 45721 - DNA, 20 bp, Artificial Sequence
  Description of Artificial Sequence: Synthetic oligonucleotide
  Target: ATXN1; (-) strand; PAM type: NRG; PAM sequence: CAG
ttatcatcattcacatattc

SEQ ID NO: 45722 - DNA, 20 bp, Artificial Sequence
  Description of Artificial Sequence: Synthetic oligonucleotide
  Target: ATXN1; (-) strand; PAM type: NRG; PAM sequence: TAG
ttttcttatgctaggcatta

SEQ ID NO: 45723 - DNA, 20 bp, Artificial Sequence
  Description of Artificial Sequence: Synthetic oligonucleotide
  Target: ATXN1; (-) strand; PAM type: NRG; PAM sequence: AGG
tggattttttttcttatgct

SEQ ID NO: 45724 - DNA, 20 bp, Artificial Sequence
  Description of Artificial Sequence: Synthetic oligonucleotide
  Target: ATXN1; (-) strand; PAM type: NRG; PAM sequence: TAG
ctggattttttttcttatgc

SEQ ID NO: 45725 - DNA, 20 bp, Artificial Sequence
  Description of Artificial Sequence: Synthetic oligonucleotide
  Target: ATXN1; (-) strand; PAM type: NRG; PAM sequence: TGG
ttcaggaagaagaacacacc

SEQ ID NO: 45726 - DNA, 20 bp, Artificial Sequence
  Description of Artificial Sequence: Synthetic oligonucleotide
  Target: ATXN1; (-) strand; PAM type: NRG; PAM sequence: AAG
tgagactgaagttcaggaag

SEQ ID NO: 45727 - DNA, 20 bp, Artificial Sequence
  Description of Artificial Sequence: Synthetic oligonucleotide
  Target: ATXN1; (-) strand; PAM type: NRG; PAM sequence: AAG
agctgagactgaagttcagg

SEQ ID NO: 45728 - DNA, 20 bp, Artificial Sequence
  Description of Artificial Sequence: Synthetic oligonucleotide
  Target: ATXN1; (-) strand; PAM type: NRG; PAM sequence: AGG
ttgagctgagactgaagttc

SEQ ID NO: 45729 - DNA, 20 bp, Artificial Sequence
  Description of Artificial Sequence: Synthetic oligonucleotide
  Target: ATXN1; (-) strand; PAM type: NRG; PAM sequence: CAG
cttgagctgagactgaagtt

SEQ ID NO: 45730 - DNA, 20 bp, Artificial Sequence
  Description of Artificial Sequence: Synthetic oligonucleotide
  Target: ATXN1; (-) strand; PAM type: NRG; PAM sequence: AAG
agactcttgagctgagactg

SEQ ID NO: 45731 - DNA, 20 bp, Artificial Sequence
  Description of Artificial Sequence: Synthetic oligonucleotide
  Target: ATXN1; (-) strand; PAM type: NRG; PAM sequence: GAG
tcctcacagactcttgagct

SEQ ID NO: 45732 - DNA, 20 bp, Artificial Sequence
  Description of Artificial Sequence: Synthetic oligonucleotide
  Target: ATXN1; (-) strand; PAM type: NRG; PAM sequence: GAG
gaaattcctcacagactctt

SEQ ID NO: 45733 - DNA, 20 bp, Artificial Sequence
  Description of Artificial Sequence: Synthetic oligonucleotide
  Target: ATXN1; (-) strand; PAM type: NRG; PAM sequence: CAG
atccaagtggaaattcctca

SEQ ID NO: 45734 - DNA, 20 bp, Artificial Sequence
  Description of Artificial Sequence: Synthetic oligonucleotide
  Target: ATXN1; (-) strand; PAM type: NRG; PAM sequence: TGG
aggggtggtaagcatccaag

SEQ ID NO: 45735 - DNA, 20 bp, Artificial Sequence
  Description of Artificial Sequence: Synthetic oligonucleotide
  Target: ATXN1; (-) strand; PAM type: NRG; PAM sequence: AAG
gagaggggtggtaagcatcc

SEQ ID NO: 45736 - DNA, 20 bp, Artificial Sequence
  Description of Artificial Sequence: Synthetic oligonucleotide
  Target: ATXN1; (-) strand; PAM type: NRG; PAM sequence: AAG
gctgatttgagaggggtggt

SEQ ID NO: 45737 - DNA, 20 bp, Artificial Sequence
  Description of Artificial Sequence: Synthetic oligonucleotide
  Target: ATXN1; (-) strand; PAM type: NRG; PAM sequence: TGG
gcatgctgatttgagagggg

SEQ ID NO: 45738 - DNA, 20 bp, Artificial Sequence
  Description of Artificial Sequence: Synthetic oligonucleotide
  Target: ATXN1; (-) strand; PAM type: NRG; PAM sequence: GGG
agtgcatgctgatttgagag

SEQ ID NO: 45739 - DNA, 20 bp, Artificial Sequence
  Description of Artificial Sequence: Synthetic oligonucleotide
  Target: ATXN1; (-) strand; PAM type: NRG; PAM sequence: GGG
gagtgcatgctgatttgaga

SEQ ID NO: 45740 - DNA, 20 bp, Artificial Sequence
  Description of Artificial Sequence: Synthetic oligonucleotide
  Target: ATXN1; (-) strand; PAM type: NRG; PAM sequence: AGG
ggagtgcatgctgatttgag

SEQ ID NO: 45741 - DNA, 20 bp, Artificial Sequence
  Description of Artificial Sequence: Synthetic oligonucleotide
  Target: ATXN1; (-) strand; PAM type: NRG; PAM sequence: GAG
cggagtgcatgctgatttga

SEQ ID NO: 45742 - DNA, 20 bp, Artificial Sequence
  Description of Artificial Sequence: Synthetic oligonucleotide
  Target: ATXN1; (-) strand; PAM type: NRG; PAM sequence: GAG
accggagtgcatgctgattt

SEQ ID NO: 45743 - DNA, 20 bp, Artificial Sequence
  Description of Artificial Sequence: Synthetic oligonucleotide
  Target: ATXN1; (-) strand; PAM type: NRG; PAM sequence: GAG
ttagcagaaatatggaaccg

SEQ ID NO: 45744 - DNA, 20 bp, Artificial Sequence
  Description of Artificial Sequence: Synthetic oligonucleotide
  Target: ATXN1; (-) strand; PAM type: NRG; PAM sequence: CGG
cgttagcagaaatatggaac

SEQ ID NO: 45745 - DNA, 20 bp, Artificial Sequence
  Description of Artificial Sequence: Synthetic oligonucleotide
  Target: ATXN1; (-) strand; PAM type: NRG; PAM sequence: TGG
caaaaccgttagcagaaata

SEQ ID NO: 45746 - DNA, 20 bp, Artificial Sequence
  Description of Artificial Sequence: Synthetic oligonucleotide
  Target: ATXN1; (-) strand; PAM type: NRG; PAM sequence: CAG
aaatggtgcaaaaccgttag

SEQ ID NO: 45747 - DNA, 20 bp, Artificial Sequence
  Description of Artificial Sequence: Synthetic oligonucleotide
  Target: ATXN1; (-) strand; PAM type: NRG; PAM sequence: TAG
gagaaatggtgcaaaaccgt

SEQ ID NO: 45748 - DNA, 20 bp, Artificial Sequence
  Description of Artificial Sequence: Synthetic oligonucleotide
  Target: ATXN1; (-) strand; PAM type: NRG; PAM sequence: TGG
ctggcctatgcttggagaaa

SEQ ID NO: 45749 - DNA, 20 bp, Artificial Sequence
  Description of Artificial Sequence: Synthetic oligonucleotide
  Target: ATXN1; (-) strand; PAM type: NRG; PAM sequence: GAG
caggctctggcctatgcttg

SEQ ID NO: 45750 - DNA, 20 bp, Artificial Sequence
  Description of Artificial Sequence: Synthetic oligonucleotide
  Target: ATXN1; (-) strand; PAM type: NRG; PAM sequence: TGG
atcaggctctggcctatgct

SEQ ID NO: 45751 - DNA, 20 bp, Artificial Sequence
  Description of Artificial Sequence: Synthetic oligonucleotide
  Target: ATXN1; (-) strand; PAM type: NRG; PAM sequence: TGG
aggtatcaaatatcaggctc

SEQ ID NO: 45752 - DNA, 20 bp, Artificial Sequence
  Description of Artificial Sequence: Synthetic oligonucleotide
  Target: ATXN1; (-) strand; PAM type: NRG; PAM sequence: AGG
cgagagaggtatcaaatatc

SEQ ID NO: 45753 - DNA, 20 bp, Artificial Sequence
  Description of Artificial Sequence: Synthetic oligonucleotide
  Target: ATXN1; (-) strand; PAM type: NRG; PAM sequence: CAG
gcgagagaggtatcaaatat

SEQ ID NO: 45754 - DNA, 20 bp, Artificial Sequence
  Description of Artificial Sequence: Synthetic oligonucleotide
  Target: ATXN1; (-) strand; PAM type: NRG; PAM sequence: AGG
ataggagtgaagtgcgagag

SEQ ID NO: 45755 - DNA, 20 bp, Artificial Sequence
  Description of Artificial Sequence: Synthetic oligonucleotide
  Target: ATXN1; (-) strand; PAM type: NRG; PAM sequence: GAG
tataggagtgaagtgcgaga

SEQ ID NO: 45756 - DNA, 20 bp, Artificial Sequence
  Description of Artificial Sequence: Synthetic oligonucleotide
  Target: ATXN1; (-) strand; PAM type: NRG; PAM sequence: GAG
gatataggagtgaagtgcga

SEQ ID NO: 45757 - DNA, 20 bp, Artificial Sequence
  Description of Artificial Sequence: Synthetic oligonucleotide
  Target: ATXN1; (-) strand; PAM type: NRG; PAM sequence: GAG
tggatataggagtgaagtgc

SEQ ID NO: 45758 - DNA, 20 bp, Artificial Sequence
  Description of Artificial Sequence: Synthetic oligonucleotide
  Target: ATXN1; (-) strand; PAM type: NRG; PAM sequence: AAG
agtcgctggatataggagtg

SEQ ID NO: 45759 - DNA, 20 bp, Artificial Sequence
  Description of Artificial Sequence: Synthetic oligonucleotide
  Target: ATXN1; (-) strand; PAM type: NRG; PAM sequence: GAG
aggggagtcgctggatatag

SEQ ID NO: 45760 - DNA, 20 bp, Artificial Sequence
  Description of Artificial Sequence: Synthetic oligonucleotide
  Target: ATXN1; (-) strand; PAM type: NRG; PAM sequence: AGG
ttaggggagtcgctggatat

SEQ ID NO: 45761 - DNA, 20 bp, Artificial Sequence
  Description of Artificial Sequence: Synthetic oligonucleotide
  Target: ATXN1; (-) strand; PAM type: NRG; PAM sequence: TAG
attaggggagtcgctggata

SEQ ID NO: 45762 - DNA, 20 bp, Artificial Sequence
  Description of Artificial Sequence: Synthetic oligonucleotide
  Target: ATXN1; (-) strand; PAM type: NRG; PAM sequence: TGG
gacacaattaggggagtcgc

SEQ ID NO: 45763 - DNA, 20 bp, Artificial Sequence
  Description of Artificial Sequence: Synthetic oligonucleotide
  Target: ATXN1; (-) strand; PAM type: NRG; PAM sequence: GAG
aaagactgacacaattaggg

SEQ ID NO: 45764 - DNA, 20 bp, Artificial Sequence
  Description of Artificial Sequence: Synthetic oligonucleotide
  Target: ATXN1; (-) strand; PAM type: NRG; PAM sequence: GGG
agaaagactgacacaattag

SEQ ID NO: 45765 - DNA, 20 bp, Artificial Sequence
  Description of Artificial Sequence: Synthetic oligonucleotide
  Target: ATXN1; (-) strand; PAM type: NRG; PAM sequence: GGG
aagaaagactgacacaatta

SEQ ID NO: 45766 - DNA, 20 bp, Artificial Sequence
  Description of Artificial Sequence: Synthetic oligonucleotide
  Target: ATXN1; (-) strand; PAM type: NRG; PAM sequence: AGG
gaagaaagactgacacaatt

SEQ ID NO: 45767 - DNA, 20 bp, Artificial Sequence
  Description of Artificial Sequence: Synthetic oligonucleotide
  Target: ATXN1; (-) strand; PAM type: NRG; PAM sequence: TAG
tgaagaaagactgacacaat

SEQ ID NO: 45768 - DNA, 20 bp, Artificial Sequence
  Description of Artificial Sequence: Synthetic oligonucleotide
  Target: ATXN1; (-) strand; PAM type: NRG; PAM sequence: AAG
gagttgagacattttgaaga

SEQ ID NO: 45769 - DNA, 20 bp, Artificial Sequence
  Description of Artificial Sequence: Synthetic oligonucleotide
  Target: ATXN1; (-) strand; PAM type: NRG; PAM sequence: AAG
ccaagagttgagacattttg

SEQ ID NO: 45770 - DNA, 20 bp, Artificial Sequence
  Description of Artificial Sequence: Synthetic oligonucleotide
  Target: ATXN1; (-) strand; PAM type: NRG; PAM sequence: GAG
caagcttcaccccaagagtt

SEQ ID NO: 45771 - DNA, 20 bp, Artificial Sequence
  Description of Artificial Sequence: Synthetic oligonucleotide
  Target: ATXN1; (-) strand; PAM type: NRG; PAM sequence: GAG
gacttcaagcttcaccccaa

SEQ ID NO: 45772 - DNA, 20 bp, Artificial Sequence
  Description of Artificial Sequence: Synthetic oligonucleotide
  Target: ATXN1; (-) strand; PAM type: NRG; PAM sequence: AAG
gagacttcaagcttcacccc

SEQ ID NO: 45773 - DNA, 20 bp, Artificial Sequence
  Description of Artificial Sequence: Synthetic oligonucleotide
  Target: ATXN1; (-) strand; PAM type: NRG; PAM sequence: AAG
atgggaaaaagagagacttc

SEQ ID NO: 45774 - DNA, 20 bp, Artificial Sequence
  Description of Artificial Sequence: Synthetic oligonucleotide
  Target: ATXN1; (-) strand; PAM type: NRG; PAM sequence: GAG
cagtaaatatgggaaaaaga

SEQ ID NO: 45775 - DNA, 20 bp, Artificial Sequence
  Description of Artificial Sequence: Synthetic oligonucleotide
  Target: ATXN1; (-) strand; PAM type: NRG; PAM sequence: GAG
cacagtaaatatgggaaaaa

SEQ ID NO: 45776 - DNA, 20 bp, Artificial Sequence
  Description of Artificial Sequence: Synthetic oligonucleotide
  Target: ATXN1; (-) strand; PAM type: NRG; PAM sequence: AAG
tacacagtaaatatgggaaa

SEQ ID NO: 45777 - DNA, 20 bp, Artificial Sequence
  Description of Artificial Sequence: Synthetic oligonucleotide
  Target: ATXN1; (-) strand; PAM type: NRG; PAM sequence: GGG
ctttcctacacagtaaatat

SEQ ID NO: 45778 - DNA, 20 bp, Artificial Sequence
  Description of Artificial Sequence: Synthetic oligonucleotide
  Target: ATXN1; (-) strand; PAM type: NRG; PAM sequence: TGG
tctttcctacacagtaaata

SEQ ID NO: 45779 - DNA, 20 bp, Artificial Sequence
  Description of Artificial Sequence: Synthetic oligonucleotide
  Target: ATXN1; (-) strand; PAM type: NRG; PAM sequence: CAG
aagccaaattctttcctaca

SEQ ID NO: 45780 - DNA, 20 bp, Artificial Sequence
  Description of Artificial Sequence: Synthetic oligonucleotide
  Target: ATXN1; (-) strand; PAM type: NRG; PAM sequence: AAG
ggcagacccgtctttggcca

SEQ ID NO: 45781 - DNA, 20 bp, Artificial Sequence
  Description of Artificial Sequence: Synthetic oligonucleotide
  Target: ATXN1; (-) strand; PAM type: NRG; PAM sequence: TGG
gcaaagggcagacccgtctt

SEQ ID NO: 45782 - DNA, 20 bp, Artificial Sequence
  Description of Artificial Sequence: Synthetic oligonucleotide
  Target: ATXN1; (-) strand; PAM type: NRG; PAM sequence: CAG
caggagccaagggcaaaggg

SEQ ID NO: 45783 - DNA, 20 bp, Artificial Sequence
  Description of Artificial Sequence: Synthetic oligonucleotide
  Target: ATXN1; (-) strand; PAM type: NRG; PAM sequence: GGG
tcccaggagccaagggcaaa

SEQ ID NO: 45784 - DNA, 20 bp, Artificial Sequence
  Description of Artificial Sequence: Synthetic oligonucleotide
  Target: ATXN1; (-) strand; PAM type: NRG; PAM sequence: AGG
ttcccaggagccaagggcaa

SEQ ID NO: 45785 - DNA, 20 bp, Artificial Sequence
  Description of Artificial Sequence: Synthetic oligonucleotide
  Target: ATXN1; (-) strand; PAM type: NRG; PAM sequence: AAG
tttcccaggagccaagggca

SEQ ID NO: 45786 - DNA, 20 bp, Artificial Sequence
  Description of Artificial Sequence: Synthetic oligonucleotide
  Target: ATXN1; (-) strand; PAM type: NRG; PAM sequence: GGG
gatcatttcccaggagccaa

SEQ ID NO: 45787 - DNA, 20 bp, Artificial Sequence
  Description of Artificial Sequence: Synthetic oligonucleotide
  Target: ATXN1; (-) strand; PAM type: NRG; PAM sequence: AGG
agatcatttcccaggagcca

SEQ ID NO: 45788 - DNA, 20 bp, Artificial Sequence
  Description of Artificial Sequence: Synthetic oligonucleotide
  Target: ATXN1; (-) strand; PAM type: NRG; PAM sequence: AAG
tagatcatttcccaggagcc

SEQ ID NO: 45789 - DNA, 20 bp, Artificial Sequence
  Description of Artificial Sequence: Synthetic oligonucleotide
  Target: ATXN1; (-) strand; PAM type: NRG; PAM sequence: GAG
tcacatagatcatttcccag

SEQ ID NO: 45790 - DNA, 20 bp, Artificial Sequence
  Description of Artificial Sequence: Synthetic oligonucleotide
  Target: ATXN1; (-) strand; PAM type: NRG; PAM sequence: AGG
tatcacatagatcatttccc

SEQ ID NO: 45791 - DNA, 20 bp, Artificial Sequence
  Description of Artificial Sequence: Synthetic oligonucleotide
  Target: ATXN1; (-) strand; PAM type: NRG; PAM sequence: CAG
atatcacatagatcatttcc

SEQ ID NO: 45792 - DNA, 20 bp, Artificial Sequence
  Description of Artificial Sequence: Synthetic oligonucleotide
  Target: ATXN1; (-) strand; PAM type: NRG; PAM sequence: TAG
caccactatcagatatcaca

SEQ ID NO: 45793 - DNA, 20 bp, Artificial Sequence
  Description of Artificial Sequence: Synthetic oligonucleotide
  Target: ATXN1; (-) strand; PAM type: NRG; PAM sequence: CAG
acaaatagggacaccactat

SEQ ID NO: 45794 - DNA, 20 bp, Artificial Sequence
  Description of Artificial Sequence: Synthetic oligonucleotide
  Target: ATXN1; (-) strand; PAM type: NRG; PAM sequence: GGG
tccttccctccccacaaata

SEQ ID NO: 45795 - DNA, 20 bp, Artificial Sequence
  Description of Artificial Sequence: Synthetic oligonucleotide
  Target: ATXN1; (-) strand; PAM type: NRG; PAM sequence: AGG
atccttccctccccacaaat

SEQ ID NO: 45796 - DNA, 20 bp, Artificial Sequence
  Description of Artificial Sequence: Synthetic oligonucleotide
  Target: ATXN1; (-) strand; PAM type: NRG; PAM sequence: TAG
aatccttccctccccacaaa

SEQ ID NO: 45797 - DNA, 20 bp, Artificial Sequence
  Description of Artificial Sequence: Synthetic oligonucleotide
  Target: ATXN1; (-) strand; PAM type: NRG; PAM sequence: CGG
aggaaaccaaggcttgggtt

SEQ ID NO: 45798 - DNA, 20 bp, Artificial Sequence
  Description of Artificial Sequence: Synthetic oligonucleotide
  Target: ATXN1; (-) strand; PAM type: NRG; PAM sequence: GGG
aaatgaggaaaccaaggctt

SEQ ID NO: 45799 - DNA, 20 bp, Artificial Sequence
  Description of Artificial Sequence: Synthetic oligonucleotide
  Target: ATXN1; (-) strand; PAM type: NRG; PAM sequence: TGG
aaaatgaggaaaccaaggct

SEQ ID NO: 45800 - DNA, 20 bp, Artificial Sequence
  Description of Artificial Sequence: Synthetic oligonucleotide
  Target: ATXN1; (-) strand; PAM type: NRG; PAM sequence: AGG
attttaaaatgaggaaacca

SEQ ID NO: 45801 - DNA, 20 bp, Artificial Sequence
  Description of Artificial Sequence: Synthetic oligonucleotide
  Target: ATXN1; (-) strand; PAM type: NRG; PAM sequence: AAG
cattttaaaatgaggaaacc

SEQ ID NO: 45802 - DNA, 20 bp, Artificial Sequence
  Description of Artificial Sequence: Synthetic oligonucleotide
  Target: ATXN1; (-) strand; PAM type: NRG; PAM sequence: AGG
ccaattcccattttaaaatg

SEQ ID NO: 45803 - DNA, 20 bp, Artificial Sequence
  Description of Artificial Sequence: Synthetic oligonucleotide
  Target: ATXN1; (-) strand; PAM type: NRG; PAM sequence: GAG
gccaattcccattttaaaat

SEQ ID NO: 45804 - DNA, 20 bp, Artificial Sequence
  Description of Artificial Sequence: Synthetic oligonucleotide
  Target: ATXN1; (-) strand; PAM type: NRG; PAM sequence: CAG
caggtgtgagccaccacacc

SEQ ID NO: 45805 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggtgt

SEQ ID NO: 45806 - DNA, 20 bp, Artificial Sequence
  Description of Artificial Sequence: Synthetic oligonucleotide
  Target: ATXN1; (-) strand; PAM type: NRG; PAM sequence: AGG
tcctgaagtgctgggattac

SEQ ID NO: 45807 - DNA, 20 bp, Artificial Sequence
  Description of Artificial Sequence: Synthetic oligonucleotide
  Target: ATXN1; (-) strand; PAM type: NRG; PAM sequence: CAG
ctcctgaagtgctgggatta

SEQ ID NO: 45808 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcctgaagtgct

SEQ ID NO: 45809 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcctgaagtgc

SEQ ID NO: 45810 - DNA, 20 bp, Artificial Sequence
  Description of Artificial Sequence: Synthetic oligonucleotide
  Target: ATXN1; (-) strand; PAM type: NRG; PAM sequence: AAG
cctcctgcctcggcctcctg

SEQ ID NO: 45811 - DNA, 20 bp, Artificial Sequence
  Description of Artificial Sequence: Synthetic oligonucleotide
  Target: ATXN1; (-) strand; PAM type: NRG; PAM sequence: CGG
ctcacatagtcctcctgcct

SEQ ID NO: 45812 - DNA, 20 bp, Artificial Sequence
  Description of Artificial Sequence: Synthetic oligonucleotide
  Target: ATXN1; (-) strand; PAM type: NRG; PAM sequence: TAG
ctcgaattcctggcctcaca

SEQ ID NO: 45813 - DNA, 20 bp, Artificial Sequence
  Description of Artificial Sequence: Synthetic oligonucleotide
  Target: ATXN1; (-) strand; PAM type: NRG; PAM sequence: TGG
ccaggctggtctcgaattcc

SEQ ID NO: 45814 - DNA, 20 bp, Artificial Sequence
  Description of Artificial Sequence: Synthetic oligonucleotide
  Target: ATXN1; (-) strand; PAM type: NRG; PAM sequence: TGG
cctcactttgttacccaggc

SEQ ID NO: 45815 - DNA, 20 bp, Artificial Sequence
  Description of Artificial Sequence: Synthetic oligonucleotide
  Target: ATXN1; (-) strand; PAM type: NRG; PAM sequence: AGG
caggcctcactttgttaccc

SEQ ID NO: 45816 - DNA, 20 bp, Artificial Sequence
  Description of Artificial Sequence: Synthetic oligonucleotide
  Target: ATXN1; (-) strand; PAM type: NRG; PAM sequence: CAG
acaggcctcactttgttacc

SEQ ID NO: 45817 - DNA, 20 bp, Artificial Sequence
  Description of Artificial Sequence: Synthetic oligonucleotide
  Target: ATXN1; (-) strand; PAM type: NRG; PAM sequence: AGG
ttttattattttgtagagac

SEQ ID NO: 45818 - DNA, 20 bp, Artificial Sequence
  Description of Artificial Sequence: Synthetic oligonucleotide
  Target: ATXN1; (-) strand; PAM type: NRG; PAM sequence: CAG
tttttattattttgtagaga

SEQ ID NO: 45819 - DNA, 20 bp, Artificial Sequence
  Description of Artificial Sequence: Synthetic oligonucleotide
  Target: ATXN1; (-) strand; PAM type: NRG; PAM sequence: GAG
aatttttttattattttgta

SEQ ID NO: 45820 - DNA, 20 bp, Artificial Sequence
  Description of Artificial Sequence: Synthetic oligonucleotide
  Target: ATXN1; (-) strand; PAM type: NRG; PAM sequence: TAG
taaatttttttattattttg

SEQ ID NO: 45821 - DNA, 20 bp, Artificial Sequence
  Description of Artificial Sequence: Synthetic oligonucleotide
  Target: ATXN1; (-) strand; PAM type: NRG; PAM sequence: AAG
tcccaagttgctgggactgc

SEQ ID NO: 45822 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagttgct

SEQ ID NO: 45823 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccaagttgc

SEQ ID NO: 45824 - DNA, 20 bp, Artificial Sequence
  Description of Artificial Sequence: Synthetic oligonucleotide
  Target: ATXN1; (-) strand; PAM type: NRG; PAM sequence: AAG
tcctcccacctcagcctccc

SEQ ID NO: 45825 - DNA, 20 bp, Artificial Sequence
  Description of Artificial Sequence: Synthetic oligonucleotide
  Target: ATXN1; (-) strand; PAM type: NRG; PAM sequence: CAG
ctcaagcaatcctcccacct

SEQ ID NO: 45826 - DNA, 20 bp, Artificial Sequence
  Description of Artificial Sequence: Synthetic oligonucleotide
  Target: ATXN1; (-) strand; PAM type: NRG; PAM sequence: AAG
tgatctcccaggctaggctc

SEQ ID NO: 45827 - DNA, 20 bp, Artificial Sequence
  Description of Artificial Sequence: Synthetic oligonucleotide
  Target: ATXN1; (-) strand; PAM type: NRG; PAM sequence: AGG
cagctttgatctcccaggct

SEQ ID NO: 45828 - DNA, 20 bp, Artificial Sequence
  Description of Artificial Sequence: Synthetic oligonucleotide
  Target: ATXN1; (-) strand; PAM type: NRG; PAM sequence: TAG
gcagctttgatctcccaggc

SEQ ID NO: 45829 - DNA, 20 bp, Artificial Sequence
  Description of Artificial Sequence: Synthetic oligonucleotide
  Target: ATXN1; (-) strand; PAM type: NRG; PAM sequence: AGG
caatgcagctttgatctccc

SEQ ID NO: 45830 - DNA, 20 bp, Artificial Sequence
  Description of Artificial Sequence: Synthetic oligonucleotide
  Target: ATXN1; (-) strand; PAM type: NRG; PAM sequence: CAG
tcaatgcagctttgatctcc

SEQ ID NO: 45831 - DNA, 20 bp, Artificial Sequence
  Description of Artificial Sequence: Synthetic oligonucleotide
  Target: ATXN1; (-) strand; PAM type: NRG; PAM sequence: CAG
gccgcgatctcagctcaatg

SEQ ID NO: 45832 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtgccgcgatct

SEQ ID NO: 45833 - DNA, 20 bp, Artificial Sequence
  Description of Artificial Sequence: Synthetic oligonucleotide
  Target: ATXN1; (-) strand; PAM type: NRG; PAM sequence: CAG
ctgtctcccaggttggagtg

SEQ ID NO: 45834 - DNA, 20 bp, Artificial Sequence
  Description of Artificial Sequence: Synthetic oligonucleotide
  Target: ATXN1; (-) strand; PAM type: NRG; PAM sequence: GAG
ttgttctgtctcccaggttg

SEQ ID NO: 45835 - DNA, 20 bp, Artificial Sequence
  Description of Artificial Sequence: Synthetic oligonucleotide
  Target: ATXN1; (-) strand; PAM type: NRG; PAM sequence: TGG
tcttgttctgtctcccaggt

SEQ ID NO: 45836 - DNA, 20 bp, Artificial Sequence
  Description of Artificial Sequence: Synthetic oligonucleotide
  Target: ATXN1; (-) strand; PAM type: NRG; PAM sequence: AGG
agggtcttgttctgtctccc

SEQ ID NO: 45837 - DNA, 20 bp, Artificial Sequence
  Description of Artificial Sequence: Synthetic oligonucleotide
  Target: ATXN1; (-) strand; PAM type: NRG; PAM sequence: CAG
cagggtcttgttctgtctcc

SEQ ID NO: 45838 - DNA, 20 bp, Artificial Sequence
  Description of Artificial Sequence: Synthetic oligonucleotide
  Target: ATXN1; (-) strand; PAM type: NRG; PAM sequence: GGG
tttctttattttttgagaca

SEQ ID NO: 45839 - DNA, 20 bp, Artificial Sequence
  Description of Artificial Sequence: Synthetic oligonucleotide
  Target: ATXN1; (-) strand; PAM type: NRG; PAM sequence: AGG
ttttctttattttttgagac

SEQ ID NO: 45840 - DNA, 20 bp, Artificial Sequence
  Description of Artificial Sequence: Synthetic oligonucleotide
  Target: ATXN1; (-) strand; PAM type: NRG; PAM sequence: CAG
attttctttattttttgaga

SEQ ID NO: 45841 - DNA, 20 bp, Artificial Sequence
  Description of Artificial Sequence: Synthetic oligonucleotide
  Target: ATXN1; (-) strand; PAM type: NRG; PAM sequence: GAG
ctccattttctttatttttt

SEQ ID NO: 45842 - DNA, 20 bp, Artificial Sequence
  Description of Artificial Sequence: Synthetic oligonucleotide
  Target: ATXN1; (-) strand; PAM type: NRG; PAM sequence: GGG
gtcatcaccctaaccctgta

SEQ ID NO: 45843 - DNA, 20 bp, Artificial Sequence
  Description of Artificial Sequence: Synthetic oligonucleotide
  Target: ATXN1; (-) strand; PAM type: NRG; PAM sequence: AGG
agtcatcaccctaaccctgt

SEQ ID NO: 45844 - DNA, 20 bp, Artificial Sequence
  Description of Artificial Sequence: Synthetic oligonucleotide
  Target: ATXN1; (-) strand; PAM type: NRG; PAM sequence: TAG
tagtcatcaccctaaccctg

SEQ ID NO: 45845 - DNA, 20 bp, Artificial Sequence
  Description of Artificial Sequence: Synthetic oligonucleotide
  Target: ATXN1; (-) strand; PAM type: NRG; PAM sequence: TAG
tttgttgaatgcatctcatt

SEQ ID NO: 45846 - DNA, 20 bp, Artificial Sequence
  Description of Artificial Sequence: Synthetic oligonucleotide
  Target: ATXN1; (-) strand; PAM type: NRG; PAM sequence: AAG
aagttcctgctgaataagag

SEQ ID NO: 45847 - DNA, 20 bp, Artificial Sequence
  Description of Artificial Sequence: Synthetic oligonucleotide
  Target: ATXN1; (-) strand; PAM type: NRG; PAM sequence: GAG
ataaagttcctgctgaataa

SEQ ID NO: 45848 - DNA, 20 bp, Artificial Sequence
  Description of Artificial Sequence: Synthetic oligonucleotide
  Target: ATXN1; (-) strand; PAM type: NRG; PAM sequence: AAG
tgataaagttcctgctgaat

SEQ ID NO: 45849 - DNA, 20 bp, Artificial Sequence
  Description of Artificial Sequence: Synthetic oligonucleotide
  Target: ATXN1; (-) strand; PAM type: NRG; PAM sequence: AAG
aaaagaaatgaacattgata

SEQ ID NO: 45850 - DNA, 20 bp, Artificial Sequence
  Description of Artificial Sequence: Synthetic oligonucleotide
  Target: ATXN1; (-) strand; PAM type: NRG; PAM sequence: AAG
tctcataattataaaagaaa

SEQ ID NO: 45851 - DNA, 20 bp, Artificial Sequence
  Description of Artificial Sequence: Synthetic oligonucleotide
  Target: ATXN1; (-) strand; PAM type: NRG; PAM sequence: AAG
tcatgttctcataattataa

SEQ ID NO: 45852 - DNA, 20 bp, Artificial Sequence
  Description of Artificial Sequence: Synthetic oligonucleotide
  Target: ATXN1; (-) strand; PAM type: NRG; PAM sequence: TGG
aaatcttggcagaattctgc

SEQ ID NO: 45853 - DNA, 20 bp, Artificial Sequence
  Description of Artificial Sequence: Synthetic oligonucleotide
  Target: ATXN1; (-) strand; PAM type: NRG; PAM sequence: CAG
gaaaagactgaaaatcttgg

SEQ ID NO: 45854 - DNA, 20 bp, Artificial Sequence
  Description of Artificial Sequence: Synthetic oligonucleotide
  Target: ATXN1; (-) strand; PAM type: NRG; PAM sequence: TGG
caggaaaagactgaaaatct

SEQ ID NO: 45855 - DNA, 20 bp, Artificial Sequence
  Description of Artificial Sequence: Synthetic oligonucleotide
  Target: ATXN1; (-) strand; PAM type: NRG; PAM sequence: AAG
gctctgctgccaatcaggaa

SEQ ID NO: 45856 - DNA, 20 bp, Artificial Sequence
  Description of Artificial Sequence: Synthetic oligonucleotide
  Target: ATXN1; (-) strand; PAM type: NRG; PAM sequence: AGG
gaaatgctctgctgccaatc

SEQ ID NO: 45857 - DNA, 20 bp, Artificial Sequence
  Description of Artificial Sequence: Synthetic oligonucleotide
  Target: ATXN1; (-) strand; PAM type: NRG; PAM sequence: CAG
ggaaatgctctgctgccaat

SEQ ID NO: 45858 - DNA, 20 bp, Artificial Sequence
  Description of Artificial Sequence: Synthetic oligonucleotide
  Target: ATXN1; (-) strand; PAM type: NRG; PAM sequence: TGG
agcaaaactcaaaatgaaaa

SEQ ID NO: 45859 - DNA, 20 bp, Artificial Sequence
  Description of Artificial Sequence: Synthetic oligonucleotide
  Target: ATXN1; (-) strand; PAM type: NRG; PAM sequence: CAG
gtttcttagtagaagaatac

SEQ ID NO: 45860 - DNA, 20 bp, Artificial Sequence
  Description of Artificial Sequence: Synthetic oligonucleotide
  Target: ATXN1; (-) strand; PAM type: NRG; PAM sequence: AAG
aaaaattggtttcttagtag

SEQ ID NO: 45861 - DNA, 20 bp, Artificial Sequence
  Description of Artificial Sequence: Synthetic oligonucleotide
  Target: ATXN1; (-) strand; PAM type: NRG; PAM sequence: TAG
gggaaaaattggtttcttag

SEQ ID NO: 45862 - DNA, 20 bp, Artificial Sequence
  Description of Artificial Sequence: Synthetic oligonucleotide
  Target: ATXN1; (-) strand; PAM type: NRG; PAM sequence: TAG
tgggggaaaaattggtttct

SEQ ID NO: 45863 - DNA, 20 bp, Artificial Sequence
  Description of Artificial Sequence: Synthetic oligonucleotide
  Target: ATXN1; (-) strand; PAM type: NRG; PAM sequence: TGG
acattcactgggggaaaaat

SEQ ID NO: 45864 - DNA, 20 bp, Artificial Sequence
  Description of Artificial Sequence: Synthetic oligonucleotide
  Target: ATXN1; (-) strand; PAM type: NRG; PAM sequence: GGG
attaaaaaaacattcactgg

SEQ ID NO: 45865 - DNA, 20 bp, Artificial Sequence
  Description of Artificial Sequence: Synthetic oligonucleotide
  Target: ATXN1; (-) strand; PAM type: NRG; PAM sequence: GGG
aattaaaaaaacattcactg

SEQ ID NO: 45866 - DNA, 20 bp, Artificial Sequence
  Description of Artificial Sequence: Synthetic oligonucleotide
  Target: ATXN1; (-) strand; PAM type: NRG; PAM sequence: GGG
aaattaaaaaaacattcact

SEQ ID NO: 45867 - DNA, 20 bp, Artificial Sequence
  Description of Artificial Sequence: Synthetic oligonucleotide
  Target: ATXN1; (-) strand; PAM type: NRG; PAM sequence: TGG
gaaattaaaaaaacattcac

SEQ ID NO: 45868 - DNA, 20 bp, Artificial Sequence
  Description of Artificial Sequence: Synthetic oligonucleotide
  Target: ATXN1; (-) strand; PAM type: NRG; PAM sequence: GAG
tccagcctgtatgacagagt

SEQ ID NO: 45869 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgtatgaca

SEQ ID NO: 45870 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgtatga

SEQ ID NO: 45871 - DNA, 20 bp, Artificial Sequence
  Description of Artificial Sequence: Synthetic oligonucleotide
  Target: ATXN1; (-) strand; PAM type: NRG; PAM sequence: CAG
aagattgggccactgcactc

SEQ ID NO: 45872 - DNA, 20 bp, Artificial Sequence
  Description of Artificial Sequence: Synthetic oligonucleotide
  Target: ATXN1; (-) strand; PAM type: NRG; PAM sequence: GGG
agctacagtgagccaagatt

SEQ ID NO: 45873 - DNA, 20 bp, Artificial Sequence
  Description of Artificial Sequence: Synthetic oligonucleotide
  Target: ATXN1; (-) strand; PAM type: NRG; PAM sequence: TGG
aagctacagtgagccaagat

SEQ ID NO: 45874 - DNA, 20 bp, Artificial Sequence
  Description of Artificial Sequence: Synthetic oligonucleotide
  Target: ATXN1; (-) strand; PAM type: NRG; PAM sequence: AAG
ggtcgaagctacagtgagcc

SEQ ID NO: 45875 - DNA, 20 bp, Artificial Sequence
  Description of Artificial Sequence: Synthetic oligonucleotide
  Target: ATXN1; (-) strand; PAM type: NRG; PAM sequence: GAG
tgggaggtcgaagctacagt

SEQ ID NO: 45876 - DNA, 20 bp, Artificial Sequence
  Description of Artificial Sequence: Synthetic oligonucleotide
  Target: ATXN1; (-) strand; PAM type: NRG; PAM sequence: CAG
agcctgggaggtcgaagcta

SEQ ID NO: 45877 - DNA, 20 bp, Artificial Sequence
  Description of Artificial Sequence: Synthetic oligonucleotide
  Target: ATXN1; (-) strand; PAM type: NRG; PAM sequence: AAG
ggcttgagcctgggaggtcg

SEQ ID NO: 45878 - DNA, 20 bp, Artificial Sequence
  Description of Artificial Sequence: Synthetic oligonucleotide
  Target: ATXN1; (-) strand; PAM type: NRG; PAM sequence: AGG
gtggatggcttgagcctggg

SEQ ID NO: 45879 - DNA, 20 bp, Artificial Sequence
  Description of Artificial Sequence: Synthetic oligonucleotide
  Target: ATXN1; (-) strand; PAM type: NRG; PAM sequence: GAG
ggtggatggcttgagcctgg

SEQ ID NO: 45880 - DNA, 20 bp, Artificial Sequence
  Description of Artificial Sequence: Synthetic oligonucleotide
  Target: ATXN1; (-) strand; PAM type: NRG; PAM sequence: GGG
tgggtggatggcttgagcct

SEQ ID NO: 45881 - DNA, 20 bp, Artificial Sequence
  Description of Artificial Sequence: Synthetic oligonucleotide
  Target: ATXN1; (-) strand; PAM type: NRG; PAM sequence: TGG
gtgggtggatggcttgagcc

SEQ ID NO: 45882 - DNA, 20 bp, Artificial Sequence
  Description of Artificial Sequence: Synthetic oligonucleotide
  Target: ATXN1; (-) strand; PAM type: NRG; PAM sequence: GAG
cagaggtgggtggatggctt

SEQ ID NO: 45883 - DNA, 20 bp, Artificial Sequence
  Description of Artificial Sequence: Synthetic oligonucleotide
  Target: ATXN1; (-) strand; PAM type: NRG; PAM sequence: TGG
aagaggcagaggtgggtgga

SEQ ID NO: 45884 - DNA, 20 bp, Artificial Sequence
  Description of Artificial Sequence: Synthetic oligonucleotide
  Target: ATXN1; (-) strand; PAM type: NRG; PAM sequence: TGG
actcaagaggcagaggtggg

SEQ ID NO: 45885 - DNA, 20 bp, Artificial Sequence
  Description of Artificial Sequence: Synthetic oligonucleotide
  Target: ATXN1; (-) strand; PAM type: NRG; PAM sequence: GGG
gcaactcaagaggcagaggt

SEQ ID NO: 45886 - DNA, 20 bp, Artificial Sequence
  Description of Artificial Sequence: Synthetic oligonucleotide
  Target: ATXN1; (-) strand; PAM type: NRG; PAM sequence: TGG
agcaactcaagaggcagagg

SEQ ID NO: 45887 - DNA, 20 bp, Artificial Sequence
  Description of Artificial Sequence: Synthetic oligonucleotide
  Target: ATXN1; (-) strand; PAM type: NRG; PAM sequence: AGG
cccagcaactcaagaggcag

SEQ ID NO: 45888 - DNA, 20 bp, Artificial Sequence
  Description of Artificial Sequence: Synthetic oligonucleotide
  Target: ATXN1; (-) strand; PAM type: NRG; PAM sequence: GAG
tcccagcaactcaagaggca

SEQ ID NO: 45889 - DNA, 20 bp, Artificial Sequence
  Description of Artificial Sequence: Synthetic oligonucleotide
  Target: ATXN1; (-) strand; PAM type: NRG; PAM sequence: CAG
agtcccagcaactcaagagg

SEQ ID NO: 45890 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagcaactcaag

SEQ ID NO: 45891 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagcaactcaa

SEQ ID NO: 45892 - DNA, 20 bp, Artificial Sequence
  Description of Artificial Sequence: Synthetic oligonucleotide
  Target: ATXN1; (-) strand; PAM type: NRG; PAM sequence: AAG
gcctgtagtcccagcaactc

SEQ ID NO: 45893 - DNA, 20 bp, Artificial Sequence
  Description of Artificial Sequence: Synthetic oligonucleotide
  Target: ATXN1; (-) strand; PAM type: NRG; PAM sequence: CAG
gtggcatgcgcctgtagtcc

SEQ ID NO: 45894 - DNA, 20 bp, Artificial Sequence
  Description of Artificial Sequence: Synthetic oligonucleotide
  Target: ATXN1; (-) strand; PAM type: NRG; PAM sequence: TAG
ggcgtggtggcatgcgcctg

SEQ ID NO: 45895 - DNA, 20 bp, Artificial Sequence
  Description of Artificial Sequence: Synthetic oligonucleotide
  Target: ATXN1; (-) strand; PAM type: NRG; PAM sequence: TGG
caaaaattagctgggcgtgg

SEQ ID NO: 45896 - DNA, 20 bp, Artificial Sequence
  Description of Artificial Sequence: Synthetic oligonucleotide
  Target: ATXN1; (-) strand; PAM type: NRG; PAM sequence: TGG
ctacaaaaattagctgggcg

SEQ ID NO: 45897 - DNA, 20 bp, Artificial Sequence
  Description of Artificial Sequence: Synthetic oligonucleotide
  Target: ATXN1; (-) strand; PAM type: NRG; PAM sequence: GGG
aaaaactacaaaaattagct

SEQ ID NO: 45898 - DNA, 20 bp, Artificial Sequence
  Description of Artificial Sequence: Synthetic oligonucleotide
  Target: ATXN1; (-) strand; PAM type: NRG; PAM sequence: TGG
caaaaactacaaaaattagc

SEQ ID NO: 45899 - DNA, 20 bp, Artificial Sequence
  Description of Artificial Sequence: Synthetic oligonucleotide
  Target: ATXN1; (-) strand; PAM type: NRG; PAM sequence: TAG
tctacaaaaactacaaaaat

SEQ ID NO: 45900 - DNA, 20 bp, Artificial Sequence
  Description of Artificial Sequence: Synthetic oligonucleotide
  Target: ATXN1; (-) strand; PAM type: NRG; PAM sequence: TGG
caagacaagcctggacaaca

SEQ ID NO: 45901 - DNA, 20 bp, Artificial Sequence
  Description of Artificial Sequence: Synthetic oligonucleotide
  Target: ATXN1; (-) strand; PAM type: NRG; PAM sequence: TGG
ccaagagttcaagacaagcc

SEQ ID NO: 45902 - DNA, 20 bp, Artificial Sequence
  Description of Artificial Sequence: Synthetic oligonucleotide
  Target: ATXN1; (-) strand; PAM type: NRG; PAM sequence: AAG
tgagcccaagagttcaagac

SEQ ID NO: 45903 - DNA, 20 bp, Artificial Sequence
  Description of Artificial Sequence: Synthetic oligonucleotide
  Target: ATXN1; (-) strand; PAM type: NRG; PAM sequence: AAG
tctcttgagcccaagagttc

SEQ ID NO: 45904 - DNA, 20 bp, Artificial Sequence
  Description of Artificial Sequence: Synthetic oligonucleotide
  Target: ATXN1; (-) strand; PAM type: NRG; PAM sequence: GAG
ggcagatctcttgagcccaa

SEQ ID NO: 45905 - DNA, 20 bp, Artificial Sequence
  Description of Artificial Sequence: Synthetic oligonucleotide
  Target: ATXN1; (-) strand; PAM type: NRG; PAM sequence: AAG
caggcagatctcttgagccc

SEQ ID NO: 45906 - DNA, 20 bp, Artificial Sequence
  Description of Artificial Sequence: Synthetic oligonucleotide
  Target: ATXN1; (-) strand; PAM type: NRG; PAM sequence: GAG
ctgagacaggcagatctctt

SEQ ID NO: 45907 - DNA, 20 bp, Artificial Sequence
  Description of Artificial Sequence: Synthetic oligonucleotide
  Target: ATXN1; (-) strand; PAM type: NRG; PAM sequence: CAG
ctttgggaggctgagacagg

SEQ ID NO: 45908 - DNA, 20 bp, Artificial Sequence
  Description of Artificial Sequence: Synthetic oligonucleotide
  Target: ATXN1; (-) strand; PAM type: NRG; PAM sequence: AGG
acactttgggaggctgagac

SEQ ID NO: 45909 - DNA, 20 bp, Artificial Sequence
  Description of Artificial Sequence: Synthetic oligonucleotide
  Target: ATXN1; (-) strand; PAM type: NRG; PAM sequence: CAG
aacactttgggaggctgaga

SEQ ID NO: 45910 - DNA, 20 bp, Artificial Sequence
  Description of Artificial Sequence: Synthetic oligonucleotide
  Target: ATXN1; (-) strand; PAM type: NRG; PAM sequence: GAG
tcccaacactttgggaggct

SEQ ID NO: 45911 - DNA, 20 bp, Artificial Sequence
  Description of Artificial Sequence: Synthetic oligonucleotide
  Target: ATXN1; (-) strand; PAM type: NRG; PAM sequence: AGG
tgttatcccaacactttggg

SEQ ID NO: 45912 - DNA, 20 bp, Artificial Sequence
  Description of Artificial Sequence: Synthetic oligonucleotide
  Target: ATXN1; (-) strand; PAM type: NRG; PAM sequence: GAG
ctgttatcccaacactttgg

SEQ ID NO: 45913 - DNA, 20 bp, Artificial Sequence
  Description of Artificial Sequence: Synthetic oligonucleotide
  Target: ATXN1; (-) strand; PAM type: NRG; PAM sequence: GGG
gcctgttatcccaacacttt

SEQ ID NO: 45914 - DNA, 20 bp, Artificial Sequence
  Description of Artificial Sequence: Synthetic oligonucleotide
  Target: ATXN1; (-) strand; PAM type: NRG; PAM sequence: TGG
tgcctgttatcccaacactt

SEQ ID NO: 45915 - DNA, 20 bp, Artificial Sequence
  Description of Artificial Sequence: Synthetic oligonucleotide
  Target: ATXN1; (-) strand; PAM type: NRG; PAM sequence: TAG
caagaatgggctgggtgtgg

SEQ ID NO: 45916 - DNA, 20 bp, Artificial Sequence
  Description of Artificial Sequence: Synthetic oligonucleotide
  Target: ATXN1; (-) strand; PAM type: NRG; PAM sequence: TGG
actcaagaatgggctgggtg

SEQ ID NO: 45917 - DNA, 20 bp, Artificial Sequence
  Description of Artificial Sequence: Synthetic oligonucleotide
  Target: ATXN1; (-) strand; PAM type: NRG; PAM sequence: GGG
agcatactcaagaatgggct

SEQ ID NO: 45918 - DNA, 20 bp, Artificial Sequence
  Description of Artificial Sequence: Synthetic oligonucleotide
  Target: ATXN1; (-) strand; PAM type: NRG; PAM sequence: TGG
cagcatactcaagaatgggc

SEQ ID NO: 45919 - DNA, 20 bp, Artificial Sequence
  Description of Artificial Sequence: Synthetic oligonucleotide
  Target: ATXN1; (-) strand; PAM type: NRG; PAM sequence: GGG
gatccagcatactcaagaat

SEQ ID NO: 45920 - DNA, 20 bp, Artificial Sequence
  Description of Artificial Sequence: Synthetic oligonucleotide
  Target: ATXN1; (-) strand; PAM type: NRG; PAM sequence: TGG
tgatccagcatactcaagaa

SEQ ID NO: 45921 - DNA, 20 bp, Artificial Sequence
  Description of Artificial Sequence: Synthetic oligonucleotide
  Target: ATXN1; (-) strand; PAM type: NRG; PAM sequence: AAG
aatattgatccagcatactc

SEQ ID NO: 45922 - DNA, 20 bp, Artificial Sequence
  Description of Artificial Sequence: Synthetic oligonucleotide
  Target: ATXN1; (-) strand; PAM type: NRG; PAM sequence: CAG
tacaaggagaaatattgatc

SEQ ID NO: 45923 - DNA, 20 bp, Artificial Sequence
  Description of Artificial Sequence: Synthetic oligonucleotide
  Target: ATXN1; (-) strand; PAM type: NRG; PAM sequence: GAG
tgttggaattacattacaag

SEQ ID NO: 45924 - DNA, 20 bp, Artificial Sequence
  Description of Artificial Sequence: Synthetic oligonucleotide
  Target: ATXN1; (-) strand; PAM type: NRG; PAM sequence: AGG
tctgttggaattacattaca

SEQ ID NO: 45925 - DNA, 20 bp, Artificial Sequence
  Description of Artificial Sequence: Synthetic oligonucleotide
  Target: ATXN1; (-) strand; PAM type: NRG; PAM sequence: AAG
ttctgttggaattacattac

SEQ ID NO: 45926 - DNA, 20 bp, Artificial Sequence
  Description of Artificial Sequence: Synthetic oligonucleotide
  Target: ATXN1; (-) strand; PAM type: NRG; PAM sequence: TGG
aggcctggtttcccttctgt

SEQ ID NO: 45927 - DNA, 20 bp, Artificial Sequence
  Description of Artificial Sequence: Synthetic oligonucleotide
  Target: ATXN1; (-) strand; PAM type: NRG; PAM sequence: TGG
tgcgatactgaaaggaggcc

SEQ ID NO: 45928 - DNA, 20 bp, Artificial Sequence
  Description of Artificial Sequence: Synthetic oligonucleotide
  Target: ATXN1; (-) strand; PAM type: NRG; PAM sequence: AGG
caagctgcgatactgaaagg

SEQ ID NO: 45929 - DNA, 20 bp, Artificial Sequence
  Description of Artificial Sequence: Synthetic oligonucleotide
  Target: ATXN1; (-) strand; PAM type: NRG; PAM sequence: GAG
tcaagctgcgatactgaaag

SEQ ID NO: 45930 - DNA, 20 bp, Artificial Sequence
  Description of Artificial Sequence: Synthetic oligonucleotide
  Target: ATXN1; (-) strand; PAM type: NRG; PAM sequence: AGG
gctcaagctgcgatactgaa

SEQ ID NO: 45931 - DNA, 20 bp, Artificial Sequence
  Description of Artificial Sequence: Synthetic oligonucleotide
  Target: ATXN1; (-) strand; PAM type: NRG; PAM sequence: AAG
ggctcaagctgcgatactga

SEQ ID NO: 45932 - DNA, 20 bp, Artificial Sequence
  Description of Artificial Sequence: Synthetic oligonucleotide
  Target: ATXN1; (-) strand; PAM type: NRG; PAM sequence: AAG
caggggatgctgacaggctc

SEQ ID NO: 45933 - DNA, 20 bp, Artificial Sequence
  Description of Artificial Sequence: Synthetic oligonucleotide
  Target: ATXN1; (-) strand; PAM type: NRG; PAM sequence: AGG
tgaaatcaggggatgctgac

SEQ ID NO: 45934 - DNA, 20 bp, Artificial Sequence
  Description of Artificial Sequence: Synthetic oligonucleotide
  Target: ATXN1; (-) strand; PAM type: NRG; PAM sequence: CAG
ctgaaatcaggggatgctga

SEQ ID NO: 45935 - DNA, 20 bp, Artificial Sequence
  Description of Artificial Sequence: Synthetic oligonucleotide
  Target: ATXN1; (-) strand; PAM type: NRG; PAM sequence: GGG
agcctacgttctgaaatcag

SEQ ID NO: 45936 - DNA, 20 bp, Artificial Sequence
  Description of Artificial Sequence: Synthetic oligonucleotide
  Target: ATXN1; (-) strand; PAM type: NRG; PAM sequence: GGG
tagcctacgttctgaaatca

SEQ ID NO: 45937 - DNA, 20 bp, Artificial Sequence
  Description of Artificial Sequence: Synthetic oligonucleotide
  Target: ATXN1; (-) strand; PAM type: NRG; PAM sequence: AGG
gtagcctacgttctgaaatc

SEQ ID NO: 45938 - DNA, 20 bp, Artificial Sequence
  Description of Artificial Sequence: Synthetic oligonucleotide
  Target: ATXN1; (-) strand; PAM type: NRG; PAM sequence: CAG
tgtagcctacgttctgaaat

SEQ ID NO: 45939 - DNA, 20 bp, Artificial Sequence
  Description of Artificial Sequence: Synthetic oligonucleotide
  Target: ATXN1; (-) strand; PAM type: NRG; PAM sequence: TAG
cacacatctgggactgtttg

SEQ ID NO: 45940 - DNA, 20 bp, Artificial Sequence
  Description of Artificial Sequence: Synthetic oligonucleotide
  Target: ATXN1; (-) strand; PAM type: NRG; PAM sequence: GGG
agtaccgtcagcacacatct

SEQ ID NO: 45941 - DNA, 20 bp, Artificial Sequence
  Description of Artificial Sequence: Synthetic oligonucleotide
  Target: ATXN1; (-) strand; PAM type: NRG; PAM sequence: TGG
tagtaccgtcagcacacatc

SEQ ID NO: 45942 - DNA, 20 bp, Artificial Sequence
  Description of Artificial Sequence: Synthetic oligonucleotide
  Target: ATXN1; (-) strand; PAM type: NRG; PAM sequence: CAG
gaccaggaatgtagtaccgt

SEQ ID NO: 45943 - DNA, 20 bp, Artificial Sequence
  Description of Artificial Sequence: Synthetic oligonucleotide
  Target: ATXN1; (-) strand; PAM type: NRG; PAM sequence: TAG
gctgtgaaagaccaggaatg

SEQ ID NO: 45944 - DNA, 20 bp, Artificial Sequence
  Description of Artificial Sequence: Synthetic oligonucleotide
  Target: ATXN1; (-) strand; PAM type: NRG; PAM sequence: AGG
agtaaatgctgtgaaagacc

SEQ ID NO: 45945 - DNA, 20 bp, Artificial Sequence
  Description of Artificial Sequence: Synthetic oligonucleotide
  Target: ATXN1; (-) strand; PAM type: NRG; PAM sequence: CAG
aagtaaatgctgtgaaagac

SEQ ID NO: 45946 - DNA, 20 bp, Artificial Sequence
  Description of Artificial Sequence: Synthetic oligonucleotide
  Target: ATXN1; (-) strand; PAM type: NRG; PAM sequence: AAG
atccaaagtaaatgctgtga

SEQ ID NO: 45947 - DNA, 20 bp, Artificial Sequence
  Description of Artificial Sequence: Synthetic oligonucleotide
  Target: ATXN1; (-) strand; PAM type: NRG; PAM sequence: AAG
acttcccatttcccaatcca

SEQ ID NO: 45948 - DNA, 20 bp, Artificial Sequence
  Description of Artificial Sequence: Synthetic oligonucleotide
  Target: ATXN1; (-) strand; PAM type: NRG; PAM sequence: GAG
aataatctcatactgaaaga

SEQ ID NO: 45949 - DNA, 20 bp, Artificial Sequence
  Description of Artificial Sequence: Synthetic oligonucleotide
  Target: ATXN1; (-) strand; PAM type: NRG; PAM sequence: GAG
gaaataatctcatactgaaa

SEQ ID NO: 45950 - DNA, 20 bp, Artificial Sequence
  Description of Artificial Sequence: Synthetic oligonucleotide
  Target: ATXN1; (-) strand; PAM type: NRG; PAM sequence: AAG
aagaaataatctcatactga

SEQ ID NO: 45951 - DNA, 20 bp, Artificial Sequence
  Description of Artificial Sequence: Synthetic oligonucleotide
  Target: ATXN1; (-) strand; PAM type: NRG; PAM sequence: AAG
aggccaaactaacctgttct

SEQ ID NO: 45952 - DNA, 20 bp, Artificial Sequence
  Description of Artificial Sequence: Synthetic oligonucleotide
  Target: ATXN1; (-) strand; PAM type: NRG; PAM sequence: AGG
gcttatttatattttagcaa

SEQ ID NO: 45953 - DNA, 20 bp, Artificial Sequence
  Description of Artificial Sequence: Synthetic oligonucleotide
  Target: ATXN1; (-) strand; PAM type: NRG; PAM sequence: AAG
tgcttatttatattttagca

SEQ ID NO: 45954 - DNA, 20 bp, Artificial Sequence
  Description of Artificial Sequence: Synthetic oligonucleotide
  Target: ATXN1; (-) strand; PAM type: NRG; PAM sequence: TAG
gcctctgcttatttatattt

SEQ ID NO: 45955 - DNA, 20 bp, Artificial Sequence
  Description of Artificial Sequence: Synthetic oligonucleotide
  Target: ATXN1; (-) strand; PAM type: NRG; PAM sequence: AAG
ctcagatgtttttctgatgg

SEQ ID NO: 45956 - DNA, 20 bp, Artificial Sequence
  Description of Artificial Sequence: Synthetic oligonucleotide
  Target: ATXN1; (-) strand; PAM type: NRG; PAM sequence: TGG
acactcagatgtttttctga

SEQ ID NO: 45957 - DNA, 20 bp, Artificial Sequence
  Description of Artificial Sequence: Synthetic oligonucleotide
  Target: ATXN1; (-) strand; PAM type: NRG; PAM sequence: CAG
gcatttatctacttaacact

SEQ ID NO: 45958 - DNA, 20 bp, Artificial Sequence
  Description of Artificial Sequence: Synthetic oligonucleotide
  Target: ATXN1; (-) strand; PAM type: NRG; PAM sequence: GGG
taaaatgtctcaatgttgaa

SEQ ID NO: 45959 - DNA, 20 bp, Artificial Sequence
  Description of Artificial Sequence: Synthetic oligonucleotide
  Target: ATXN1; (-) strand; PAM type: NRG; PAM sequence: AGG
ataaaatgtctcaatgttga

SEQ ID NO: 45960 - DNA, 20 bp, Artificial Sequence
  Description of Artificial Sequence: Synthetic oligonucleotide
  Target: ATXN1; (-) strand; PAM type: NRG; PAM sequence: AAG
gataaaatgtctcaatgttg

SEQ ID NO: 45961 - DNA, 20 bp, Artificial Sequence
  Description of Artificial Sequence: Synthetic oligonucleotide
  Target: ATXN1; (-) strand; PAM type: NRG; PAM sequence: GAG
ataagagtgcatcagatgtg

SEQ ID NO: 45962 - DNA, 20 bp, Artificial Sequence
  Description of Artificial Sequence: Synthetic oligonucleotide
  Target: ATXN1; (-) strand; PAM type: NRG; PAM sequence: TGG
aaataagagtgcatcagatg

SEQ ID NO: 45963 - DNA, 20 bp, Artificial Sequence
  Description of Artificial Sequence: Synthetic oligonucleotide
  Target: ATXN1; (-) strand; PAM type: NRG; PAM sequence: CAG
atgaaaaaataagagtgcat

SEQ ID NO: 45964 - DNA, 20 bp, Artificial Sequence
  Description of Artificial Sequence: Synthetic oligonucleotide
  Target: ATXN1; (-) strand; PAM type: NRG; PAM sequence: GAG
gtgtcctgatgaaaaaataa

SEQ ID NO: 45965 - DNA, 20 bp, Artificial Sequence
  Description of Artificial Sequence: Synthetic oligonucleotide
  Target: ATXN1; (-) strand; PAM type: NRG; PAM sequence: AAG
acgtgtcctgatgaaaaaat

SEQ ID NO: 45966 - DNA, 20 bp, Artificial Sequence
  Description of Artificial Sequence: Synthetic oligonucleotide
  Target: ATXN1; (-) strand; PAM type: NRG; PAM sequence: TGG
gggaaaaagatccaagtttc

SEQ ID NO: 45967 - DNA, 20 bp, Artificial Sequence
  Description of Artificial Sequence: Synthetic oligonucleotide
  Target: ATXN1; (-) strand; PAM type: NRG; PAM sequence: AAG
tatagcagggaaaaagatcc

SEQ ID NO: 45968 - DNA, 20 bp, Artificial Sequence
  Description of Artificial Sequence: Synthetic oligonucleotide
  Target: ATXN1; (-) strand; PAM type: NRG; PAM sequence: AAG
gcgaaactatagcagggaaa

SEQ ID NO: 45969 - DNA, 20 bp, Artificial Sequence
  Description of Artificial Sequence: Synthetic oligonucleotide
  Target: ATXN1; (-) strand; PAM type: NRG; PAM sequence: GGG
ttattcgcgaaactatagca

SEQ ID NO: 45970 - DNA, 20 bp, Artificial Sequence
  Description of Artificial Sequence: Synthetic oligonucleotide
  Target: ATXN1; (-) strand; PAM type: NRG; PAM sequence: AGG
attattcgcgaaactatagc

SEQ ID NO: 45971 - DNA, 20 bp, Artificial Sequence
  Description of Artificial Sequence: Synthetic oligonucleotide
  Target: ATXN1; (-) strand; PAM type: NRG; PAM sequence: CAG
tattattcgcgaaactatag

SEQ ID NO: 45972 - DNA, 20 bp, Artificial Sequence
  Description of Artificial Sequence: Synthetic oligonucleotide
  Target: ATXN1; (-) strand; PAM type: NRG; PAM sequence: TAG
ctatattattcgcgaaacta

SEQ ID NO: 45973 - DNA, 20 bp, Artificial Sequence
  Description of Artificial Sequence: Synthetic oligonucleotide
  Target: ATXN1; (-) strand; PAM type: NRG; PAM sequence: AAG
ggttaaccagagcaaaatag

SEQ ID NO: 45974 - DNA, 20 bp, Artificial Sequence
  Description of Artificial Sequence: Synthetic oligonucleotide
  Target: ATXN1; (-) strand; PAM type: NRG; PAM sequence: TAG
ttgggttaaccagagcaaaa

SEQ ID NO: 45975 - DNA, 20 bp, Artificial Sequence
  Description of Artificial Sequence: Synthetic oligonucleotide
  Target: ATXN1; (-) strand; PAM type: NRG; PAM sequence: GAG
accatcccttgggttaacca

SEQ ID NO: 45976 - DNA, 20 bp, Artificial Sequence
  Description of Artificial Sequence: Synthetic oligonucleotide
  Target: ATXN1; (-) strand; PAM type: NRG; PAM sequence: CAG
ccaccatcccttgggttaac

SEQ ID NO: 45977 - DNA, 20 bp, Artificial Sequence
  Description of Artificial Sequence: Synthetic oligonucleotide
  Target: ATXN1; (-) strand; PAM type: NRG; PAM sequence: GGG
catcccacccaccatccctt

SEQ ID NO: 45978 - DNA, 20 bp, Artificial Sequence
  Description of Artificial Sequence: Synthetic oligonucleotide
  Target: ATXN1; (-) strand; PAM type: NRG; PAM sequence: TGG
tcatcccacccaccatccct

SEQ ID NO: 45979 - DNA, 20 bp, Artificial Sequence
  Description of Artificial Sequence: Synthetic oligonucleotide
  Target: ATXN1; (-) strand; PAM type: NRG; PAM sequence: CAG
aaacgttatagattgagact

SEQ ID NO: 45980 - DNA, 20 bp, Artificial Sequence
  Description of Artificial Sequence: Synthetic oligonucleotide
  Target: ATXN1; (-) strand; PAM type: NRG; PAM sequence: GAG
cgttggaaacgttatagatt

SEQ ID NO: 45981 - DNA, 20 bp, Artificial Sequence
  Description of Artificial Sequence: Synthetic oligonucleotide
  Target: ATXN1; (-) strand; PAM type: NRG; PAM sequence: TAG
cttctacgttggaaacgtta

SEQ ID NO: 45982 - DNA, 20 bp, Artificial Sequence
  Description of Artificial Sequence: Synthetic oligonucleotide
  Target: ATXN1; (-) strand; PAM type: NRG; PAM sequence: TGG
gttcattttatcttctacgt

SEQ ID NO: 45983 - DNA, 20 bp, Artificial Sequence
  Description of Artificial Sequence: Synthetic oligonucleotide
  Target: ATXN1; (-) strand; PAM type: NRG; PAM sequence: GGG
ttcccaaatatgtttattat

SEQ ID NO: 45984 - DNA, 20 bp, Artificial Sequence
  Description of Artificial Sequence: Synthetic oligonucleotide
  Target: ATXN1; (-) strand; PAM type: NRG; PAM sequence: TGG
tttcccaaatatgtttatta

SEQ ID NO: 45985 - DNA, 20 bp, Artificial Sequence
  Description of Artificial Sequence: Synthetic oligonucleotide
  Target: ATXN1; (-) strand; PAM type: NRG; PAM sequence: AAG
tccgttgagagctttctgtg

SEQ ID NO: 45986 - DNA, 20 bp, Artificial Sequence
  Description of Artificial Sequence: Synthetic oligonucleotide
  Target: ATXN1; (-) strand; PAM type: NRG; PAM sequence: GAG
cccttcaggctctccgttga

SEQ ID NO: 45987 - DNA, 20 bp, Artificial Sequence
  Description of Artificial Sequence: Synthetic oligonucleotide
  Target: ATXN1; (-) strand; PAM type: NRG; PAM sequence: GAG
gtcccttcaggctctccgtt

SEQ ID NO: 45988 - DNA, 20 bp, Artificial Sequence
  Description of Artificial Sequence: Synthetic oligonucleotide
  Target: ATXN1; (-) strand; PAM type: NRG; PAM sequence: AGG
actccctggctggtcccttc

SEQ ID NO: 45989 - DNA, 20 bp, Artificial Sequence
  Description of Artificial Sequence: Synthetic oligonucleotide
  Target: ATXN1; (-) strand; PAM type: NRG; PAM sequence: CAG
gactccctggctggtccctt

SEQ ID NO: 45990 - DNA, 20 bp, Artificial Sequence
  Description of Artificial Sequence: Synthetic oligonucleotide
  Target: ATXN1; (-) strand; PAM type: NRG; PAM sequence: TGG
cttgcattagactccctggc

SEQ ID NO: 45991 - DNA, 20 bp, Artificial Sequence
  Description of Artificial Sequence: Synthetic oligonucleotide
  Target: ATXN1; (-) strand; PAM type: NRG; PAM sequence: TGG
ctggcttgcattagactccc

SEQ ID NO: 45992 - DNA, 20 bp, Artificial Sequence
  Description of Artificial Sequence: Synthetic oligonucleotide
  Target: ATXN1; (-) strand; PAM type: NRG; PAM sequence: TAG
tggctgttcctggcttgcat

SEQ ID NO: 45993 - DNA, 20 bp, Artificial Sequence
  Description of Artificial Sequence: Synthetic oligonucleotide
  Target: ATXN1; (-) strand; PAM type: NRG; PAM sequence: TGG
tactcatgcctggctgttcc

SEQ ID NO: 45994 - DNA, 20 bp, Artificial Sequence
  Description of Artificial Sequence: Synthetic oligonucleotide
  Target: ATXN1; (-) strand; PAM type: NRG; PAM sequence: TGG
tctaaggcattactcatgcc

SEQ ID NO: 45995 - DNA, 20 bp, Artificial Sequence
  Description of Artificial Sequence: Synthetic oligonucleotide
  Target: ATXN1; (-) strand; PAM type: NRG; PAM sequence: AGG
aaacaaaacccacccatcta

SEQ ID NO: 45996 - DNA, 20 bp, Artificial Sequence
  Description of Artificial Sequence: Synthetic oligonucleotide
  Target: ATXN1; (-) strand; PAM type: NRG; PAM sequence: AAG
aaaacaaaacccacccatct

SEQ ID NO: 45997 - DNA, 20 bp, Artificial Sequence
  Description of Artificial Sequence: Synthetic oligonucleotide
  Target: ATXN1; (-) strand; PAM type: NRG; PAM sequence: AAG
aagtttcaaatcagctgtga

SEQ ID NO: 45998 - DNA, 20 bp, Artificial Sequence
  Description of Artificial Sequence: Synthetic oligonucleotide
  Target: ATXN1; (-) strand; PAM type: NRG; PAM sequence: CAG
cattgagggaagtttcaaat

SEQ ID NO: 45999 - DNA, 20 bp, Artificial Sequence
  Description of Artificial Sequence: Synthetic oligonucleotide
  Target: ATXN1; (-) strand; PAM type: NRG; PAM sequence: AAG
ttctacagtgtcattgaggg

SEQ ID NO: 46000 - DNA, 20 bp, Artificial Sequence
  Description of Artificial Sequence: Synthetic oligonucleotide
  Target: ATXN1; (-) strand; PAM type: NRG; PAM sequence: GGG
atcttctacagtgtcattga

SEQ ID NO: 46001 - DNA, 20 bp, Artificial Sequence
  Description of Artificial Sequence: Synthetic oligonucleotide
  Target: ATXN1; (-) strand; PAM type: NRG; PAM sequence: AGG
tatcttctacagtgtcattg

SEQ ID NO: 46002 - DNA, 20 bp, Artificial Sequence
  Description of Artificial Sequence: Synthetic oligonucleotide
  Target: ATXN1; (-) strand; PAM type: NRG; PAM sequence: GAG
ttatcttctacagtgtcatt

SEQ ID NO: 46003 - DNA, 20 bp, Artificial Sequence
  Description of Artificial Sequence: Synthetic oligonucleotide
  Target: ATXN1; (-) strand; PAM type: NRG; PAM sequence: CAG
tgttaaaacattatcttcta

SEQ ID NO: 46004 - DNA, 20 bp, Artificial Sequence
  Description of Artificial Sequence: Synthetic oligonucleotide
  Target: ATXN1; (-) strand; PAM type: NRG; PAM sequence: AAG
ctgtcggcttgagtgtgagg

SEQ ID NO: 46005 - DNA, 20 bp, Artificial Sequence
  Description of Artificial Sequence: Synthetic oligonucleotide
  Target: ATXN1; (-) strand; PAM type: NRG; PAM sequence: AGG
gctctgtcggcttgagtgtg

SEQ ID NO: 46006 - DNA, 20 bp, Artificial Sequence
  Description of Artificial Sequence: Synthetic oligonucleotide
  Target: ATXN1; (-) strand; PAM type: NRG; PAM sequence: GAG
tgctctgtcggcttgagtgt

SEQ ID NO: 46007 - DNA, 20 bp, Artificial Sequence
  Description of Artificial Sequence: Synthetic oligonucleotide
  Target: ATXN1; (-) strand; PAM type: NRG; PAM sequence: GAG
gtgtgatgctctgtcggctt

SEQ ID NO: 46008 - DNA, 20 bp, Artificial Sequence
  Description of Artificial Sequence: Synthetic oligonucleotide
  Target: ATXN1; (-) strand; PAM type: NRG; PAM sequence: CGG
agcctcgtgtgatgctctgt

SEQ ID NO: 46009 - DNA, 20 bp, Artificial Sequence
  Description of Artificial Sequence: Synthetic oligonucleotide
  Target: ATXN1; (-) strand; PAM type: NRG; PAM sequence: GAG
gatgtggagactaccagaca

SEQ ID NO: 46010 - DNA, 20 bp, Artificial Sequence
  Description of Artificial Sequence: Synthetic oligonucleotide
  Target: ATXN1; (-) strand; PAM type: NRG; PAM sequence: CAG
gagatgtggagactaccaga

SEQ ID NO: 46011 - DNA, 20 bp, Artificial Sequence
  Description of Artificial Sequence: Synthetic oligonucleotide
  Target: ATXN1; (-) strand; PAM type: NRG; PAM sequence: CAG
gcctgagatgtggagactac

SEQ ID NO: 46012 - DNA, 20 bp, Artificial Sequence
  Description of Artificial Sequence: Synthetic oligonucleotide
  Target: ATXN1; (-) strand; PAM type: NRG; PAM sequence: GAG
ccagcccagcctgagatgtg

SEQ ID NO: 46013 - DNA, 20 bp, Artificial Sequence
  Description of Artificial Sequence: Synthetic oligonucleotide
  Target: ATXN1; (-) strand; PAM type: NRG; PAM sequence: TGG
atccagcccagcctgagatg

SEQ ID NO: 46014 - DNA, 20 bp, Artificial Sequence
  Description of Artificial Sequence: Synthetic oligonucleotide
  Target: ATXN1; (-) strand; PAM type: NRG; PAM sequence: GAG
ccttccatccagcccagcct

SEQ ID NO: 46015 - DNA, 20 bp, Artificial Sequence
  Description of Artificial Sequence: Synthetic oligonucleotide
  Target: ATXN1; (-) strand; PAM type: NRG; PAM sequence: CAG
tcatttccttccatccagcc

SEQ ID NO: 46016 - DNA, 20 bp, Artificial Sequence
  Description of Artificial Sequence: Synthetic oligonucleotide
  Target: ATXN1; (-) strand; PAM type: NRG; PAM sequence: CAG
tgtgatcatttccttccatc

SEQ ID NO: 46017 - DNA, 20 bp, Artificial Sequence
  Description of Artificial Sequence: Synthetic oligonucleotide
  Target: ATXN1; (-) strand; PAM type: NRG; PAM sequence: TGG
gccctcgatgtgccttgctg

SEQ ID NO: 46018 - DNA, 20 bp, Artificial Sequence
  Description of Artificial Sequence: Synthetic oligonucleotide
  Target: ATXN1; (-) strand; PAM type: NRG; PAM sequence: GAG
cttcttttgagccacaaagg

SEQ ID NO: 46019 - DNA, 20 bp, Artificial Sequence
  Description of Artificial Sequence: Synthetic oligonucleotide
  Target: ATXN1; (-) strand; PAM type: NRG; PAM sequence: GGG
tgcttcttttgagccacaaa

SEQ ID NO: 46020 - DNA, 20 bp, Artificial Sequence
  Description of Artificial Sequence: Synthetic oligonucleotide
  Target: ATXN1; (-) strand; PAM type: NRG; PAM sequence: AGG
atgcttcttttgagccacaa

SEQ ID NO: 46021 - DNA, 20 bp, Artificial Sequence
  Description of Artificial Sequence: Synthetic oligonucleotide
  Target: ATXN1; (-) strand; PAM type: NRG; PAM sequence: AAG
gatgcttcttttgagccaca

SEQ ID NO: 46022 - DNA, 20 bp, Artificial Sequence
  Description of Artificial Sequence: Synthetic oligonucleotide
  Target: ATXN1; (-) strand; PAM type: NRG; PAM sequence: GAG
tctgccatgatgcttctttt

SEQ ID NO: 46023 - DNA, 20 bp, Artificial Sequence
  Description of Artificial Sequence: Synthetic oligonucleotide
  Target: ATXN1; (-) strand; PAM type: NRG; PAM sequence: GGG
tattcctcatggataaggcg

SEQ ID NO: 46024 - DNA, 20 bp, Artificial Sequence
  Description of Artificial Sequence: Synthetic oligonucleotide
  Target: ATXN1; (-) strand; PAM type: NRG; PAM sequence: GGG
ctattcctcatggataaggc

SEQ ID NO: 46025 - DNA, 20 bp, Artificial Sequence
  Description of Artificial Sequence: Synthetic oligonucleotide
  Target: ATXN1; (-) strand; PAM type: NRG; PAM sequence: CGG
cctattcctcatggataagg

SEQ ID NO: 46026 - DNA, 20 bp, Artificial Sequence
  Description of Artificial Sequence: Synthetic oligonucleotide
  Target: ATXN1; (-) strand; PAM type: NRG; PAM sequence: AGG
gaacctattcctcatggata

SEQ ID NO: 46027 - DNA, 20 bp, Artificial Sequence
  Description of Artificial Sequence: Synthetic oligonucleotide
  Target: ATXN1; (-) strand; PAM type: NRG; PAM sequence: AAG
ggaacctattcctcatggat

SEQ ID NO: 46028 - DNA, 20 bp, Artificial Sequence
  Description of Artificial Sequence: Synthetic oligonucleotide
  Target: ATXN1; (-) strand; PAM type: NRG; PAM sequence: TGG
gtcttggaacctattcctca

SEQ ID NO: 46029 - DNA, 20 bp, Artificial Sequence
  Description of Artificial Sequence: Synthetic oligonucleotide
  Target: ATXN1; (-) strand; PAM type: NRG; PAM sequence: TGG
caggaacccactgggggtct

SEQ ID NO: 46030 - DNA, 20 bp, Artificial Sequence
  Description of Artificial Sequence: Synthetic oligonucleotide
  Target: ATXN1; (-) strand; PAM type: NRG; PAM sequence: GGG
gggtttcaggaacccactgg

SEQ ID NO: 46031 - DNA, 20 bp, Artificial Sequence
  Description of Artificial Sequence: Synthetic oligonucleotide
  Target: ATXN1; (-) strand; PAM type: NRG; PAM sequence: GGG
tgggtttcaggaacccactg

SEQ ID NO: 46032 - DNA, 20 bp, Artificial Sequence
  Description of Artificial Sequence: Synthetic oligonucleotide
  Target: ATXN1; (-) strand; PAM type: NRG; PAM sequence: GGG
gtgggtttcaggaacccact

SEQ ID NO: 46033 - DNA, 20 bp, Artificial Sequence
  Description of Artificial Sequence: Synthetic oligonucleotide
  Target: ATXN1; (-) strand; PAM type: NRG; PAM sequence: TGG
agtgggtttcaggaacccac

SEQ ID NO: 46034 - DNA, 20 bp, Artificial Sequence
  Description of Artificial Sequence: Synthetic oligonucleotide
  Target: ATXN1; (-) strand; PAM type: NRG; PAM sequence: AGG
ggtactatccagtgggtttc

SEQ ID NO: 46035 - DNA, 20 bp, Artificial Sequence
  Description of Artificial Sequence: Synthetic oligonucleotide
  Target: ATXN1; (-) strand; PAM type: NRG; PAM sequence: CAG
tggtactatccagtgggttt

SEQ ID NO: 46036 - DNA, 20 bp, Artificial Sequence
  Description of Artificial Sequence: Synthetic oligonucleotide
  Target: ATXN1; (-) strand; PAM type: NRG; PAM sequence: GGG
agggtttggtactatccagt

SEQ ID NO: 46037 - DNA, 20 bp, Artificial Sequence
  Description of Artificial Sequence: Synthetic oligonucleotide
  Target: ATXN1; (-) strand; PAM type: NRG; PAM sequence: TGG
tagggtttggtactatccag

SEQ ID NO: 46038 - DNA, 20 bp, Artificial Sequence
  Description of Artificial Sequence: Synthetic oligonucleotide
  Target: ATXN1; (-) strand; PAM type: NRG; PAM sequence: CAG
acatagggtttggtactatc

SEQ ID NO: 46039 - DNA, 20 bp, Artificial Sequence
  Description of Artificial Sequence: Synthetic oligonucleotide
  Target: ATXN1; (-) strand; PAM type: NRG; PAM sequence: TGG
aacatagcgtacatagggtt

SEQ ID NO: 46040 - DNA, 20 bp, Artificial Sequence
  Description of Artificial Sequence: Synthetic oligonucleotide
  Target: ATXN1; (-) strand; PAM type: NRG; PAM sequence: GGG
aaaaaaacatagcgtacata

SEQ ID NO: 46041 - DNA, 20 bp, Artificial Sequence
  Description of Artificial Sequence: Synthetic oligonucleotide
  Target: ATXN1; (-) strand; PAM type: NRG; PAM sequence: AGG
gaaaaaaacatagcgtacat

SEQ ID NO: 46042 - DNA, 20 bp, Artificial Sequence
  Description of Artificial Sequence: Synthetic oligonucleotide
  Target: ATXN1; (-) strand; PAM type: NRG; PAM sequence: TAG
ggaaaaaaacatagcgtaca

SEQ ID NO: 46043 - DNA, 20 bp, Artificial Sequence
  Description of Artificial Sequence: Synthetic oligonucleotide
  Target: ATXN1; (-) strand; PAM type: NRG; PAM sequence: TAG
gtatatataggaaaaaaaca

SEQ ID NO: 46044 - DNA, 20 bp, Artificial Sequence
  Description of Artificial Sequence: Synthetic oligonucleotide
  Target: ATXN1; (-) strand; PAM type: NRG; PAM sequence: AGG
tatcgtaggtatgtatatat

SEQ ID NO: 46045 - DNA, 20 bp, Artificial Sequence
  Description of Artificial Sequence: Synthetic oligonucleotide
  Target: ATXN1; (-) strand; PAM type: NRG; PAM sequence: TAG
ttatcgtaggtatgtatata

SEQ ID NO: 46046 - DNA, 20 bp, Artificial Sequence
  Description of Artificial Sequence: Synthetic oligonucleotide
  Target: ATXN1; (-) strand; PAM type: NRG; PAM sequence: AGG
tataaatcaaactttatcgt

SEQ ID NO: 46047 - DNA, 20 bp, Artificial Sequence
  Description of Artificial Sequence: Synthetic oligonucleotide
  Target: ATXN1; (-) strand; PAM type: NRG; PAM sequence: TAG
gtataaatcaaactttatcg

SEQ ID NO: 46048 - DNA, 20 bp, Artificial Sequence
  Description of Artificial Sequence: Synthetic oligonucleotide
  Target: ATXN1; (-) strand; PAM type: NRG; PAM sequence: TAG
caatcgttctattttattat

SEQ ID NO: 46049 - DNA, 20 bp, Artificial Sequence
  Description of Artificial Sequence: Synthetic oligonucleotide
  Target: ATXN1; (-) strand; PAM type: NRG; PAM sequence: TGG
cccaaagcacttagtgatgc

SEQ ID NO: 46050 - DNA, 20 bp, Artificial Sequence
  Description of Artificial Sequence: Synthetic oligonucleotide
  Target: ATXN1; (-) strand; PAM type: NRG; PAM sequence: TAG
aatgatggtcccaaagcact

SEQ ID NO: 46051 - DNA, 20 bp, Artificial Sequence
  Description of Artificial Sequence: Synthetic oligonucleotide
  Target: ATXN1; (-) strand; PAM type: NRG; PAM sequence: AAG
tttacttaatgatggtccca

SEQ ID NO: 46052 - DNA, 20 bp, Artificial Sequence
  Description of Artificial Sequence: Synthetic oligonucleotide
  Target: ATXN1; (-) strand; PAM type: NRG; PAM sequence: TGG
acctttattttacttaatga

SEQ ID NO: 46053 - DNA, 20 bp, Artificial Sequence
  Description of Artificial Sequence: Synthetic oligonucleotide
  Target: ATXN1; (-) strand; PAM type: NRG; PAM sequence: AAG
ggatggaagtgcttgtgttc

SEQ ID NO: 46054 - DNA, 20 bp, Artificial Sequence
  Description of Artificial Sequence: Synthetic oligonucleotide
  Target: ATXN1; (-) strand; PAM type: NRG; PAM sequence: AAG
gatccactgtggtgggatgg

SEQ ID NO: 46055 - DNA, 20 bp, Artificial Sequence
  Description of Artificial Sequence: Synthetic oligonucleotide
  Target: ATXN1; (-) strand; PAM type: NRG; PAM sequence: TGG
ttagatccactgtggtggga

SEQ ID NO: 46056 - DNA, 20 bp, Artificial Sequence
  Description of Artificial Sequence: Synthetic oligonucleotide
  Target: ATXN1; (-) strand; PAM type: NRG; PAM sequence: GGG
gtgcttagatccactgtggt

SEQ ID NO: 46057 - DNA, 20 bp, Artificial Sequence
  Description of Artificial Sequence: Synthetic oligonucleotide
  Target: ATXN1; (-) strand; PAM type: NRG; PAM sequence: TGG
ggtgcttagatccactgtgg

SEQ ID NO: 46058 - DNA, 20 bp, Artificial Sequence
  Description of Artificial Sequence: Synthetic oligonucleotide
  Target: ATXN1; (-) strand; PAM type: NRG; PAM sequence: TGG
cttggtgcttagatccactg

SEQ ID NO: 46059 - DNA, 20 bp, Artificial Sequence
  Description of Artificial Sequence: Synthetic oligonucleotide
  Target: ATXN1; (-) strand; PAM type: NRG; PAM sequence: TAG
ctagcggccatcttggtgct

SEQ ID NO: 46060 - DNA, 20 bp, Artificial Sequence
  Description of Artificial Sequence: Synthetic oligonucleotide
  Target: ATXN1; (-) strand; PAM type: NRG; PAM sequence: TGG
gagtcacctagcggccatct

SEQ ID NO: 46061 - DNA, 20 bp, Artificial Sequence
  Description of Artificial Sequence: Synthetic oligonucleotide
  Target: ATXN1; (-) strand; PAM type: NRG; PAM sequence: CGG
cccgccggtgagtcacctag

SEQ ID NO: 46062 - DNA, 20 bp, Artificial Sequence
  Description of Artificial Sequence: Synthetic oligonucleotide
  Target: ATXN1; (-) strand; PAM type: NRG; PAM sequence: TAG
ctccccgccggtgagtcacc

SEQ ID NO: 46063 - DNA, 20 bp, Artificial Sequence
  Description of Artificial Sequence: Synthetic oligonucleotide
  Target: ATXN1; (-) strand; PAM type: NRG; PAM sequence: GAG
gcgcagcgctccccgccggt

SEQ ID NO: 46064 - DNA, 20 bp, Artificial Sequence
  Description of Artificial Sequence: Synthetic oligonucleotide
  Target: ATXN1; (-) strand; PAM type: NRG; PAM sequence: CGG
cgctgcgcagcgctccccgc

SEQ ID NO: 46065 - DNA, 20 bp, Artificial Sequence
  Description of Artificial Sequence: Synthetic oligonucleotide
  Target: ATXN1; (-) strand; PAM type: NRG; PAM sequence: CAG
tctccagcttgtccgctgcg

SEQ ID NO: 46066 - DNA, 20 bp, Artificial Sequence
  Description of Artificial Sequence: Synthetic oligonucleotide
  Target: ATXN1; (-) strand; PAM type: NRG; PAM sequence: CAG
acgtgaatcgtccctttctc

SEQ ID NO: 46067 - DNA, 20 bp, Artificial Sequence
  Description of Artificial Sequence: Synthetic oligonucleotide
  Target: ATXN1; (-) strand; PAM type: NRG; PAM sequence: CAG
cgccttaccccatcctaacg

SEQ ID NO: 46068 - DNA, 20 bp, Artificial Sequence
  Description of Artificial Sequence: Synthetic oligonucleotide
  Target: ATXN1; (-) strand; PAM type: NRG; PAM sequence: TAG
aagttgcgtgctgttctcag

SEQ ID NO: 46069 - DNA, 20 bp, Artificial Sequence
  Description of Artificial Sequence: Synthetic oligonucleotide
  Target: ATXN1; (-) strand; PAM type: NRG; PAM sequence: CAG
tttaagttgcgtgctgttct

SEQ ID NO: 46070 - DNA, 20 bp, Artificial Sequence
  Description of Artificial Sequence: Synthetic oligonucleotide
  Target: ATXN1; (-) strand; PAM type: NRG; PAM sequence: AAG
ataaacagttcctaagtttt

SEQ ID NO: 46071 - DNA, 20 bp, Artificial Sequence
  Description of Artificial Sequence: Synthetic oligonucleotide
  Target: ATXN1; (-) strand; PAM type: NRG; PAM sequence: AAG
tccagaaataaacagttcct

SEQ ID NO: 46072 - DNA, 20 bp, Artificial Sequence
  Description of Artificial Sequence: Synthetic oligonucleotide
  Target: ATXN1; (-) strand; PAM type: NRG; PAM sequence: CAG
tggaaaattccagaaataaa

SEQ ID NO: 46073 - DNA, 20 bp, Artificial Sequence
  Description of Artificial Sequence: Synthetic oligonucleotide
  Target: ATXN1; (-) strand; PAM type: NRG; PAM sequence: CAG
aagtatgaaatggaaaattc

SEQ ID NO: 46074 - DNA, 20 bp, Artificial Sequence
  Description of Artificial Sequence: Synthetic oligonucleotide
  Target: ATXN1; (-) strand; PAM type: NRG; PAM sequence: TGG
tgcagactgaaagtatgaaa

SEQ ID NO: 46075 - DNA, 20 bp, Artificial Sequence
  Description of Artificial Sequence: Synthetic oligonucleotide
  Target: ATXN1; (-) strand; PAM type: NRG; PAM sequence: AAG
tgaggccaactgcagactga

SEQ ID NO: 46076 - DNA, 20 bp, Artificial Sequence
  Description of Artificial Sequence: Synthetic oligonucleotide
  Target: ATXN1; (-) strand; PAM type: NRG; PAM sequence: CAG
ttgatttctgaggccaactg

SEQ ID NO: 46077 - DNA, 20 bp, Artificial Sequence
  Description of Artificial Sequence: Synthetic oligonucleotide
  Target: ATXN1; (-) strand; PAM type: NRG; PAM sequence: AGG
tatccgcaggttgatttctg

SEQ ID NO: 46078 - DNA, 20 bp, Artificial Sequence
  Description of Artificial Sequence: Synthetic oligonucleotide
  Target: ATXN1; (-) strand; PAM type: NRG; PAM sequence: GAG
ttatccgcaggttgatttct

SEQ ID NO: 46079 - DNA, 20 bp, Artificial Sequence
  Description of Artificial Sequence: Synthetic oligonucleotide
  Target: ATXN1; (-) strand; PAM type: NRG; PAM sequence: AGG
agacgtcccccgttatccgc

SEQ ID NO: 46080 - DNA, 20 bp, Artificial Sequence
  Description of Artificial Sequence: Synthetic oligonucleotide
  Target: ATXN1; (-) strand; PAM type: NRG; PAM sequence: CAG
cagacgtcccccgttatccg

SEQ ID NO: 46081 - DNA, 20 bp, Artificial Sequence
  Description of Artificial Sequence: Synthetic oligonucleotide
  Target: ATXN1; (-) strand; PAM type: NRG; PAM sequence: CAG
ttttcctagaacaccgcagc

SEQ ID NO: 46082 - DNA, 20 bp, Artificial Sequence
  Description of Artificial Sequence: Synthetic oligonucleotide
  Target: ATXN1; (-) strand; PAM type: NRG; PAM sequence: CAG
agtattttcctagaacaccg

SEQ ID NO: 46083 - DNA, 20 bp, Artificial Sequence
  Description of Artificial Sequence: Synthetic oligonucleotide
  Target: ATXN1; (-) strand; PAM type: NRG; PAM sequence: TAG
tttagtgtggagtattttcc

SEQ ID NO: 46084 - DNA, 20 bp, Artificial Sequence
  Description of Artificial Sequence: Synthetic oligonucleotide
  Target: ATXN1; (-) strand; PAM type: NRG; PAM sequence: GAG
acctcctttagtttagtgtg

SEQ ID NO: 46085 - DNA, 20 bp, Artificial Sequence
  Description of Artificial Sequence: Synthetic oligonucleotide
  Target: ATXN1; (-) strand; PAM type: NRG; PAM sequence: TGG
acacctcctttagtttagtg

SEQ ID NO: 46086 - DNA, 20 bp, Artificial Sequence
  Description of Artificial Sequence: Synthetic oligonucleotide
  Target: ATXN1; (-) strand; PAM type: NRG; PAM sequence: TAG
ttgagacacctcctttagtt

SEQ ID NO: 46087 - DNA, 20 bp, Artificial Sequence
  Description of Artificial Sequence: Synthetic oligonucleotide
  Target: ATXN1; (-) strand; PAM type: NRG; PAM sequence: TAG
ccttgttgagacacctcctt

SEQ ID NO: 46088 - DNA, 20 bp, Artificial Sequence
  Description of Artificial Sequence: Synthetic oligonucleotide
  Target: ATXN1; (-) strand; PAM type: NRG; PAM sequence: GAG
acctcgttctcagccttgtt

SEQ ID NO: 46089 - DNA, 20 bp, Artificial Sequence
  Description of Artificial Sequence: Synthetic oligonucleotide
  Target: ATXN1; (-) strand; PAM type: NRG; PAM sequence: CAG
tctgtcatagacctcgttct

SEQ ID NO: 46090 - DNA, 20 bp, Artificial Sequence
  Description of Artificial Sequence: Synthetic oligonucleotide
  Target: ATXN1; (-) strand; PAM type: NRG; PAM sequence: TAG
ttcttggcacatttctgtca

SEQ ID NO: 46091 - DNA, 20 bp, Artificial Sequence
  Description of Artificial Sequence: Synthetic oligonucleotide
  Target: ATXN1; (-) strand; PAM type: NRG; PAM sequence: TGG
gcttttcctttctgctttct

SEQ ID NO: 46092 - DNA, 20 bp, Artificial Sequence
  Description of Artificial Sequence: Synthetic oligonucleotide
  Target: ATXN1; (-) strand; PAM type: NRG; PAM sequence: GAG
agcagcattccccattctat

SEQ ID NO: 46093 - DNA, 20 bp, Artificial Sequence
  Description of Artificial Sequence: Synthetic oligonucleotide
  Target: ATXN1; (-) strand; PAM type: NRG; PAM sequence: CAG
tgaagccactaaccaaccag

SEQ ID NO: 46094 - DNA, 20 bp, Artificial Sequence
  Description of Artificial Sequence: Synthetic oligonucleotide
  Target: ATXN1; (-) strand; PAM type: NRG; PAM sequence: CAG
ttctgaagccactaaccaac

SEQ ID NO: 46095 - DNA, 20 bp, Artificial Sequence
  Description of Artificial Sequence: Synthetic oligonucleotide
  Target: ATXN1; (-) strand; PAM type: NRG; PAM sequence: AAG
gagaatcagacacctttctg

SEQ ID NO: 46096 - DNA, 20 bp, Artificial Sequence
  Description of Artificial Sequence: Synthetic oligonucleotide
  Target: ATXN1; (-) strand; PAM type: NRG; PAM sequence: CAG
taattgcttgttaagagaat

SEQ ID NO: 46097 - DNA, 20 bp, Artificial Sequence
  Description of Artificial Sequence: Synthetic oligonucleotide
  Target: ATXN1; (-) strand; PAM type: NRG; PAM sequence: GAG
ctcctgtaattgcttgttaa

SEQ ID NO: 46098 - DNA, 20 bp, Artificial Sequence
  Description of Artificial Sequence: Synthetic oligonucleotide
  Target: ATXN1; (-) strand; PAM type: NRG; PAM sequence: AAG
gcctcctgtaattgcttgtt

SEQ ID NO: 46099 - DNA, 20 bp, Artificial Sequence
  Description of Artificial Sequence: Synthetic oligonucleotide
  Target: ATXN1; (-) strand; PAM type: NRG; PAM sequence: GGG
caggtgtgagccaccatgcc

SEQ ID NO: 46100 - DNA, 20 bp, Artificial Sequence
  Description of Artificial Sequence: Synthetic oligonucleotide
  Target: ATXN1; (-) strand; PAM type: NRG; PAM sequence: CGG
acaggtgtgagccaccatgc

SEQ ID NO: 46101 - DNA, 20 bp, Artificial Sequence
  Description of Artificial Sequence: Synthetic oligonucleotide
  Target: ATXN1; (-) strand; PAM type: NRG; PAM sequence: GAG
agtgctgggactacaggtgt

SEQ ID NO: 46102 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggactac

SEQ ID NO: 46103 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggacta

SEQ ID NO: 46104 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 46105 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccaaagtgc

SEQ ID NO: 46106 - DNA, 20 bp, Artificial Sequence
  Description of Artificial Sequence: Synthetic oligonucleotide
  Target: ATXN1; (-) strand; PAM type: NRG; PAM sequence: AAG
ccgcccacctcagcctccca

SEQ ID NO: 46107 - DNA, 20 bp, Artificial Sequence
  Description of Artificial Sequence: Synthetic oligonucleotide
  Target: ATXN1; (-) strand; PAM type: NRG; PAM sequence: CAG
accccaagatccgcccacct

SEQ ID NO: 46108 - DNA, 20 bp, Artificial Sequence
  Description of Artificial Sequence: Synthetic oligonucleotide
  Target: ATXN1; (-) strand; PAM type: NRG; PAM sequence: AAG
ggtctcgaactcctgacccc

SEQ ID NO: 46109 - DNA, 20 bp, Artificial Sequence
  Description of Artificial Sequence: Synthetic oligonucleotide
  Target: ATXN1; (-) strand; PAM type: NRG; PAM sequence: TGG
ttttggcatgttggccaggc

SEQ ID NO: 46110 - DNA, 20 bp, Artificial Sequence
  Description of Artificial Sequence: Synthetic oligonucleotide
  Target: ATXN1; (-) strand; PAM type: NRG; PAM sequence: AGG
ggggttttggcatgttggcc

SEQ ID NO: 46111 - DNA, 20 bp, Artificial Sequence
  Description of Artificial Sequence: Synthetic oligonucleotide
  Target: ATXN1; (-) strand; PAM type: NRG; PAM sequence: CAG
gggggttttggcatgttggc

SEQ ID NO: 46112 - DNA, 20 bp, Artificial Sequence
  Description of Artificial Sequence: Synthetic oligonucleotide
  Target: ATXN1; (-) strand; PAM type: NRG; PAM sequence: TGG
agacgggggttttggcatgt

SEQ ID NO: 46113 - DNA, 20 bp, Artificial Sequence
  Description of Artificial Sequence: Synthetic oligonucleotide
  Target: ATXN1; (-) strand; PAM type: NRG; PAM sequence: TGG
tttagtagagacgggggttt

SEQ ID NO: 46114 - DNA, 20 bp, Artificial Sequence
  Description of Artificial Sequence: Synthetic oligonucleotide
  Target: ATXN1; (-) strand; PAM type: NRG; PAM sequence: GGG
tgtagttttagtagagacgg

SEQ ID NO: 46115 - DNA, 20 bp, Artificial Sequence
  Description of Artificial Sequence: Synthetic oligonucleotide
  Target: ATXN1; (-) strand; PAM type: NRG; PAM sequence: GGG
ttgtagttttagtagagacg

SEQ ID NO: 46116 - DNA, 20 bp, Artificial Sequence
  Description of Artificial Sequence: Synthetic oligonucleotide
  Target: ATXN1; (-) strand; PAM type: NRG; PAM sequence: GGG
tttgtagttttagtagagac

SEQ ID NO: 46117 - DNA, 20 bp, Artificial Sequence
  Description of Artificial Sequence: Synthetic oligonucleotide
  Target: ATXN1; (-) strand; PAM type: NRG; PAM sequence: CGG
ttttgtagttttagtagaga

SEQ ID NO: 46118 - DNA, 20 bp, Artificial Sequence
  Description of Artificial Sequence: Synthetic oligonucleotide
  Target: ATXN1; (-) strand; PAM type: NRG; PAM sequence: GAG
taatttttgtagttttagta

SEQ ID NO: 46119 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtagttttag

SEQ ID NO: 46120 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttttgtagttt

SEQ ID NO: 46121 - DNA, 20 bp, Artificial Sequence
  Description of Artificial Sequence: Synthetic oligonucleotide
  Target: ATXN1; (-) strand; PAM type: NRG; PAM sequence: TAG
ccatgcctggctaatttttg

SEQ ID NO: 46122 - DNA, 20 bp, Artificial Sequence
  Description of Artificial Sequence: Synthetic oligonucleotide
  Target: ATXN1; (-) strand; PAM type: NRG; PAM sequence: TGG
caggcacaagccaccatgcc

SEQ ID NO: 46123 - DNA, 20 bp, Artificial Sequence
  Description of Artificial Sequence: Synthetic oligonucleotide
  Target: ATXN1; (-) strand; PAM type: NRG; PAM sequence: AAG
gtagcagggattacaggcac

SEQ ID NO: 46124 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagcagggattac

SEQ ID NO: 46125 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagcagggatta

SEQ ID NO: 46126 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagca

SEQ ID NO: 46127 - DNA, 20 bp, Artificial Sequence
  Description of Artificial Sequence: Synthetic oligonucleotide
  Target: ATXN1; (-) strand; PAM type: NRG; PAM sequence: AGG
gcctcagcctcctgagtagc

SEQ ID NO: 46128 - DNA, 20 bp, Artificial Sequence
  Description of Artificial Sequence: Synthetic oligonucleotide
  Target: ATXN1; (-) strand; PAM type: NRG; PAM sequence: CAG
tgcctcagcctcctgagtag

SEQ ID NO: 46129 - DNA, 20 bp, Artificial Sequence
  Description of Artificial Sequence: Synthetic oligonucleotide
  Target: ATXN1; (-) strand; PAM type: NRG; PAM sequence: TAG
tcatgcctcagcctcctgag

SEQ ID NO: 46130 - DNA, 20 bp, Artificial Sequence
  Description of Artificial Sequence: Synthetic oligonucleotide
  Target: ATXN1; (-) strand; PAM type: NRG; PAM sequence: GAG
ttctcatgcctcagcctcct

SEQ ID NO: 46131 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcatgcct

SEQ ID NO: 46132 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcccaggttc

SEQ ID NO: 46133 - DNA, 20 bp, Artificial Sequence
  Description of Artificial Sequence: Synthetic oligonucleotide
  Target: ATXN1; (-) strand; PAM type: NRG; PAM sequence: AGG
cattgcaacctccgcctccc

SEQ ID NO: 46134 - DNA, 20 bp, Artificial Sequence
  Description of Artificial Sequence: Synthetic oligonucleotide
  Target: ATXN1; (-) strand; PAM type: NRG; PAM sequence: CAG
tcattgcaacctccgcctcc

SEQ ID NO: 46135 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggtgcaatct

SEQ ID NO: 46136 - DNA, 20 bp, Artificial Sequence
  Description of Artificial Sequence: Synthetic oligonucleotide
  Target: ATXN1; (-) strand; PAM type: NRG; PAM sequence: TGG
tcgtccaggctggagtgcag

SEQ ID NO: 46137 - DNA, 20 bp, Artificial Sequence
  Description of Artificial Sequence: Synthetic oligonucleotide
  Target: ATXN1; (-) strand; PAM type: NRG; PAM sequence: CAG
ctgtcgtccaggctggagtg

SEQ ID NO: 46138 - DNA, 20 bp, Artificial Sequence
  Description of Artificial Sequence: Synthetic oligonucleotide
  Target: ATXN1; (-) strand; PAM type: NRG; PAM sequence: GAG
ttgctctgtcgtccaggctg

SEQ ID NO: 46139 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgtcgtccaggc

SEQ ID NO: 46140 - DNA, 20 bp, Artificial Sequence
  Description of Artificial Sequence: Synthetic oligonucleotide
  Target: ATXN1; (-) strand; PAM type: NRG; PAM sequence: AGG
aaggtcttgctctgtcgtcc

SEQ ID NO: 46141 - DNA, 20 bp, Artificial Sequence
  Description of Artificial Sequence: Synthetic oligonucleotide
  Target: ATXN1; (-) strand; PAM type: NRG; PAM sequence: CAG
caaggtcttgctctgtcgtc

SEQ ID NO: 46142 - DNA, 20 bp, Artificial Sequence
  Description of Artificial Sequence: Synthetic oligonucleotide
  Target: ATXN1; (-) strand; PAM type: NRG; PAM sequence: AGG
tttttgctttttttgagaca

SEQ ID NO: 46143 - DNA, 20 bp, Artificial Sequence
  Description of Artificial Sequence: Synthetic oligonucleotide
  Target: ATXN1; (-) strand; PAM type: NRG; PAM sequence: AAG
ttttttgctttttttgagac

SEQ ID NO: 46144 - DNA, 20 bp, Artificial Sequence
  Description of Artificial Sequence: Synthetic oligonucleotide
  Target: ATXN1; (-) strand; PAM type: NRG; PAM sequence: GAG
ttttgttttttgcttttttt

SEQ ID NO: 46145 - DNA, 20 bp, Artificial Sequence
  Description of Artificial Sequence: Synthetic oligonucleotide
  Target: ATXN1; (-) strand; PAM type: NRG; PAM sequence: TGG
gccaagtgtgtttgtaattg

SEQ ID NO: 46146 - DNA, 20 bp, Artificial Sequence
  Description of Artificial Sequence: Synthetic oligonucleotide
  Target: ATXN1; (-) strand; PAM type: NRG; PAM sequence: AAG
ctgcttcaagtttaatggcc

SEQ ID NO: 46147 - DNA, 20 bp, Artificial Sequence
  Description of Artificial Sequence: Synthetic oligonucleotide
  Target: ATXN1; (-) strand; PAM type: NRG; PAM sequence: TGG
tttcactgcttcaagtttaa

SEQ ID NO: 46148 - DNA, 20 bp, Artificial Sequence
  Description of Artificial Sequence: Synthetic oligonucleotide
  Target: ATXN1; (-) strand; PAM type: NRG; PAM sequence: AAG
aagctgtttttcactgcttc

SEQ ID NO: 46149 - DNA, 20 bp, Artificial Sequence
  Description of Artificial Sequence: Synthetic oligonucleotide
  Target: ATXN1; (-) strand; PAM type: NRG; PAM sequence: AAG
tttatttattctcgtagacg

SEQ ID NO: 46150 - DNA, 20 bp, Artificial Sequence
  Description of Artificial Sequence: Synthetic oligonucleotide
  Target: ATXN1; (-) strand; PAM type: NRG; PAM sequence: TAG
tttttatttatttattctcg

SEQ ID NO: 46151 - DNA, 20 bp, Artificial Sequence
  Description of Artificial Sequence: Synthetic oligonucleotide
  Target: ATXN1; (-) strand; PAM type: NRG; PAM sequence: CAG
ttaaagcataatgcctgtag

SEQ ID NO: 46152 - DNA, 20 bp, Artificial Sequence
  Description of Artificial Sequence: Synthetic oligonucleotide
  Target: ATXN1; (-) strand; PAM type: NRG; PAM sequence: TAG
atcttaaagcataatgcctg

SEQ ID NO: 46153 - DNA, 20 bp, Artificial Sequence
  Description of Artificial Sequence: Synthetic oligonucleotide
  Target: ATXN1; (-) strand; PAM type: NRG; PAM sequence: AAG
catgcacgattgtgatctta

SEQ ID NO: 46154 - DNA, 20 bp, Artificial Sequence
  Description of Artificial Sequence: Synthetic oligonucleotide
  Target: ATXN1; (-) strand; PAM type: NRG; PAM sequence: GGG
atttctgattatcgactcag

SEQ ID NO: 46155 - DNA, 20 bp, Artificial Sequence
  Description of Artificial Sequence: Synthetic oligonucleotide
  Target: ATXN1; (-) strand; PAM type: NRG; PAM sequence: GGG
tatttctgattatcgactca

SEQ ID NO: 46156 - DNA, 20 bp, Artificial Sequence
  Description of Artificial Sequence: Synthetic oligonucleotide
  Target: ATXN1; (-) strand; PAM type: NRG; PAM sequence: AGG
gtatttctgattatcgactc

SEQ ID NO: 46157 - DNA, 20 bp, Artificial Sequence
  Description of Artificial Sequence: Synthetic oligonucleotide
  Target: ATXN1; (-) strand; PAM type: NRG; PAM sequence: CAG
tgtatttctgattatcgact

SEQ ID NO: 46158 - DNA, 20 bp, Artificial Sequence
  Description of Artificial Sequence: Synthetic oligonucleotide
  Target: ATXN1; (-) strand; PAM type: NRG; PAM sequence: CAG
acagaggatgtgtattttta

SEQ ID NO: 46159 - DNA, 20 bp, Artificial Sequence
  Description of Artificial Sequence: Synthetic oligonucleotide
  Target: ATXN1; (-) strand; PAM type: NRG; PAM sequence: AGG
acaatcttgggaaactacag

SEQ ID NO: 46160 - DNA, 20 bp, Artificial Sequence
  Description of Artificial Sequence: Synthetic oligonucleotide
  Target: ATXN1; (-) strand; PAM type: NRG; PAM sequence: GAG
cacaatcttgggaaactaca

SEQ ID NO: 46161 - DNA, 20 bp, Artificial Sequence
  Description of Artificial Sequence: Synthetic oligonucleotide
  Target: ATXN1; (-) strand; PAM type: NRG; PAM sequence: CAG
tacacaatcttgggaaacta

SEQ ID NO: 46162 - DNA, 20 bp, Artificial Sequence
  Description of Artificial Sequence: Synthetic oligonucleotide
  Target: ATXN1; (-) strand; PAM type: NRG; PAM sequence: GGG
gcccagacctacacaatctt

SEQ ID NO: 46163 - DNA, 20 bp, Artificial Sequence
  Description of Artificial Sequence: Synthetic oligonucleotide
  Target: ATXN1; (-) strand; PAM type: NRG; PAM sequence: TGG
agcccagacctacacaatct

SEQ ID NO: 46164 - DNA, 20 bp, Artificial Sequence
  Description of Artificial Sequence: Synthetic oligonucleotide
  Target: ATXN1; (-) strand; PAM type: NRG; PAM sequence: CAG
cagattcctaggtcccagcc

SEQ ID NO: 46165 - DNA, 20 bp, Artificial Sequence
  Description of Artificial Sequence: Synthetic oligonucleotide
  Target: ATXN1; (-) strand; PAM type: NRG; PAM sequence: CAG
aaatacagattcctaggtcc

SEQ ID NO: 46166 - DNA, 20 bp, Artificial Sequence
  Description of Artificial Sequence: Synthetic oligonucleotide
  Target: ATXN1; (-) strand; PAM type: NRG; PAM sequence: AGG
tttttaaaatacagattcct

SEQ ID NO: 46167 - DNA, 20 bp, Artificial Sequence
  Description of Artificial Sequence: Synthetic oligonucleotide
  Target: ATXN1; (-) strand; PAM type: NRG; PAM sequence: TAG
atttttaaaatacagattcc

SEQ ID NO: 46168 - DNA, 20 bp, Artificial Sequence
  Description of Artificial Sequence: Synthetic oligonucleotide
  Target: ATXN1; (-) strand; PAM type: NRG; PAM sequence: CAG
caaaagagatttttaaaata

SEQ ID NO: 46169 - DNA, 20 bp, Artificial Sequence
  Description of Artificial Sequence: Synthetic oligonucleotide
  Target: ATXN1; (-) strand; PAM type: NRG; PAM sequence: GAG
gccaatcagaatcaccaaaa

SEQ ID NO: 46170 - DNA, 20 bp, Artificial Sequence
  Description of Artificial Sequence: Synthetic oligonucleotide
  Target: ATXN1; (-) strand; PAM type: NRG; PAM sequence: AAG
ctgccaatcagaatcaccaa

SEQ ID NO: 46171 - DNA, 20 bp, Artificial Sequence
  Description of Artificial Sequence: Synthetic oligonucleotide
  Target: ATXN1; (-) strand; PAM type: NRG; PAM sequence: CAG
tccccaacctagctgccaat

SEQ ID NO: 46172 - DNA, 20 bp, Artificial Sequence
  Description of Artificial Sequence: Synthetic oligonucleotide
  Target: ATXN1; (-) strand; PAM type: NRG; PAM sequence: TAG
agtgtagtagttccccaacc

SEQ ID NO: 46173 - DNA, 20 bp, Artificial Sequence
  Description of Artificial Sequence: Synthetic oligonucleotide
  Target: ATXN1; (-) strand; PAM type: NRG; PAM sequence: TAG
gaagcacaggtctagtgtag

SEQ ID NO: 46174 - DNA, 20 bp, Artificial Sequence
  Description of Artificial Sequence: Synthetic oligonucleotide
  Target: ATXN1; (-) strand; PAM type: NRG; PAM sequence: TAG
taagaagcacaggtctagtg

SEQ ID NO: 46175 - DNA, 20 bp, Artificial Sequence
  Description of Artificial Sequence: Synthetic oligonucleotide
  Target: ATXN1; (-) strand; PAM type: NRG; PAM sequence: TAG
aaggttaagaagcacaggtc

SEQ ID NO: 46176 - DNA, 20 bp, Artificial Sequence
  Description of Artificial Sequence: Synthetic oligonucleotide
  Target: ATXN1; (-) strand; PAM type: NRG; PAM sequence: AGG
ctgccaaggttaagaagcac

SEQ ID NO: 46177 - DNA, 20 bp, Artificial Sequence
  Description of Artificial Sequence: Synthetic oligonucleotide
  Target: ATXN1; (-) strand; PAM type: NRG; PAM sequence: CAG
gctgccaaggttaagaagca

SEQ ID NO: 46178 - DNA, 20 bp, Artificial Sequence
  Description of Artificial Sequence: Synthetic oligonucleotide
  Target: ATXN1; (-) strand; PAM type: NRG; PAM sequence: AAG
cctgtgctgccaaggttaag

SEQ ID NO: 46179 - DNA, 20 bp, Artificial Sequence
  Description of Artificial Sequence: Synthetic oligonucleotide
  Target: ATXN1; (-) strand; PAM type: NRG; PAM sequence: AAG
tctcctgtgctgccaaggtt

SEQ ID NO: 46180 - DNA, 20 bp, Artificial Sequence
  Description of Artificial Sequence: Synthetic oligonucleotide
  Target: ATXN1; (-) strand; PAM type: NRG; PAM sequence: AGG
gtgattctcctgtgctgcca

SEQ ID NO: 46181 - DNA, 20 bp, Artificial Sequence
  Description of Artificial Sequence: Synthetic oligonucleotide
  Target: ATXN1; (-) strand; PAM type: NRG; PAM sequence: AAG
ggtgattctcctgtgctgcc

SEQ ID NO: 46182 - DNA, 20 bp, Artificial Sequence
  Description of Artificial Sequence: Synthetic oligonucleotide
  Target: ATXN1; (-) strand; PAM type: NRG; PAM sequence: AGG
agacttttcaaaatctttcc

SEQ ID NO: 46183 - DNA, 20 bp, Artificial Sequence
  Description of Artificial Sequence: Synthetic oligonucleotide
  Target: ATXN1; (-) strand; PAM type: NRG; PAM sequence: CAG
aagacttttcaaaatctttc

SEQ ID NO: 46184 - DNA, 20 bp, Artificial Sequence
  Description of Artificial Sequence: Synthetic oligonucleotide
  Target: ATXN1; (-) strand; PAM type: NRG; PAM sequence: AAG
tggagtgtggtgtgaccggc

SEQ ID NO: 46185 - DNA, 20 bp, Artificial Sequence
  Description of Artificial Sequence: Synthetic oligonucleotide
  Target: ATXN1; (-) strand; PAM type: NRG; PAM sequence: CGG
ggcctggagtgtggtgtgac

SEQ ID NO: 46186 - DNA, 20 bp, Artificial Sequence
  Description of Artificial Sequence: Synthetic oligonucleotide
  Target: ATXN1; (-) strand; PAM type: NRG; PAM sequence: TGG
gagttcagtggcctggagtg

SEQ ID NO: 46187 - DNA, 20 bp, Artificial Sequence
  Description of Artificial Sequence: Synthetic oligonucleotide
  Target: ATXN1; (-) strand; PAM type: NRG; PAM sequence: GAG
gttctgagttcagtggcctg

SEQ ID NO: 46188 - DNA, 20 bp, Artificial Sequence
  Description of Artificial Sequence: Synthetic oligonucleotide
  Target: ATXN1; (-) strand; PAM type: NRG; PAM sequence: TGG
aggttctgagttcagtggcc

SEQ ID NO: 46189 - DNA, 20 bp, Artificial Sequence
  Description of Artificial Sequence: Synthetic oligonucleotide
  Target: ATXN1; (-) strand; PAM type: NRG; PAM sequence: TGG
cctataggttctgagttcag

SEQ ID NO: 46190 - DNA, 20 bp, Artificial Sequence
  Description of Artificial Sequence: Synthetic oligonucleotide
  Target: ATXN1; (-) strand; PAM type: NRG; PAM sequence: CAG
gaccctataggttctgagtt

SEQ ID NO: 46191 - DNA, 20 bp, Artificial Sequence
  Description of Artificial Sequence: Synthetic oligonucleotide
  Target: ATXN1; (-) strand; PAM type: NRG; PAM sequence: GAG
actccgaccctataggttct

SEQ ID NO: 46192 - DNA, 20 bp, Artificial Sequence
  Description of Artificial Sequence: Synthetic oligonucleotide
  Target: ATXN1; (-) strand; PAM type: NRG; PAM sequence: AGG
gatacccactccgaccctat

SEQ ID NO: 46193 - DNA, 20 bp, Artificial Sequence
  Description of Artificial Sequence: Synthetic oligonucleotide
  Target: ATXN1; (-) strand; PAM type: NRG; PAM sequence: TAG
tgatacccactccgacccta

SEQ ID NO: 46194 - DNA, 20 bp, Artificial Sequence
  Description of Artificial Sequence: Synthetic oligonucleotide
  Target: ATXN1; (-) strand; PAM type: NRG; PAM sequence: TGG
actgcactgattctcaacca

SEQ ID NO: 46195 - DNA, 20 bp, Artificial Sequence
  Description of Artificial Sequence: Synthetic oligonucleotide
  Target: ATXN1; (-) strand; PAM type: NRG; PAM sequence: GGG
ttcctccgtcagggaactga

SEQ ID NO: 46196 - DNA, 20 bp, Artificial Sequence
  Description of Artificial Sequence: Synthetic oligonucleotide
  Target: ATXN1; (-) strand; PAM type: NRG; PAM sequence: AGG
gttcctccgtcagggaactg

SEQ ID NO: 46197 - DNA, 20 bp, Artificial Sequence
  Description of Artificial Sequence: Synthetic oligonucleotide
  Target: ATXN1; (-) strand; PAM type: NRG; PAM sequence: GAG
tgttcctccgtcagggaact

SEQ ID NO: 46198 - DNA, 20 bp, Artificial Sequence
  Description of Artificial Sequence: Synthetic oligonucleotide
  Target: ATXN1; (-) strand; PAM type: NRG; PAM sequence: GGG
atgaatatgttcctccgtca

SEQ ID NO: 46199 - DNA, 20 bp, Artificial Sequence
  Description of Artificial Sequence: Synthetic oligonucleotide
  Target: ATXN1; (-) strand; PAM type: NRG; PAM sequence: AGG
catgaatatgttcctccgtc

SEQ ID NO: 46200 - DNA, 20 bp, Artificial Sequence
  Description of Artificial Sequence: Synthetic oligonucleotide
  Target: ATXN1; (-) strand; PAM type: NRG; PAM sequence: CAG
acatgaatatgttcctccgt

SEQ ID NO: 46201 - DNA, 20 bp, Artificial Sequence
  Description of Artificial Sequence: Synthetic oligonucleotide
  Target: ATXN1; (-) strand; PAM type: NRG; PAM sequence: AGG
tggagggcactgttttaggg

SEQ ID NO: 46202 - DNA, 20 bp, Artificial Sequence
  Description of Artificial Sequence: Synthetic oligonucleotide
  Target: ATXN1; (-) strand; PAM type: NRG; PAM sequence: GAG
gtggagggcactgttttagg

SEQ ID NO: 46203 - DNA, 20 bp, Artificial Sequence
  Description of Artificial Sequence: Synthetic oligonucleotide
  Target: ATXN1; (-) strand; PAM type: NRG; PAM sequence: GGG
ttgtggagggcactgtttta

SEQ ID NO: 46204 - DNA, 20 bp, Artificial Sequence
  Description of Artificial Sequence: Synthetic oligonucleotide
  Target: ATXN1; (-) strand; PAM type: NRG; PAM sequence: AGG
attgtggagggcactgtttt

SEQ ID NO: 46205 - DNA, 20 bp, Artificial Sequence
  Description of Artificial Sequence: Synthetic oligonucleotide
  Target: ATXN1; (-) strand; PAM type: NRG; PAM sequence: TAG
tattgtggagggcactgttt

SEQ ID NO: 46206 - DNA, 20 bp, Artificial Sequence
  Description of Artificial Sequence: Synthetic oligonucleotide
  Target: ATXN1; (-) strand; PAM type: NRG; PAM sequence: GGG
gggtctggctttattgtgga

SEQ ID NO: 46207 - DNA, 20 bp, Artificial Sequence
  Description of Artificial Sequence: Synthetic oligonucleotide
  Target: ATXN1; (-) strand; PAM type: NRG; PAM sequence: AGG
ggggtctggctttattgtgg

SEQ ID NO: 46208 - DNA, 20 bp, Artificial Sequence
  Description of Artificial Sequence: Synthetic oligonucleotide
  Target: ATXN1; (-) strand; PAM type: NRG; PAM sequence: GAG
gggggtctggctttattgtg

SEQ ID NO: 46209 - DNA, 20 bp, Artificial Sequence
  Description of Artificial Sequence: Synthetic oligonucleotide
  Target: ATXN1; (-) strand; PAM type: NRG; PAM sequence: TGG
aagggggtctggctttattg

SEQ ID NO: 46210 - DNA, 20 bp, Artificial Sequence
  Description of Artificial Sequence: Synthetic oligonucleotide
  Target: ATXN1; (-) strand; PAM type: NRG; PAM sequence: TGG
aagatagaaggaagggggtc

SEQ ID NO: 46211 - DNA, 20 bp, Artificial Sequence
  Description of Artificial Sequence: Synthetic oligonucleotide
  Target: ATXN1; (-) strand; PAM type: NRG; PAM sequence: GGG
gaaataagatagaaggaagg

SEQ ID NO: 46212 - DNA, 20 bp, Artificial Sequence
  Description of Artificial Sequence: Synthetic oligonucleotide
  Target: ATXN1; (-) strand; PAM type: NRG; PAM sequence: GGG
tgaaataagatagaaggaag

SEQ ID NO: 46213 - DNA, 20 bp, Artificial Sequence
  Description of Artificial Sequence: Synthetic oligonucleotide
  Target: ATXN1; (-) strand; PAM type: NRG; PAM sequence: GGG
gtgaaataagatagaaggaa

SEQ ID NO: 46214 - DNA, 20 bp, Artificial Sequence
  Description of Artificial Sequence: Synthetic oligonucleotide
  Target: ATXN1; (-) strand; PAM type: NRG; PAM sequence: AGG
agtgaaataagatagaagga

SEQ ID NO: 46215 - DNA, 20 bp, Artificial Sequence
  Description of Artificial Sequence: Synthetic oligonucleotide
  Target: ATXN1; (-) strand; PAM type: NRG; PAM sequence: AAG
aagtgaaataagatagaagg

SEQ ID NO: 46216 - DNA, 20 bp, Artificial Sequence
  Description of Artificial Sequence: Synthetic oligonucleotide
  Target: ATXN1; (-) strand; PAM type: NRG; PAM sequence: AGG
aataagtgaaataagataga

SEQ ID NO: 46217 - DNA, 20 bp, Artificial Sequence
  Description of Artificial Sequence: Synthetic oligonucleotide
  Target: ATXN1; (-) strand; PAM type: NRG; PAM sequence: AAG
aaataagtgaaataagatag

SEQ ID NO: 46218 - DNA, 20 bp, Artificial Sequence
  Description of Artificial Sequence: Synthetic oligonucleotide
  Target: ATXN1; (-) strand; PAM type: NRG; PAM sequence: TAG
aaaaaataagtgaaataaga

SEQ ID NO: 46219 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaataagtgaaat

SEQ ID NO: 46220 - DNA, 20 bp, Artificial Sequence
  Description of Artificial Sequence: Synthetic oligonucleotide
  Target: ATXN1; (-) strand; PAM type: NRG; PAM sequence: AAG
tccatctcaaaaaaaaaaat

SEQ ID NO: 46221 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggcgacagagc

SEQ ID NO: 46222 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcgaca

SEQ ID NO: 46223 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcga

SEQ ID NO: 46224 - DNA, 20 bp, Artificial Sequence
  Description of Artificial Sequence: Synthetic oligonucleotide
  Target: ATXN1; (-) strand; PAM type: NRG; PAM sequence: GGG
gcaccactgcactccagcct

SEQ ID NO: 46225 - DNA, 20 bp, Artificial Sequence
  Description of Artificial Sequence: Synthetic oligonucleotide
  Target: ATXN1; (-) strand; PAM type: NRG; PAM sequence: TGG
tgcaccactgcactccagcc

SEQ ID NO: 46226 - DNA, 20 bp, Artificial Sequence
  Description of Artificial Sequence: Synthetic oligonucleotide
  Target: ATXN1; (-) strand; PAM type: NRG; PAM sequence: CAG
gagattgcaccactgcactc

SEQ ID NO: 46227 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagcc

SEQ ID NO: 46228 - DNA, 20 bp, Artificial Sequence
  Description of Artificial Sequence: Synthetic oligonucleotide
  Target: ATXN1; (-) strand; PAM type: NRG; PAM sequence: GAG
caggaggcagaggttgcagt

SEQ ID NO: 46229 - DNA, 20 bp, Artificial Sequence
  Description of Artificial Sequence: Synthetic oligonucleotide
  Target: ATXN1; (-) strand; PAM type: NRG; PAM sequence: CAG
aacccaggaggcagaggttg

SEQ ID NO: 46230 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacccaggaggcag

SEQ ID NO: 46231 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccaggaggca

SEQ ID NO: 46232 - DNA, 20 bp, Artificial Sequence
  Description of Artificial Sequence: Synthetic oligonucleotide
  Target: ATXN1; (-) strand; PAM type: NRG; PAM sequence: CAG
aatcgcttgaacccaggagg

SEQ ID NO: 46233 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacccagg

SEQ ID NO: 46234 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaacccag

SEQ ID NO: 46235 - DNA, 20 bp, Artificial Sequence
  Description of Artificial Sequence: Synthetic oligonucleotide
  Target: ATXN1; (-) strand; PAM type: NRG; PAM sequence: AGG
caggagaatcgcttgaaccc

SEQ ID NO: 46236 - DNA, 20 bp, Artificial Sequence
  Description of Artificial Sequence: Synthetic oligonucleotide
  Target: ATXN1; (-) strand; PAM type: NRG; PAM sequence: CAG
gcaggagaatcgcttgaacc

SEQ ID NO: 46237 - DNA, 20 bp, Artificial Sequence
  Description of Artificial Sequence: Synthetic oligonucleotide
  Target: ATXN1; (-) strand; PAM type: NRG; PAM sequence: GAG
tactagagaggctgaggcag

SEQ ID NO: 46238 - DNA, 20 bp, Artificial Sequence
  Description of Artificial Sequence: Synthetic oligonucleotide
  Target: ATXN1; (-) strand; PAM type: NRG; PAM sequence: AGG
gctactagagaggctgaggc

SEQ ID NO: 46239 - DNA, 20 bp, Artificial Sequence
  Description of Artificial Sequence: Synthetic oligonucleotide
  Target: ATXN1; (-) strand; PAM type: NRG; PAM sequence: CAG
agctactagagaggctgagg

SEQ ID NO: 46240 - DNA, 20 bp, Artificial Sequence
  Description of Artificial Sequence: Synthetic oligonucleotide
  Target: ATXN1; (-) strand; PAM type: NRG; PAM sequence: AGG
cccagctactagagaggctg

SEQ ID NO: 46241 - DNA, 20 bp, Artificial Sequence
  Description of Artificial Sequence: Synthetic oligonucleotide
  Target: ATXN1; (-) strand; PAM type: NRG; PAM sequence: GAG
tcccagctactagagaggct

SEQ ID NO: 46242 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctactagag

SEQ ID NO: 46243 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctactaga

SEQ ID NO: 46244 - DNA, 20 bp, Artificial Sequence
  Description of Artificial Sequence: Synthetic oligonucleotide
  Target: ATXN1; (-) strand; PAM type: NRG; PAM sequence: GAG
acctgtagtcccagctacta

SEQ ID NO: 46245 - DNA, 20 bp, Artificial Sequence
  Description of Artificial Sequence: Synthetic oligonucleotide
  Target: ATXN1; (-) strand; PAM type: NRG; PAM sequence: TAG
acacctgtagtcccagctac

SEQ ID NO: 46246 - DNA, 20 bp, Artificial Sequence
  Description of Artificial Sequence: Synthetic oligonucleotide
  Target: ATXN1; (-) strand; PAM type: NRG; PAM sequence: CAG
gtggcgcacacctgtagtcc

SEQ ID NO: 46247 - DNA, 20 bp, Artificial Sequence
  Description of Artificial Sequence: Synthetic oligonucleotide
  Target: ATXN1; (-) strand; PAM type: NRG; PAM sequence: TAG
ggcatggtggcgcacacctg

SEQ ID NO: 46248 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggcatgg

SEQ ID NO: 46249 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaattagccaggca

SEQ ID NO: 46250 - DNA, 20 bp, Artificial Sequence
  Description of Artificial Sequence: Synthetic oligonucleotide
  Target: ATXN1; (-) strand; PAM type: NRG; PAM sequence: AGG
aaaaatacaaaaaattagcc

SEQ ID NO: 46251 - DNA, 20 bp, Artificial Sequence
  Description of Artificial Sequence: Synthetic oligonucleotide
  Target: ATXN1; (-) strand; PAM type: NRG; PAM sequence: CAG
taaaaatacaaaaaattagc

SEQ ID NO: 46252 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatacaaaaaat

SEQ ID NO: 46253 - DNA, 20 bp, Artificial Sequence
  Description of Artificial Sequence: Synthetic oligonucleotide
  Target: ATXN1; (-) strand; PAM type: NRG; PAM sequence: CAG
tgagaccatcctggctaaca

SEQ ID NO: 46254 - DNA, 20 bp, Artificial Sequence
  Description of Artificial Sequence: Synthetic oligonucleotide
  Target: ATXN1; (-) strand; PAM type: NRG; PAM sequence: TGG
tcaggagattgagaccatcc

SEQ ID NO: 46255 - DNA, 20 bp, Artificial Sequence
  Description of Artificial Sequence: Synthetic oligonucleotide
  Target: ATXN1; (-) strand; PAM type: NRG; PAM sequence: GAG
gatcaggaggtcaggagatt

SEQ ID NO: 46256 - DNA, 20 bp, Artificial Sequence
  Description of Artificial Sequence: Synthetic oligonucleotide
  Target: ATXN1; (-) strand; PAM type: NRG; PAM sequence: GAG
caggtagatcaggaggtcag

SEQ ID NO: 46257 - DNA, 20 bp, Artificial Sequence
  Description of Artificial Sequence: Synthetic oligonucleotide
  Target: ATXN1; (-) strand; PAM type: NRG; PAM sequence: AGG
ggcaggtagatcaggaggtc

SEQ ID NO: 46258 - DNA, 20 bp, Artificial Sequence
  Description of Artificial Sequence: Synthetic oligonucleotide
  Target: ATXN1; (-) strand; PAM type: NRG; PAM sequence: CAG
aggcaggtagatcaggaggt

SEQ ID NO: 46259 - DNA, 20 bp, Artificial Sequence
  Description of Artificial Sequence: Synthetic oligonucleotide
  Target: ATXN1; (-) strand; PAM type: NRG; PAM sequence: AGG
gctgaggcaggtagatcagg

SEQ ID NO: 46260 - DNA, 20 bp, Artificial Sequence
  Description of Artificial Sequence: Synthetic oligonucleotide
  Target: ATXN1; (-) strand; PAM type: NRG; PAM sequence: GAG
ggctgaggcaggtagatcag

SEQ ID NO: 46261 - DNA, 20 bp, Artificial Sequence
  Description of Artificial Sequence: Synthetic oligonucleotide
  Target: ATXN1; (-) strand; PAM type: NRG; PAM sequence: AGG
gaggctgaggcaggtagatc

SEQ ID NO: 46262 - DNA, 20 bp, Artificial Sequence
  Description of Artificial Sequence: Synthetic oligonucleotide
  Target: ATXN1; (-) strand; PAM type: NRG; PAM sequence: CAG
ggaggctgaggcaggtagat

SEQ ID NO: 46263 - DNA, 20 bp, Artificial Sequence
  Description of Artificial Sequence: Synthetic oligonucleotide
  Target: ATXN1; (-) strand; PAM type: NRG; PAM sequence: TAG
ctttgggaggctgaggcagg

SEQ ID NO: 46264 - DNA, 20 bp, Artificial Sequence
  Description of Artificial Sequence: Synthetic oligonucleotide
  Target: ATXN1; (-) strand; PAM type: NRG; PAM sequence: AGG
acactttgggaggctgaggc

SEQ ID NO: 46265 - DNA, 20 bp, Artificial Sequence
  Description of Artificial Sequence: Synthetic oligonucleotide
  Target: ATXN1; (-) strand; PAM type: NRG; PAM sequence: CAG
cacactttgggaggctgagg

SEQ ID NO: 46266 - DNA, 20 bp, Artificial Sequence
  Description of Artificial Sequence: Synthetic oligonucleotide
  Target: ATXN1; (-) strand; PAM type: NRG; PAM sequence: AGG
ccccacactttgggaggctg

SEQ ID NO: 46267 - DNA, 20 bp, Artificial Sequence
  Description of Artificial Sequence: Synthetic oligonucleotide
  Target: ATXN1; (-) strand; PAM type: NRG; PAM sequence: GAG
tccccacactttgggaggct

SEQ ID NO: 46268 - DNA, 20 bp, Artificial Sequence
  Description of Artificial Sequence: Synthetic oligonucleotide
  Target: ATXN1; (-) strand; PAM type: NRG; PAM sequence: AGG
tgtaatccccacactttggg

SEQ ID NO: 46269 - DNA, 20 bp, Artificial Sequence
  Description of Artificial Sequence: Synthetic oligonucleotide
  Target: ATXN1; (-) strand; PAM type: NRG; PAM sequence: GAG
ctgtaatccccacactttgg

SEQ ID NO: 46270 - DNA, 20 bp, Artificial Sequence
  Description of Artificial Sequence: Synthetic oligonucleotide
  Target: ATXN1; (-) strand; PAM type: NRG; PAM sequence: GGG
ggctgtaatccccacacttt

SEQ ID NO: 46271 - DNA, 20 bp, Artificial Sequence
  Description of Artificial Sequence: Synthetic oligonucleotide
  Target: ATXN1; (-) strand; PAM type: NRG; PAM sequence: TGG
tggctgtaatccccacactt

SEQ ID NO: 46272 - DNA, 20 bp, Artificial Sequence
  Description of Artificial Sequence: Synthetic oligonucleotide
  Target: ATXN1; (-) strand; PAM type: NRG; PAM sequence: TGG
atagaagggtccgagtgcgg

SEQ ID NO: 46273 - DNA, 20 bp, Artificial Sequence
  Description of Artificial Sequence: Synthetic oligonucleotide
  Target: ATXN1; (-) strand; PAM type: NRG; PAM sequence: CGG
aaaatagaagggtccgagtg

SEQ ID NO: 46274 - DNA, 20 bp, Artificial Sequence
  Description of Artificial Sequence: Synthetic oligonucleotide
  Target: ATXN1; (-) strand; PAM type: NRG; PAM sequence: GAG
tttataaaatagaagggtcc

SEQ ID NO: 46275 - DNA, 20 bp, Artificial Sequence
  Description of Artificial Sequence: Synthetic oligonucleotide
  Target: ATXN1; (-) strand; PAM type: NRG; PAM sequence: GGG
cccagctttataaaatagaa

SEQ ID NO: 46276 - DNA, 20 bp, Artificial Sequence
  Description of Artificial Sequence: Synthetic oligonucleotide
  Target: ATXN1; (-) strand; PAM type: NRG; PAM sequence: AGG
acccagctttataaaataga

SEQ ID NO: 46277 - DNA, 20 bp, Artificial Sequence
  Description of Artificial Sequence: Synthetic oligonucleotide
  Target: ATXN1; (-) strand; PAM type: NRG; PAM sequence: AAG
aacccagctttataaaatag

SEQ ID NO: 46278 - DNA, 20 bp, Artificial Sequence
  Description of Artificial Sequence: Synthetic oligonucleotide
  Target: ATXN1; (-) strand; PAM type: NRG; PAM sequence: TAG
tgtaacccagctttataaaa

SEQ ID NO: 46279 - DNA, 20 bp, Artificial Sequence
  Description of Artificial Sequence: Synthetic oligonucleotide
  Target: ATXN1; (-) strand; PAM type: NRG; PAM sequence: CAG
aacaaattccatgtgtaacc

SEQ ID NO: 46280 - DNA, 20 bp, Artificial Sequence
  Description of Artificial Sequence: Synthetic oligonucleotide
  Target: ATXN1; (-) strand; PAM type: NRG; PAM sequence: TGG
tttgttttctgggaaaagct

SEQ ID NO: 46281 - DNA, 20 bp, Artificial Sequence
  Description of Artificial Sequence: Synthetic oligonucleotide
  Target: ATXN1; (-) strand; PAM type: NRG; PAM sequence: AAG
tcgattttgttttctgggaa

SEQ ID NO: 46282 - DNA, 20 bp, Artificial Sequence
  Description of Artificial Sequence: Synthetic oligonucleotide
  Target: ATXN1; (-) strand; PAM type: NRG; PAM sequence: GGG
aggactcgattttgttttct

SEQ ID NO: 46283 - DNA, 20 bp, Artificial Sequence
  Description of Artificial Sequence: Synthetic oligonucleotide
  Target: ATXN1; (-) strand; PAM type: NRG; PAM sequence: TGG
aaggactcgattttgttttc

SEQ ID NO: 46284 - DNA, 20 bp, Artificial Sequence
  Description of Artificial Sequence: Synthetic oligonucleotide
  Target: ATXN1; (-) strand; PAM type: NRG; PAM sequence: AGG
atctaaaaactttgtttaaa

SEQ ID NO: 46285 - DNA, 20 bp, Artificial Sequence
  Description of Artificial Sequence: Synthetic oligonucleotide
  Target: ATXN1; (-) strand; PAM type: NRG; PAM sequence: AAG
tatctaaaaactttgtttaa

SEQ ID NO: 46286 - DNA, 20 bp, Artificial Sequence
  Description of Artificial Sequence: Synthetic oligonucleotide
  Target: ATXN1; (-) strand; PAM type: NRG; PAM sequence: TAG
agctctcacccctcaaagtg

SEQ ID NO: 46287 - DNA, 20 bp, Artificial Sequence
  Description of Artificial Sequence: Synthetic oligonucleotide
  Target: ATXN1; (-) strand; PAM type: NRG; PAM sequence: AAG
tttagagctctcacccctca

SEQ ID NO: 46288 - DNA, 20 bp, Artificial Sequence
  Description of Artificial Sequence: Synthetic oligonucleotide
  Target: ATXN1; (-) strand; PAM type: NRG; PAM sequence: GAG
agcaactaaggttcttttta

SEQ ID NO: 46289 - DNA, 20 bp, Artificial Sequence
  Description of Artificial Sequence: Synthetic oligonucleotide
  Target: ATXN1; (-) strand; PAM type: NRG; PAM sequence: TAG
caagcaactaaggttctttt

SEQ ID NO: 46290 - DNA, 20 bp, Artificial Sequence
  Description of Artificial Sequence: Synthetic oligonucleotide
  Target: ATXN1; (-) strand; PAM type: NRG; PAM sequence: AGG
ttgttgcctccaagcaacta

SEQ ID NO: 46291 - DNA, 20 bp, Artificial Sequence
  Description of Artificial Sequence: Synthetic oligonucleotide
  Target: ATXN1; (-) strand; PAM type: NRG; PAM sequence: AAG
cttgttgcctccaagcaact

SEQ ID NO: 46292 - DNA, 20 bp, Artificial Sequence
  Description of Artificial Sequence: Synthetic oligonucleotide
  Target: ATXN1; (-) strand; PAM type: NRG; PAM sequence: AAG
ttgatctacttgttgcctcc

SEQ ID NO: 46293 - DNA, 20 bp, Artificial Sequence
  Description of Artificial Sequence: Synthetic oligonucleotide
  Target: ATXN1; (-) strand; PAM type: NRG; PAM sequence: TGG
agaggatgtcaggcacctgt

SEQ ID NO: 46294 - DNA, 20 bp, Artificial Sequence
  Description of Artificial Sequence: Synthetic oligonucleotide
  Target: ATXN1; (-) strand; PAM type: NRG; PAM sequence: AGG
aacaacccagagaggatgtc

SEQ ID NO: 46295 - DNA, 20 bp, Artificial Sequence
  Description of Artificial Sequence: Synthetic oligonucleotide
  Target: ATXN1; (-) strand; PAM type: NRG; PAM sequence: CAG
gaacaacccagagaggatgt

SEQ ID NO: 46296 - DNA, 20 bp, Artificial Sequence
  Description of Artificial Sequence: Synthetic oligonucleotide
  Target: ATXN1; (-) strand; PAM type: NRG; PAM sequence: AGG
atcagaagaacaacccagag

SEQ ID NO: 46297 - DNA, 20 bp, Artificial Sequence
  Description of Artificial Sequence: Synthetic oligonucleotide
  Target: ATXN1; (-) strand; PAM type: NRG; PAM sequence: GAG
aatcagaagaacaacccaga

SEQ ID NO: 46298 - DNA, 20 bp, Artificial Sequence
  Description of Artificial Sequence: Synthetic oligonucleotide
  Target: ATXN1; (-) strand; PAM type: NRG; PAM sequence: GAG
caaatcagaagaacaaccca

SEQ ID NO: 46299 - DNA, 20 bp, Artificial Sequence
  Description of Artificial Sequence: Synthetic oligonucleotide
  Target: ATXN1; (-) strand; PAM type: NRG; PAM sequence: CAG
cacaaatcagaagaacaacc

SEQ ID NO: 46300 - DNA, 20 bp, Artificial Sequence
  Description of Artificial Sequence: Synthetic oligonucleotide
  Target: ATXN1; (-) strand; PAM type: NRG; PAM sequence: AAG
ttgtacccatcacaaatcag

SEQ ID NO: 46301 - DNA, 20 bp, Artificial Sequence
  Description of Artificial Sequence: Synthetic oligonucleotide
  Target: ATXN1; (-) strand; PAM type: NRG; PAM sequence: CAG
ttcttgtacccatcacaaat

SEQ ID NO: 46302 - DNA, 20 bp, Artificial Sequence
  Description of Artificial Sequence: Synthetic oligonucleotide
  Target: ATXN1; (-) strand; PAM type: NRG; PAM sequence: GAG
tcttgcatatcagaaaatct

SEQ ID NO: 46303 - DNA, 20 bp, Artificial Sequence
  Description of Artificial Sequence: Synthetic oligonucleotide
  Target: ATXN1; (-) strand; PAM type: NRG; PAM sequence: CAG
ctgtagagtttcttgcatat

SEQ ID NO: 46304 - DNA, 20 bp, Artificial Sequence
  Description of Artificial Sequence: Synthetic oligonucleotide
  Target: ATXN1; (-) strand; PAM type: NRG; PAM sequence: GAG
ggctgctgctccactctgta

SEQ ID NO: 46305 - DNA, 20 bp, Artificial Sequence
  Description of Artificial Sequence: Synthetic oligonucleotide
  Target: ATXN1; (-) strand; PAM type: NRG; PAM sequence: TAG
atggctgctgctccactctg

SEQ ID NO: 46306 - DNA, 20 bp, Artificial Sequence
  Description of Artificial Sequence: Synthetic oligonucleotide
  Target: ATXN1; (-) strand; PAM type: NRG; PAM sequence: TGG
ccataggctacaagaccaca

SEQ ID NO: 46307 - DNA, 20 bp, Artificial Sequence
  Description of Artificial Sequence: Synthetic oligonucleotide
  Target: ATXN1; (-) strand; PAM type: NRG; PAM sequence: AAG
gtgctctgaccataggctac

SEQ ID NO: 46308 - DNA, 20 bp, Artificial Sequence
  Description of Artificial Sequence: Synthetic oligonucleotide
  Target: ATXN1; (-) strand; PAM type: NRG; PAM sequence: AGG
attttctgtgctctgaccat

SEQ ID NO: 46309 - DNA, 20 bp, Artificial Sequence
  Description of Artificial Sequence: Synthetic oligonucleotide
  Target: ATXN1; (-) strand; PAM type: NRG; PAM sequence: TAG
tattttctgtgctctgacca

SEQ ID NO: 46310 - DNA, 20 bp, Artificial Sequence
  Description of Artificial Sequence: Synthetic oligonucleotide
  Target: ATXN1; (-) strand; PAM type: NRG; PAM sequence: AGG
ccagtctccagctatgctgg

SEQ ID NO: 46311 - DNA, 20 bp, Artificial Sequence
  Description of Artificial Sequence: Synthetic oligonucleotide
  Target: ATXN1; (-) strand; PAM type: NRG; PAM sequence: GAG
gccagtctccagctatgctg

SEQ ID NO: 46312 - DNA, 20 bp, Artificial Sequence
  Description of Artificial Sequence: Synthetic oligonucleotide
  Target: ATXN1; (-) strand; PAM type: NRG; PAM sequence: TGG
tggccagtctccagctatgc

SEQ ID NO: 46313 - DNA, 20 bp, Artificial Sequence
  Description of Artificial Sequence: Synthetic oligonucleotide
  Target: ATXN1; (-) strand; PAM type: NRG; PAM sequence: CAG
cagggcctctggccagtctc

SEQ ID NO: 46314 - DNA, 20 bp, Artificial Sequence
  Description of Artificial Sequence: Synthetic oligonucleotide
  Target: ATXN1; (-) strand; PAM type: NRG; PAM sequence: CAG
cagctgtcagggcctctggc

SEQ ID NO: 46315 - DNA, 20 bp, Artificial Sequence
  Description of Artificial Sequence: Synthetic oligonucleotide
  Target: ATXN1; (-) strand; PAM type: NRG; PAM sequence: TGG
tgtgcagctgtcagggcctc

SEQ ID NO: 46316 - DNA, 20 bp, Artificial Sequence
  Description of Artificial Sequence: Synthetic oligonucleotide
  Target: ATXN1; (-) strand; PAM type: NRG; PAM sequence: GGG
gacacagtgtgcagctgtca

SEQ ID NO: 46317 - DNA, 20 bp, Artificial Sequence
  Description of Artificial Sequence: Synthetic oligonucleotide
  Target: ATXN1; (-) strand; PAM type: NRG; PAM sequence: AGG
ggacacagtgtgcagctgtc

SEQ ID NO: 46318 - DNA, 20 bp, Artificial Sequence
  Description of Artificial Sequence: Synthetic oligonucleotide
  Target: ATXN1; (-) strand; PAM type: NRG; PAM sequence: CAG
aggacacagtgtgcagctgt

SEQ ID NO: 46319 - DNA, 20 bp, Artificial Sequence
  Description of Artificial Sequence: Synthetic oligonucleotide
  Target: ATXN1; (-) strand; PAM type: NRG; PAM sequence: CAG
atgttacaggacacagtgtg

SEQ ID NO: 46320 - DNA, 20 bp, Artificial Sequence
  Description of Artificial Sequence: Synthetic oligonucleotide
  Target: ATXN1; (-) strand; PAM type: NRG; PAM sequence: CAG
gtcaaatatgttacaggaca

SEQ ID NO: 46321 - DNA, 20 bp, Artificial Sequence
  Description of Artificial Sequence: Synthetic oligonucleotide
  Target: ATXN1; (-) strand; PAM type: NRG; PAM sequence: AGG
cctaaagtcaaatatgttac

SEQ ID NO: 46322 - DNA, 20 bp, Artificial Sequence
  Description of Artificial Sequence: Synthetic oligonucleotide
  Target: ATXN1; (-) strand; PAM type: NRG; PAM sequence: CAG
ccctaaagtcaaatatgtta

SEQ ID NO: 46323 - DNA, 20 bp, Artificial Sequence
  Description of Artificial Sequence: Synthetic oligonucleotide
  Target: ATXN1; (-) strand; PAM type: NRG; PAM sequence: AAG
cagaaatgcaaggtgcccta

SEQ ID NO: 46324 - DNA, 20 bp, Artificial Sequence
  Description of Artificial Sequence: Synthetic oligonucleotide
  Target: ATXN1; (-) strand; PAM type: NRG; PAM sequence: AGG
cagtgtgatgcagaaatgca

SEQ ID NO: 46325 - DNA, 20 bp, Artificial Sequence
  Description of Artificial Sequence: Synthetic oligonucleotide
  Target: ATXN1; (-) strand; PAM type: NRG; PAM sequence: AAG
acagtgtgatgcagaaatgc

SEQ ID NO: 46326 - DNA, 20 bp, Artificial Sequence
  Description of Artificial Sequence: Synthetic oligonucleotide
  Target: ATXN1; (-) strand; PAM type: NRG; PAM sequence: CAG
aagatgtgcacagtgtgatg

SEQ ID NO: 46327 - DNA, 20 bp, Artificial Sequence
  Description of Artificial Sequence: Synthetic oligonucleotide
  Target: ATXN1; (-) strand; PAM type: NRG; PAM sequence: CAG
gagaaaaagaaagatgtgca

SEQ ID NO: 46328 - DNA, 20 bp, Artificial Sequence
  Description of Artificial Sequence: Synthetic oligonucleotide
  Target: ATXN1; (-) strand; PAM type: NRG; PAM sequence: AAG
accaagagaggagaaaaaga

SEQ ID NO: 46329 - DNA, 20 bp, Artificial Sequence
  Description of Artificial Sequence: Synthetic oligonucleotide
  Target: ATXN1; (-) strand; PAM type: NRG; PAM sequence: AAG
ctccaccaagagaggagaaa

SEQ ID NO: 46330 - DNA, 20 bp, Artificial Sequence
  Description of Artificial Sequence: Synthetic oligonucleotide
  Target: ATXN1; (-) strand; PAM type: NRG; PAM sequence: GAG
atacctctccaccaagagag

SEQ ID NO: 46331 - DNA, 20 bp, Artificial Sequence
  Description of Artificial Sequence: Synthetic oligonucleotide
  Target: ATXN1; (-) strand; PAM type: NRG; PAM sequence: AGG
aaatacctctccaccaagag

SEQ ID NO: 46332 - DNA, 20 bp, Artificial Sequence
  Description of Artificial Sequence: Synthetic oligonucleotide
  Target: ATXN1; (-) strand; PAM type: NRG; PAM sequence: GAG
taaatacctctccaccaaga

SEQ ID NO: 46333 - DNA, 20 bp, Artificial Sequence
  Description of Artificial Sequence: Synthetic oligonucleotide
  Target: ATXN1; (-) strand; PAM type: NRG; PAM sequence: GAG
aataaatacctctccaccaa

SEQ ID NO: 46334 - DNA, 20 bp, Artificial Sequence
  Description of Artificial Sequence: Synthetic oligonucleotide
  Target: ATXN1; (-) strand; PAM type: NRG; PAM sequence: AAG
aaaataaatacctctccacc

SEQ ID NO: 46335 - DNA, 20 bp, Artificial Sequence
  Description of Artificial Sequence: Synthetic oligonucleotide
  Target: ATXN1; (-) strand; PAM type: NRG; PAM sequence: AGG
cagttcaccatacataatag

SEQ ID NO: 46336 - DNA, 20 bp, Artificial Sequence
  Description of Artificial Sequence: Synthetic oligonucleotide
  Target: ATXN1; (-) strand; PAM type: NRG; PAM sequence: GAG
acagttcaccatacataata

SEQ ID NO: 46337 - DNA, 20 bp, Artificial Sequence
  Description of Artificial Sequence: Synthetic oligonucleotide
  Target: ATXN1; (-) strand; PAM type: NRG; PAM sequence: TAG
aaacagttcaccatacataa

SEQ ID NO: 46338 - DNA, 20 bp, Artificial Sequence
  Description of Artificial Sequence: Synthetic oligonucleotide
  Target: ATXN1; (-) strand; PAM type: NRG; PAM sequence: CAG
tcaactgccccagagttaaa

SEQ ID NO: 46339 - DNA, 20 bp, Artificial Sequence
  Description of Artificial Sequence: Synthetic oligonucleotide
  Target: ATXN1; (-) strand; PAM type: NRG; PAM sequence: GAG
gaggcagttcaactgcccca

SEQ ID NO: 46340 - DNA, 20 bp, Artificial Sequence
  Description of Artificial Sequence: Synthetic oligonucleotide
  Target: ATXN1; (-) strand; PAM type: NRG; PAM sequence: CAG
ttgaggcagttcaactgccc

SEQ ID NO: 46341 - DNA, 20 bp, Artificial Sequence
  Description of Artificial Sequence: Synthetic oligonucleotide
  Target: ATXN1; (-) strand; PAM type: NRG; PAM sequence: CAG
ttatgcagcctagtttgagg

SEQ ID NO: 46342 - DNA, 20 bp, Artificial Sequence
  Description of Artificial Sequence: Synthetic oligonucleotide
  Target: ATXN1; (-) strand; PAM type: NRG; PAM sequence: AGG
gttttatgcagcctagtttg

SEQ ID NO: 46343 - DNA, 20 bp, Artificial Sequence
  Description of Artificial Sequence: Synthetic oligonucleotide
  Target: ATXN1; (-) strand; PAM type: NRG; PAM sequence: GAG
tgttttatgcagcctagttt

SEQ ID NO: 46344 - DNA, 20 bp, Artificial Sequence
  Description of Artificial Sequence: Synthetic oligonucleotide
  Target: ATXN1; (-) strand; PAM type: NRG; PAM sequence: TAG
tccttctgttttatgcagcc

SEQ ID NO: 46345 - DNA, 20 bp, Artificial Sequence
  Description of Artificial Sequence: Synthetic oligonucleotide
  Target: ATXN1; (-) strand; PAM type: NRG; PAM sequence: CAG
gaccttccttctgttttatg

SEQ ID NO: 46346 - DNA, 20 bp, Artificial Sequence
  Description of Artificial Sequence: Synthetic oligonucleotide
  Target: ATXN1; (-) strand; PAM type: NRG; PAM sequence: TGG
agtccaagggaagatggctg

SEQ ID NO: 46347 - DNA, 20 bp, Artificial Sequence
  Description of Artificial Sequence: Synthetic oligonucleotide
  Target: ATXN1; (-) strand; PAM type: NRG; PAM sequence: TGG
caggccagtccaagggaaga

SEQ ID NO: 46348 - DNA, 20 bp, Artificial Sequence
  Description of Artificial Sequence: Synthetic oligonucleotide
  Target: ATXN1; (-) strand; PAM type: NRG; PAM sequence: AAG
agcccaggccagtccaaggg

SEQ ID NO: 46349 - DNA, 20 bp, Artificial Sequence
  Description of Artificial Sequence: Synthetic oligonucleotide
  Target: ATXN1; (-) strand; PAM type: NRG; PAM sequence: GGG
gcaagcccaggccagtccaa

SEQ ID NO: 46350 - DNA, 20 bp, Artificial Sequence
  Description of Artificial Sequence: Synthetic oligonucleotide
  Target: ATXN1; (-) strand; PAM type: NRG; PAM sequence: AGG
agcaagcccaggccagtcca

SEQ ID NO: 46351 - DNA, 20 bp, Artificial Sequence
  Description of Artificial Sequence: Synthetic oligonucleotide
  Target: ATXN1; (-) strand; PAM type: NRG; PAM sequence: AAG
aagcaagcccaggccagtcc

SEQ ID NO: 46352 - DNA, 20 bp, Artificial Sequence
  Description of Artificial Sequence: Synthetic oligonucleotide
  Target: ATXN1; (-) strand; PAM type: NRG; PAM sequence: CAG
aaactgaagcaagcccaggc

SEQ ID NO: 46353 - DNA, 20 bp, Artificial Sequence
  Description of Artificial Sequence: Synthetic oligonucleotide
  Target: ATXN1; (-) strand; PAM type: NRG; PAM sequence: AGG
cagcaaactgaagcaagccc

SEQ ID NO: 46354 - DNA, 20 bp, Artificial Sequence
  Description of Artificial Sequence: Synthetic oligonucleotide
  Target: ATXN1; (-) strand; PAM type: NRG; PAM sequence: CAG
tcagcaaactgaagcaagcc

SEQ ID NO: 46355 - DNA, 20 bp, Artificial Sequence
  Description of Artificial Sequence: Synthetic oligonucleotide
  Target: ATXN1; (-) strand; PAM type: NRG; PAM sequence: AAG
tgctctcagcaaactgaagc

SEQ ID NO: 46356 - DNA, 20 bp, Artificial Sequence
  Description of Artificial Sequence: Synthetic oligonucleotide
  Target: ATXN1; (-) strand; PAM type: NRG; PAM sequence: AAG
gttctgctctcagcaaactg

SEQ ID NO: 46357 - DNA, 20 bp, Artificial Sequence
  Description of Artificial Sequence: Synthetic oligonucleotide
  Target: ATXN1; (-) strand; PAM type: NRG; PAM sequence: CAG
tccaagctgggttctgctct

SEQ ID NO: 46358 - DNA, 20 bp, Artificial Sequence
  Description of Artificial Sequence: Synthetic oligonucleotide
  Target: ATXN1; (-) strand; PAM type: NRG; PAM sequence: GGG
catctgtgggcatccaagct

SEQ ID NO: 46359 - DNA, 20 bp, Artificial Sequence
  Description of Artificial Sequence: Synthetic oligonucleotide
  Target: ATXN1; (-) strand; PAM type: NRG; PAM sequence: TGG
gcatctgtgggcatccaagc

SEQ ID NO: 46360 - DNA, 20 bp, Artificial Sequence
  Description of Artificial Sequence: Synthetic oligonucleotide
  Target: ATXN1; (-) strand; PAM type: NRG; PAM sequence: AAG
agcggcatctgtgggcatcc

SEQ ID NO: 46361 - DNA, 20 bp, Artificial Sequence
  Description of Artificial Sequence: Synthetic oligonucleotide
  Target: ATXN1; (-) strand; PAM type: NRG; PAM sequence: GGG
aaaagtacagcggcatctgt

SEQ ID NO: 46362 - DNA, 20 bp, Artificial Sequence
  Description of Artificial Sequence: Synthetic oligonucleotide
  Target: ATXN1; (-) strand; PAM type: NRG; PAM sequence: TGG
caaaagtacagcggcatctg

SEQ ID NO: 46363 - DNA, 20 bp, Artificial Sequence
  Description of Artificial Sequence: Synthetic oligonucleotide
  Target: ATXN1; (-) strand; PAM type: NRG; PAM sequence: CGG
aagtttgtgcaaaagtacag

SEQ ID NO: 46364 - DNA, 20 bp, Artificial Sequence
  Description of Artificial Sequence: Synthetic oligonucleotide
  Target: ATXN1; (-) strand; PAM type: NRG; PAM sequence: CAG
tgtaagtttgtgcaaaagta

SEQ ID NO: 46365 - DNA, 20 bp, Artificial Sequence
  Description of Artificial Sequence: Synthetic oligonucleotide
  Target: ATXN1; (-) strand; PAM type: NRG; PAM sequence: AAG
ctgtatgtaagtttgtgcaa

SEQ ID NO: 46366 - DNA, 20 bp, Artificial Sequence
  Description of Artificial Sequence: Synthetic oligonucleotide
  Target: ATXN1; (-) strand; PAM type: NRG; PAM sequence: AAG
gttttaggtgctctgtatgt

SEQ ID NO: 46367 - DNA, 20 bp, Artificial Sequence
  Description of Artificial Sequence: Synthetic oligonucleotide
  Target: ATXN1; (-) strand; PAM type: NRG; PAM sequence: AGG
ttttaggtgcccctggtttt

SEQ ID NO: 46368 - DNA, 20 bp, Artificial Sequence
  Description of Artificial Sequence: Synthetic oligonucleotide
  Target: ATXN1; (-) strand; PAM type: NRG; PAM sequence: TAG
gttttaggtgcccctggttt

SEQ ID NO: 46369 - DNA, 20 bp, Artificial Sequence
  Description of Artificial Sequence: Synthetic oligonucleotide
  Target: ATXN1; (-) strand; PAM type: NRG; PAM sequence: TGG
ctactggttttaggtgcccc

SEQ ID NO: 46370 - DNA, 20 bp, Artificial Sequence
  Description of Artificial Sequence: Synthetic oligonucleotide
  Target: ATXN1; (-) strand; PAM type: NRG; PAM sequence: AGG
ggattaccactactggtttt

SEQ ID NO: 46371 - DNA, 20 bp, Artificial Sequence
  Description of Artificial Sequence: Synthetic oligonucleotide
  Target: ATXN1; (-) strand; PAM type: NRG; PAM sequence: TAG
tggattaccactactggttt

SEQ ID NO: 46372 - DNA, 20 bp, Artificial Sequence
  Description of Artificial Sequence: Synthetic oligonucleotide
  Target: ATXN1; (-) strand; PAM type: NRG; PAM sequence: TGG
taaaattggattaccactac

SEQ ID NO: 46373 - DNA, 20 bp, Artificial Sequence
  Description of Artificial Sequence: Synthetic oligonucleotide
  Target: ATXN1; (-) strand; PAM type: NRG; PAM sequence: TGG
gctgcagttttccgtaaaat

SEQ ID NO: 46374 - DNA, 20 bp, Artificial Sequence
  Description of Artificial Sequence: Synthetic oligonucleotide
  Target: ATXN1; (-) strand; PAM type: NRG; PAM sequence: CAG
gtggcagcaaattcctgctg

SEQ ID NO: 46375 - DNA, 20 bp, Artificial Sequence
  Description of Artificial Sequence: Synthetic oligonucleotide
  Target: ATXN1; (-) strand; PAM type: NRG; PAM sequence: CAG
ctggggaaaatggaaggtgg

SEQ ID NO: 46376 - DNA, 20 bp, Artificial Sequence
  Description of Artificial Sequence: Synthetic oligonucleotide
  Target: ATXN1; (-) strand; PAM type: NRG; PAM sequence: TGG
gtgctggggaaaatggaagg

SEQ ID NO: 46377 - DNA, 20 bp, Artificial Sequence
  Description of Artificial Sequence: Synthetic oligonucleotide
  Target: ATXN1; (-) strand; PAM type: NRG; PAM sequence: AGG
ttagtgctggggaaaatgga

SEQ ID NO: 46378 - DNA, 20 bp, Artificial Sequence
  Description of Artificial Sequence: Synthetic oligonucleotide
  Target: ATXN1; (-) strand; PAM type: NRG; PAM sequence: AAG
cttagtgctggggaaaatgg

SEQ ID NO: 46379 - DNA, 20 bp, Artificial Sequence
  Description of Artificial Sequence: Synthetic oligonucleotide
  Target: ATXN1; (-) strand; PAM type: NRG; PAM sequence: TGG
gttcttagtgctggggaaaa

SEQ ID NO: 46380 - DNA, 20 bp, Artificial Sequence
  Description of Artificial Sequence: Synthetic oligonucleotide
  Target: ATXN1; (-) strand; PAM type: NRG; PAM sequence: GGG
agtaggtgttcttagtgctg

SEQ ID NO: 46381 - DNA, 20 bp, Artificial Sequence
  Description of Artificial Sequence: Synthetic oligonucleotide
  Target: ATXN1; (-) strand; PAM type: NRG; PAM sequence: GGG
aagtaggtgttcttagtgct

SEQ ID NO: 46382 - DNA, 20 bp, Artificial Sequence
  Description of Artificial Sequence: Synthetic oligonucleotide
  Target: ATXN1; (-) strand; PAM type: NRG; PAM sequence: TGG
aaagtaggtgttcttagtgc

SEQ ID NO: 46383 - DNA, 20 bp, Artificial Sequence
  Description of Artificial Sequence: Synthetic oligonucleotide
  Target: ATXN1; (-) strand; PAM type: NRG; PAM sequence: TAG
tcactaaaagtaggtgttct

SEQ ID NO: 46384 - DNA, 20 bp, Artificial Sequence
  Description of Artificial Sequence: Synthetic oligonucleotide
  Target: ATXN1; (-) strand; PAM type: NRG; PAM sequence: AGG
agtcacctgtcactaaaagt

SEQ ID NO: 46385 - DNA, 20 bp, Artificial Sequence
  Description of Artificial Sequence: Synthetic oligonucleotide
  Target: ATXN1; (-) strand; PAM type: NRG; PAM sequence: TAG
gagtcacctgtcactaaaag

SEQ ID NO: 46386 - DNA, 20 bp, Artificial Sequence
  Description of Artificial Sequence: Synthetic oligonucleotide
  Target: ATXN1; (-) strand; PAM type: NRG; PAM sequence: AAG
gatgagtcacctgtcactaa

SEQ ID NO: 46387 - DNA, 20 bp, Artificial Sequence
  Description of Artificial Sequence: Synthetic oligonucleotide
  Target: ATXN1; (-) strand; PAM type: NRG; PAM sequence: GAG
ctgctagaagagtggcagat

SEQ ID NO: 46388 - DNA, 20 bp, Artificial Sequence
  Description of Artificial Sequence: Synthetic oligonucleotide
  Target: ATXN1; (-) strand; PAM type: NRG; PAM sequence: CAG
agagcctgctagaagagtgg

SEQ ID NO: 46389 - DNA, 20 bp, Artificial Sequence
  Description of Artificial Sequence: Synthetic oligonucleotide
  Target: ATXN1; (-) strand; PAM type: NRG; PAM sequence: TGG
agaagagcctgctagaagag

SEQ ID NO: 46390 - DNA, 20 bp, Artificial Sequence
  Description of Artificial Sequence: Synthetic oligonucleotide
  Target: ATXN1; (-) strand; PAM type: NRG; PAM sequence: GAG
cttagaagagcctgctagaa

SEQ ID NO: 46391 - DNA, 20 bp, Artificial Sequence
  Description of Artificial Sequence: Synthetic oligonucleotide
  Target: ATXN1; (-) strand; PAM type: NRG; PAM sequence: AAG
cgcttagaagagcctgctag

SEQ ID NO: 46392 - DNA, 20 bp, Artificial Sequence
  Description of Artificial Sequence: Synthetic oligonucleotide
  Target: ATXN1; (-) strand; PAM type: NRG; PAM sequence: TAG
cttcgcttagaagagcctgc

SEQ ID NO: 46393 - DNA, 20 bp, Artificial Sequence
  Description of Artificial Sequence: Synthetic oligonucleotide
  Target: ATXN1; (-) strand; PAM type: NRG; PAM sequence: GAG
gtttgtgtcttcgcttagaa

SEQ ID NO: 46394 - DNA, 20 bp, Artificial Sequence
  Description of Artificial Sequence: Synthetic oligonucleotide
  Target: ATXN1; (-) strand; PAM type: NRG; PAM sequence: AAG
ttgtttgtgtcttcgcttag

SEQ ID NO: 46395 - DNA, 20 bp, Artificial Sequence
  Description of Artificial Sequence: Synthetic oligonucleotide
  Target: ATXN1; (-) strand; PAM type: NRG; PAM sequence: TAG
ctcttgtttgtgtcttcgct

SEQ ID NO: 46396 - DNA, 20 bp, Artificial Sequence
  Description of Artificial Sequence: Synthetic oligonucleotide
  Target: ATXN1; (-) strand; PAM type: NRG; PAM sequence: GGG
cccaccaagctcatccatca

SEQ ID NO: 46397 - DNA, 20 bp, Artificial Sequence
  Description of Artificial Sequence: Synthetic oligonucleotide
  Target: ATXN1; (-) strand; PAM type: NRG; PAM sequence: AGG
ccccaccaagctcatccatc

SEQ ID NO: 46398 - DNA, 20 bp, Artificial Sequence
  Description of Artificial Sequence: Synthetic oligonucleotide
  Target: ATXN1; (-) strand; PAM type: NRG; PAM sequence: CAG
cccccaccaagctcatccat

SEQ ID NO: 46399 - DNA, 20 bp, Artificial Sequence
  Description of Artificial Sequence: Synthetic oligonucleotide
  Target: ATXN1; (-) strand; PAM type: NRG; PAM sequence: AAG
ggggcttctcctcccccacc

SEQ ID NO: 46400 - DNA, 20 bp, Artificial Sequence
  Description of Artificial Sequence: Synthetic oligonucleotide
  Target: ATXN1; (-) strand; PAM type: NRG; PAM sequence: GGG
tcatccctttcttatccatg

SEQ ID NO: 46401 - DNA, 20 bp, Artificial Sequence
  Description of Artificial Sequence: Synthetic oligonucleotide
  Target: ATXN1; (-) strand; PAM type: NRG; PAM sequence: GGG
gtcatccctttcttatccat

SEQ ID NO: 46402 - DNA, 20 bp, Artificial Sequence
  Description of Artificial Sequence: Synthetic oligonucleotide
  Target: ATXN1; (-) strand; PAM type: NRG; PAM sequence: TGG
tgtcatccctttcttatcca

SEQ ID NO: 46403 - DNA, 20 bp, Artificial Sequence
  Description of Artificial Sequence: Synthetic oligonucleotide
  Target: ATXN1; (-) strand; PAM type: NRG; PAM sequence: GAG
aggaaggggaagattgagca

SEQ ID NO: 46404 - DNA, 20 bp, Artificial Sequence
  Description of Artificial Sequence: Synthetic oligonucleotide
  Target: ATXN1; (-) strand; PAM type: NRG; PAM sequence: CAG
gcaggaaggggaagattgag

SEQ ID NO: 46405 - DNA, 20 bp, Artificial Sequence
  Description of Artificial Sequence: Synthetic oligonucleotide
  Target: ATXN1; (-) strand; PAM type: NRG; PAM sequence: GAG
cctgcaggaaggggaagatt

SEQ ID NO: 46406 - DNA, 20 bp, Artificial Sequence
  Description of Artificial Sequence: Synthetic oligonucleotide
  Target: ATXN1; (-) strand; PAM type: NRG; PAM sequence: AAG
agtattcctgcaggaagggg

SEQ ID NO: 46407 - DNA, 20 bp, Artificial Sequence
  Description of Artificial Sequence: Synthetic oligonucleotide
  Target: ATXN1; (-) strand; PAM type: NRG; PAM sequence: GGG
gtgagtattcctgcaggaag

SEQ ID NO: 46408 - DNA, 20 bp, Artificial Sequence
  Description of Artificial Sequence: Synthetic oligonucleotide
  Target: ATXN1; (-) strand; PAM type: NRG; PAM sequence: GGG
ggtgagtattcctgcaggaa

SEQ ID NO: 46409 - DNA, 20 bp, Artificial Sequence
  Description of Artificial Sequence: Synthetic oligonucleotide
  Target: ATXN1; (-) strand; PAM type: NRG; PAM sequence: AGG
gggtgagtattcctgcagga

SEQ ID NO: 46410 - DNA, 20 bp, Artificial Sequence
  Description of Artificial Sequence: Synthetic oligonucleotide
  Target: ATXN1; (-) strand; PAM type: NRG; PAM sequence: AAG
tgggtgagtattcctgcagg

SEQ ID NO: 46411 - DNA, 20 bp, Artificial Sequence
  Description of Artificial Sequence: Synthetic oligonucleotide
  Target: ATXN1; (-) strand; PAM type: NRG; PAM sequence: AGG
gggtgggtgagtattcctgc

SEQ ID NO: 46412 - DNA, 20 bp, Artificial Sequence
  Description of Artificial Sequence: Synthetic oligonucleotide
  Target: ATXN1; (-) strand; PAM type: NRG; PAM sequence: CAG
agggtgggtgagtattcctg

SEQ ID NO: 46413 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaaaaagggtgggt

SEQ ID NO: 46414 - DNA, 20 bp, Artificial Sequence
  Description of Artificial Sequence: Synthetic oligonucleotide
  Target: ATXN1; (-) strand; PAM type: NRG; PAM sequence: GGG
aaagaaaaaaaaaaaagggt

SEQ ID NO: 46415 - DNA, 20 bp, Artificial Sequence
  Description of Artificial Sequence: Synthetic oligonucleotide
  Target: ATXN1; (-) strand; PAM type: NRG; PAM sequence: TGG
aaaagaaaaaaaaaaaaggg

SEQ ID NO: 46416 - DNA, 20 bp, Artificial Sequence
  Description of Artificial Sequence: Synthetic oligonucleotide
  Target: ATXN1; (-) strand; PAM type: NRG; PAM sequence: GGG
caaaaaagaaaaaaaaaaaa

SEQ ID NO: 46417 - DNA, 20 bp, Artificial Sequence
  Description of Artificial Sequence: Synthetic oligonucleotide
  Target: ATXN1; (-) strand; PAM type: NRG; PAM sequence: AGG
tcaaaaaagaaaaaaaaaaa

SEQ ID NO: 46418 - DNA, 20 bp, Artificial Sequence
  Description of Artificial Sequence: Synthetic oligonucleotide
  Target: ATXN1; (-) strand; PAM type: NRG; PAM sequence: AAG
ctcaaaaaagaaaaaaaaaa

SEQ ID NO: 46419 - DNA, 20 bp, Artificial Sequence
  Description of Artificial Sequence: Synthetic oligonucleotide
  Target: ATXN1; (-) strand; PAM type: NRG; PAM sequence: AAG
agcgagactccgtctcaaaa

SEQ ID NO: 46420 - DNA, 20 bp, Artificial Sequence
  Description of Artificial Sequence: Synthetic oligonucleotide
  Target: ATXN1; (-) strand; PAM type: NRG; PAM sequence: GAG
accggcctgggcgacagagc

SEQ ID NO: 46421 - DNA, 20 bp, Artificial Sequence
  Description of Artificial Sequence: Synthetic oligonucleotide
  Target: ATXN1; (-) strand; PAM type: NRG; PAM sequence: GAG
tcacaccggcctgggcgaca

SEQ ID NO: 46422 - DNA, 20 bp, Artificial Sequence
  Description of Artificial Sequence: Synthetic oligonucleotide
  Target: ATXN1; (-) strand; PAM type: NRG; PAM sequence: CAG
cttcacaccggcctgggcga

SEQ ID NO: 46423 - DNA, 20 bp, Artificial Sequence
  Description of Artificial Sequence: Synthetic oligonucleotide
  Target: ATXN1; (-) strand; PAM type: NRG; PAM sequence: GGG
gtgccacttcacaccggcct

SEQ ID NO: 46424 - DNA, 20 bp, Artificial Sequence
  Description of Artificial Sequence: Synthetic oligonucleotide
  Target: ATXN1; (-) strand; PAM type: NRG; PAM sequence: TGG
cgtgccacttcacaccggcc

SEQ ID NO: 46425 - DNA, 20 bp, Artificial Sequence
  Description of Artificial Sequence: Synthetic oligonucleotide
  Target: ATXN1; (-) strand; PAM type: NRG; PAM sequence: CGG
gagatcgtgccacttcacac

SEQ ID NO: 46426 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagcc

SEQ ID NO: 46427 - DNA, 20 bp, Artificial Sequence
  Description of Artificial Sequence: Synthetic oligonucleotide
  Target: ATXN1; (-) strand; PAM type: NRG; PAM sequence: GAG
tgggaggcagaggttgcagt

SEQ ID NO: 46428 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggcagaggttg

SEQ ID NO: 46429 - DNA, 20 bp, Artificial Sequence
  Description of Artificial Sequence: Synthetic oligonucleotide
  Target: ATXN1; (-) strand; PAM type: NRG; PAM sequence: AGG
tgtttgaacctgggaggcag

SEQ ID NO: 46430 - DNA, 20 bp, Artificial Sequence
  Description of Artificial Sequence: Synthetic oligonucleotide
  Target: ATXN1; (-) strand; PAM type: NRG; PAM sequence: GAG
ttgtttgaacctgggaggca

SEQ ID NO: 46431 - DNA, 20 bp, Artificial Sequence
  Description of Artificial Sequence: Synthetic oligonucleotide
  Target: ATXN1; (-) strand; PAM type: NRG; PAM sequence: CAG
aattgtttgaacctgggagg

SEQ ID NO: 46432 - DNA, 20 bp, Artificial Sequence
  Description of Artificial Sequence: Synthetic oligonucleotide
  Target: ATXN1; (-) strand; PAM type: NRG; PAM sequence: AGG
gagaattgtttgaacctggg

SEQ ID NO: 46433 - DNA, 20 bp, Artificial Sequence
  Description of Artificial Sequence: Synthetic oligonucleotide
  Target: ATXN1; (-) strand; PAM type: NRG; PAM sequence: GAG
ggagaattgtttgaacctgg

SEQ ID NO: 46434 - DNA, 20 bp, Artificial Sequence
  Description of Artificial Sequence: Synthetic oligonucleotide
  Target: ATXN1; (-) strand; PAM type: NRG; PAM sequence: GGG
caggagaattgtttgaacct

SEQ ID NO: 46435 - DNA, 20 bp, Artificial Sequence
  Description of Artificial Sequence: Synthetic oligonucleotide
  Target: ATXN1; (-) strand; PAM type: NRG; PAM sequence: TGG
gcaggagaattgtttgaacc

SEQ ID NO: 46436 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggcag

SEQ ID NO: 46437 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgaggc

SEQ ID NO: 46438 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgagg

SEQ ID NO: 46439 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 46440 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 46441 - DNA, 20 bp, Artificial Sequence
  Description of Artificial Sequence: Synthetic oligonucleotide
  Target: ATXN1; (-) strand; PAM type: NRG; PAM sequence: AGG
tataatcccagctactcagg

SEQ ID NO: 46442 - DNA, 20 bp, Artificial Sequence
  Description of Artificial Sequence: Synthetic oligonucleotide
  Target: ATXN1; (-) strand; PAM type: NRG; PAM sequence: GAG
ctataatcccagctactcag

SEQ ID NO: 46443 - DNA, 20 bp, Artificial Sequence
  Description of Artificial Sequence: Synthetic oligonucleotide
  Target: ATXN1; (-) strand; PAM type: NRG; PAM sequence: AGG
gcctataatcccagctactc

SEQ ID NO: 46444 - DNA, 20 bp, Artificial Sequence
  Description of Artificial Sequence: Synthetic oligonucleotide
  Target: ATXN1; (-) strand; PAM type: NRG; PAM sequence: CAG
tgcctataatcccagctact

SEQ ID NO: 46445 - DNA, 20 bp, Artificial Sequence
  Description of Artificial Sequence: Synthetic oligonucleotide
  Target: ATXN1; (-) strand; PAM type: NRG; PAM sequence: CAG
gtggcgcatgcctataatcc

SEQ ID NO: 46446 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccgggcgtgg

SEQ ID NO: 46447 - DNA, 20 bp, Artificial Sequence
  Description of Artificial Sequence: Synthetic oligonucleotide
  Target: ATXN1; (-) strand; PAM type: NRG; PAM sequence: TGG
agaaaaaaattagccgggcg

SEQ ID NO: 46448 - DNA, 20 bp, Artificial Sequence
  Description of Artificial Sequence: Synthetic oligonucleotide
  Target: ATXN1; (-) strand; PAM type: NRG; PAM sequence: GGG
aaaatagaaaaaaattagcc

SEQ ID NO: 46449 - DNA, 20 bp, Artificial Sequence
  Description of Artificial Sequence: Synthetic oligonucleotide
  Target: ATXN1; (-) strand; PAM type: NRG; PAM sequence: CGG
aaaaatagaaaaaaattagc

SEQ ID NO: 46450 - DNA, 20 bp, Artificial Sequence
  Description of Artificial Sequence: Synthetic oligonucleotide
  Target: ATXN1; (-) strand; PAM type: NRG; PAM sequence: TAG
tactaaaaatagaaaaaaat

SEQ ID NO: 46451 - DNA, 20 bp, Artificial Sequence
  Description of Artificial Sequence: Synthetic oligonucleotide
  Target: ATXN1; (-) strand; PAM type: NRG; PAM sequence: TAG
aaccccgtctctactaaaaa

SEQ ID NO: 46452 - DNA, 20 bp, Artificial Sequence
  Description of Artificial Sequence: Synthetic oligonucleotide
  Target: ATXN1; (-) strand; PAM type: NRG; PAM sequence: CGG
caagaccagccttgccaata

SEQ ID NO: 46453 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggaattcaagac

SEQ ID NO: 46454 - DNA, 20 bp, Artificial Sequence
  Description of Artificial Sequence: Synthetic oligonucleotide
  Target: ATXN1; (-) strand; PAM type: NRG; PAM sequence: AAG
tcacctgaggtcaggaattc

SEQ ID NO: 46455 - DNA, 20 bp, Artificial Sequence
  Description of Artificial Sequence: Synthetic oligonucleotide
  Target: ATXN1; (-) strand; PAM type: NRG; PAM sequence: AGG
cgggtggatcacctgaggtc

SEQ ID NO: 46456 - DNA, 20 bp, Artificial Sequence
  Description of Artificial Sequence: Synthetic oligonucleotide
  Target: ATXN1; (-) strand; PAM type: NRG; PAM sequence: CAG
gcgggtggatcacctgaggt

SEQ ID NO: 46457 - DNA, 20 bp, Artificial Sequence
  Description of Artificial Sequence: Synthetic oligonucleotide
  Target: ATXN1; (-) strand; PAM type: NRG; PAM sequence: AGG
caaggcgggtggatcacctg

SEQ ID NO: 46458 - DNA, 20 bp, Artificial Sequence
  Description of Artificial Sequence: Synthetic oligonucleotide
  Target: ATXN1; (-) strand; PAM type: NRG; PAM sequence: GAG
ccaaggcgggtggatcacct

SEQ ID NO: 46459 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccaaggcggg

SEQ ID NO: 46460 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccaaggc

SEQ ID NO: 46461 - DNA, 20 bp, Artificial Sequence
  Description of Artificial Sequence: Synthetic oligonucleotide
  Target: ATXN1; (-) strand; PAM type: NRG; PAM sequence: CGG
agcactttgggaggccaagg

SEQ ID NO: 46462 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggcca

SEQ ID NO: 46463 - DNA, 20 bp, Artificial Sequence
  Description of Artificial Sequence: Synthetic oligonucleotide
  Target: ATXN1; (-) strand; PAM type: NRG; PAM sequence: AAG
tcccagcactttgggaggcc

SEQ ID NO: 46464 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 46465 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 46466 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 46467 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 46468 - DNA, 20 bp, Artificial Sequence
  Description of Artificial Sequence: Synthetic oligonucleotide
  Target: ATXN1; (-) strand; PAM type: NRG; PAM sequence: CAG
gtgcctcacgcctgtaatcc

SEQ ID NO: 46469 - DNA, 20 bp, Artificial Sequence
  Description of Artificial Sequence: Synthetic oligonucleotide
  Target: ATXN1; (-) strand; PAM type: NRG; PAM sequence: TGG
ggtgggtgaggggctgggcg

SEQ ID NO: 46470 - DNA, 20 bp, Artificial Sequence
  Description of Artificial Sequence: Synthetic oligonucleotide
  Target: ATXN1; (-) strand; PAM type: NRG; PAM sequence: GGG
aaaagggtgggtgaggggct

SEQ ID NO: 46471 - DNA, 20 bp, Artificial Sequence
  Description of Artificial Sequence: Synthetic oligonucleotide
  Target: ATXN1; (-) strand; PAM type: NRG; PAM sequence: TGG
caaaagggtgggtgaggggc

SEQ ID NO: 46472 - DNA, 20 bp, Artificial Sequence
  Description of Artificial Sequence: Synthetic oligonucleotide
  Target: ATXN1; (-) strand; PAM type: NRG; PAM sequence: GGG
ccatcaaaagggtgggtgag

SEQ ID NO: 46473 - DNA, 20 bp, Artificial Sequence
  Description of Artificial Sequence: Synthetic oligonucleotide
  Target: ATXN1; (-) strand; PAM type: NRG; PAM sequence: GGG
cccatcaaaagggtgggtga

SEQ ID NO: 46474 - DNA, 20 bp, Artificial Sequence
  Description of Artificial Sequence: Synthetic oligonucleotide
  Target: ATXN1; (-) strand; PAM type: NRG; PAM sequence: AGG
gcccatcaaaagggtgggtg

SEQ ID NO: 46475 - DNA, 20 bp, Artificial Sequence
  Description of Artificial Sequence: Synthetic oligonucleotide
  Target: ATXN1; (-) strand; PAM type: NRG; PAM sequence: GAG
tgcccatcaaaagggtgggt

SEQ ID NO: 46476 - DNA, 20 bp, Artificial Sequence
  Description of Artificial Sequence: Synthetic oligonucleotide
  Target: ATXN1; (-) strand; PAM type: NRG; PAM sequence: GGG
aagttgcccatcaaaagggt

SEQ ID NO: 46477 - DNA, 20 bp, Artificial Sequence
  Description of Artificial Sequence: Synthetic oligonucleotide
  Target: ATXN1; (-) strand; PAM type: NRG; PAM sequence: TGG
caagttgcccatcaaaaggg

SEQ ID NO: 46478 - DNA, 20 bp, Artificial Sequence
  Description of Artificial Sequence: Synthetic oligonucleotide
  Target: ATXN1; (-) strand; PAM type: NRG; PAM sequence: GGG
gctcaagttgcccatcaaaa

SEQ ID NO: 46479 - DNA, 20 bp, Artificial Sequence
  Description of Artificial Sequence: Synthetic oligonucleotide
  Target: ATXN1; (-) strand; PAM type: NRG; PAM sequence: AGG
agctcaagttgcccatcaaa

SEQ ID NO: 46480 - DNA, 20 bp, Artificial Sequence
  Description of Artificial Sequence: Synthetic oligonucleotide
  Target: ATXN1; (-) strand; PAM type: NRG; PAM sequence: AAG
cagctcaagttgcccatcaa

SEQ ID NO: 46481 - DNA, 20 bp, Artificial Sequence
  Description of Artificial Sequence: Synthetic oligonucleotide
  Target: ATXN1; (-) strand; PAM type: NRG; PAM sequence: AAG
taagcaggagagggcagctc

SEQ ID NO: 46482 - DNA, 20 bp, Artificial Sequence
  Description of Artificial Sequence: Synthetic oligonucleotide
  Target: ATXN1; (-) strand; PAM type: NRG; PAM sequence: CAG
caggaataagcaggagaggg

SEQ ID NO: 46483 - DNA, 20 bp, Artificial Sequence
  Description of Artificial Sequence: Synthetic oligonucleotide
  Target: ATXN1; (-) strand; PAM type: NRG; PAM sequence: GGG
ttacaggaataagcaggaga

SEQ ID NO: 46484 - DNA, 20 bp, Artificial Sequence
  Description of Artificial Sequence: Synthetic oligonucleotide
  Target: ATXN1; (-) strand; PAM type: NRG; PAM sequence: AGG
gttacaggaataagcaggag

SEQ ID NO: 46485 - DNA, 20 bp, Artificial Sequence
  Description of Artificial Sequence: Synthetic oligonucleotide
  Target: ATXN1; (-) strand; PAM type: NRG; PAM sequence: GAG
agttacaggaataagcagga

SEQ ID NO: 46486 - DNA, 20 bp, Artificial Sequence
  Description of Artificial Sequence: Synthetic oligonucleotide
  Target: ATXN1; (-) strand; PAM type: NRG; PAM sequence: GAG
gcagttacaggaataagcag

SEQ ID NO: 46487 - DNA, 20 bp, Artificial Sequence
  Description of Artificial Sequence: Synthetic oligonucleotide
  Target: ATXN1; (-) strand; PAM type: NRG; PAM sequence: AGG
ttgcagttacaggaataagc

SEQ ID NO: 46488 - DNA, 20 bp, Artificial Sequence
  Description of Artificial Sequence: Synthetic oligonucleotide
  Target: ATXN1; (-) strand; PAM type: NRG; PAM sequence: CAG
tttgcagttacaggaataag

SEQ ID NO: 46489 - DNA, 20 bp, Artificial Sequence
  Description of Artificial Sequence: Synthetic oligonucleotide
  Target: ATXN1; (-) strand; PAM type: NRG; PAM sequence: AAG
gtgtttgcagttacaggaat

SEQ ID NO: 46490 - DNA, 20 bp, Artificial Sequence
  Description of Artificial Sequence: Synthetic oligonucleotide
  Target: ATXN1; (-) strand; PAM type: NRG; PAM sequence: AGG
caagacgtgtttgcagttac

SEQ ID NO: 46491 - DNA, 20 bp, Artificial Sequence
  Description of Artificial Sequence: Synthetic oligonucleotide
  Target: ATXN1; (-) strand; PAM type: NRG; PAM sequence: CAG
gcaagacgtgtttgcagtta

SEQ ID NO: 46492 - DNA, 20 bp, Artificial Sequence
  Description of Artificial Sequence: Synthetic oligonucleotide
  Target: ATXN1; (-) strand; PAM type: NRG; PAM sequence: CAG
gttggagcaagacgtgtttg

SEQ ID NO: 46493 - DNA, 20 bp, Artificial Sequence
  Description of Artificial Sequence: Synthetic oligonucleotide
  Target: ATXN1; (-) strand; PAM type: NRG; PAM sequence: AAG
taagaagtggtggttggagc

SEQ ID NO: 46494 - DNA, 20 bp, Artificial Sequence
  Description of Artificial Sequence: Synthetic oligonucleotide
  Target: ATXN1; (-) strand; PAM type: NRG; PAM sequence: GAG
gttttaagaagtggtggttg

SEQ ID NO: 46495 - DNA, 20 bp, Artificial Sequence
  Description of Artificial Sequence: Synthetic oligonucleotide
  Target: ATXN1; (-) strand; PAM type: NRG; PAM sequence: TGG
cagttttaagaagtggtggt

SEQ ID NO: 46496 - DNA, 20 bp, Artificial Sequence
  Description of Artificial Sequence: Synthetic oligonucleotide
  Target: ATXN1; (-) strand; PAM type: NRG; PAM sequence: TGG
tctgcagttttaagaagtgg

SEQ ID NO: 46497 - DNA, 20 bp, Artificial Sequence
  Description of Artificial Sequence: Synthetic oligonucleotide
  Target: ATXN1; (-) strand; PAM type: NRG; PAM sequence: TGG
tcatctgcagttttaagaag

SEQ ID NO: 46498 - DNA, 20 bp, Artificial Sequence
  Description of Artificial Sequence: Synthetic oligonucleotide
  Target: ATXN1; (-) strand; PAM type: NRG; PAM sequence: AAG
ccttcatctgcagttttaag

SEQ ID NO: 46499 - DNA, 20 bp, Artificial Sequence
  Description of Artificial Sequence: Synthetic oligonucleotide
  Target: ATXN1; (-) strand; PAM type: NRG; PAM sequence: AAG
agcccttcatctgcagtttt

SEQ ID NO: 46500 - DNA, 20 bp, Artificial Sequence
  Description of Artificial Sequence: Synthetic oligonucleotide
  Target: ATXN1; (-) strand; PAM type: NRG; PAM sequence: CAG
cagagtcagcccttcatctg

SEQ ID NO: 46501 - DNA, 20 bp, Artificial Sequence
  Description of Artificial Sequence: Synthetic oligonucleotide
  Target: ATXN1; (-) strand; PAM type: NRG; PAM sequence: CAG
accaatggcatgcccagagt

SEQ ID NO: 46502 - DNA, 20 bp, Artificial Sequence
  Description of Artificial Sequence: Synthetic oligonucleotide
  Target: ATXN1; (-) strand; PAM type: NRG; PAM sequence: GAG
cccaaccaatggcatgccca

SEQ ID NO: 46503 - DNA, 20 bp, Artificial Sequence
  Description of Artificial Sequence: Synthetic oligonucleotide
  Target: ATXN1; (-) strand; PAM type: NRG; PAM sequence: CAG
agcccaaccaatggcatgcc

SEQ ID NO: 46504 - DNA, 20 bp, Artificial Sequence
  Description of Artificial Sequence: Synthetic oligonucleotide
  Target: ATXN1; (-) strand; PAM type: NRG; PAM sequence: TGG
gaaggaacgagcccaaccaa

SEQ ID NO: 46505 - DNA, 20 bp, Artificial Sequence
  Description of Artificial Sequence: Synthetic oligonucleotide
  Target: ATXN1; (-) strand; PAM type: NRG; PAM sequence: GAG
aatggtcgcggggaaggaac

SEQ ID NO: 46506 - DNA, 20 bp, Artificial Sequence
  Description of Artificial Sequence: Synthetic oligonucleotide
  Target: ATXN1; (-) strand; PAM type: NRG; PAM sequence: AGG
gaggagaatggtcgcgggga

SEQ ID NO: 46507 - DNA, 20 bp, Artificial Sequence
  Description of Artificial Sequence: Synthetic oligonucleotide
  Target: ATXN1; (-) strand; PAM type: NRG; PAM sequence: AAG
ggaggagaatggtcgcgggg

SEQ ID NO: 46508 - DNA, 20 bp, Artificial Sequence
  Description of Artificial Sequence: Synthetic oligonucleotide
  Target: ATXN1; (-) strand; PAM type: NRG; PAM sequence: GGG
tcaggaggagaatggtcgcg

SEQ ID NO: 46509 - DNA, 20 bp, Artificial Sequence
  Description of Artificial Sequence: Synthetic oligonucleotide
  Target: ATXN1; (-) strand; PAM type: NRG; PAM sequence: GGG
ctcaggaggagaatggtcgc

SEQ ID NO: 46510 - DNA, 20 bp, Artificial Sequence
  Description of Artificial Sequence: Synthetic oligonucleotide
  Target: ATXN1; (-) strand; PAM type: NRG; PAM sequence: CGG
tctcaggaggagaatggtcg

SEQ ID NO: 46511 - DNA, 20 bp, Artificial Sequence
  Description of Artificial Sequence: Synthetic oligonucleotide
  Target: ATXN1; (-) strand; PAM type: NRG; PAM sequence: TGG
cagagctctcaggaggagaa

SEQ ID NO: 46512 - DNA, 20 bp, Artificial Sequence
  Description of Artificial Sequence: Synthetic oligonucleotide
  Target: ATXN1; (-) strand; PAM type: NRG; PAM sequence: GAG
gacttcagagctctcaggag

SEQ ID NO: 46513 - DNA, 20 bp, Artificial Sequence
  Description of Artificial Sequence: Synthetic oligonucleotide
  Target: ATXN1; (-) strand; PAM type: NRG; PAM sequence: AGG
atgacttcagagctctcagg

SEQ ID NO: 46514 - DNA, 20 bp, Artificial Sequence
  Description of Artificial Sequence: Synthetic oligonucleotide
  Target: ATXN1; (-) strand; PAM type: NRG; PAM sequence: GAG
aatgacttcagagctctcag

SEQ ID NO: 46515 - DNA, 20 bp, Artificial Sequence
  Description of Artificial Sequence: Synthetic oligonucleotide
  Target: ATXN1; (-) strand; PAM type: NRG; PAM sequence: AGG
gtaatgacttcagagctctc

SEQ ID NO: 46516 - DNA, 20 bp, Artificial Sequence
  Description of Artificial Sequence: Synthetic oligonucleotide
  Target: ATXN1; (-) strand; PAM type: NRG; PAM sequence: CAG
tgtaatgacttcagagctct

SEQ ID NO: 46517 - DNA, 20 bp, Artificial Sequence
  Description of Artificial Sequence: Synthetic oligonucleotide
  Target: ATXN1; (-) strand; PAM type: NRG; PAM sequence: GAG
acttcgatgtaatgacttca

SEQ ID NO: 46518 - DNA, 20 bp, Artificial Sequence
  Description of Artificial Sequence: Synthetic oligonucleotide
  Target: ATXN1; (-) strand; PAM type: NRG; PAM sequence: CAG
ttacttcgatgtaatgactt

SEQ ID NO: 46519 - DNA, 20 bp, Artificial Sequence
  Description of Artificial Sequence: Synthetic oligonucleotide
  Target: ATXN1; (-) strand; PAM type: NRG; PAM sequence: AGG
gtgagcaagaggaatattag

SEQ ID NO: 46520 - DNA, 20 bp, Artificial Sequence
  Description of Artificial Sequence: Synthetic oligonucleotide
  Target: ATXN1; (-) strand; PAM type: NRG; PAM sequence: GAG
tgtgagcaagaggaatatta

SEQ ID NO: 46521 - DNA, 20 bp, Artificial Sequence
  Description of Artificial Sequence: Synthetic oligonucleotide
  Target: ATXN1; (-) strand; PAM type: NRG; PAM sequence: TAG
gatgtgagcaagaggaatat

SEQ ID NO: 46522 - DNA, 20 bp, Artificial Sequence
  Description of Artificial Sequence: Synthetic oligonucleotide
  Target: ATXN1; (-) strand; PAM type: NRG; PAM sequence: AGG
acttcacagatgtgagcaag

SEQ ID NO: 46523 - DNA, 20 bp, Artificial Sequence
  Description of Artificial Sequence: Synthetic oligonucleotide
  Target: ATXN1; (-) strand; PAM type: NRG; PAM sequence: GAG
aacttcacagatgtgagcaa

SEQ ID NO: 46524 - DNA, 20 bp, Artificial Sequence
  Description of Artificial Sequence: Synthetic oligonucleotide
  Target: ATXN1; (-) strand; PAM type: NRG; PAM sequence: AAG
taaacttcacagatgtgagc

SEQ ID NO: 46525 - DNA, 20 bp, Artificial Sequence
  Description of Artificial Sequence: Synthetic oligonucleotide
  Target: ATXN1; (-) strand; PAM type: NRG; PAM sequence: GAG
ttgctaaacttcacagatgt

SEQ ID NO: 46526 - DNA, 20 bp, Artificial Sequence
  Description of Artificial Sequence: Synthetic oligonucleotide
  Target: ATXN1; (-) strand; PAM type: NRG; PAM sequence: CAG
gctttatttgctaaacttca

SEQ ID NO: 46527 - DNA, 20 bp, Artificial Sequence
  Description of Artificial Sequence: Synthetic oligonucleotide
  Target: ATXN1; (-) strand; PAM type: NRG; PAM sequence: CAG
atgtccagagataggaaatt

SEQ ID NO: 46528 - DNA, 20 bp, Artificial Sequence
  Description of Artificial Sequence: Synthetic oligonucleotide
  Target: ATXN1; (-) strand; PAM type: NRG; PAM sequence: AGG
ttccctgtatgtccagagat

SEQ ID NO: 46529 - DNA, 20 bp, Artificial Sequence
  Description of Artificial Sequence: Synthetic oligonucleotide
  Target: ATXN1; (-) strand; PAM type: NRG; PAM sequence: TAG
tttccctgtatgtccagaga

SEQ ID NO: 46530 - DNA, 20 bp, Artificial Sequence
  Description of Artificial Sequence: Synthetic oligonucleotide
  Target: ATXN1; (-) strand; PAM type: NRG; PAM sequence: GAG
agtgtttccctgtatgtcca

SEQ ID NO: 46531 - DNA, 20 bp, Artificial Sequence
  Description of Artificial Sequence: Synthetic oligonucleotide
  Target: ATXN1; (-) strand; PAM type: NRG; PAM sequence: CAG
tcagtgtttccctgtatgtc

SEQ ID NO: 46532 - DNA, 20 bp, Artificial Sequence
  Description of Artificial Sequence: Synthetic oligonucleotide
  Target: ATXN1; (-) strand; PAM type: NRG; PAM sequence: CAG
aagagaggacatcacttctt

SEQ ID NO: 46533 - DNA, 20 bp, Artificial Sequence
  Description of Artificial Sequence: Synthetic oligonucleotide
  Target: ATXN1; (-) strand; PAM type: NRG; PAM sequence: AGG
aggaaatgtaggaagaagag

SEQ ID NO: 46534 - DNA, 20 bp, Artificial Sequence
  Description of Artificial Sequence: Synthetic oligonucleotide
  Target: ATXN1; (-) strand; PAM type: NRG; PAM sequence: GAG
caggaaatgtaggaagaaga

SEQ ID NO: 46535 - DNA, 20 bp, Artificial Sequence
  Description of Artificial Sequence: Synthetic oligonucleotide
  Target: ATXN1; (-) strand; PAM type: NRG; PAM sequence: GAG
ggcaggaaatgtaggaagaa

SEQ ID NO: 46536 - DNA, 20 bp, Artificial Sequence
  Description of Artificial Sequence: Synthetic oligonucleotide
  Target: ATXN1; (-) strand; PAM type: NRG; PAM sequence: AAG
tgggcaggaaatgtaggaag

SEQ ID NO: 46537 - DNA, 20 bp, Artificial Sequence
  Description of Artificial Sequence: Synthetic oligonucleotide
  Target: ATXN1; (-) strand; PAM type: NRG; PAM sequence: AAG
ccgtgggcaggaaatgtagg

SEQ ID NO: 46538 - DNA, 20 bp, Artificial Sequence
  Description of Artificial Sequence: Synthetic oligonucleotide
  Target: ATXN1; (-) strand; PAM type: NRG; PAM sequence: AGG
gtgccgtgggcaggaaatgt

SEQ ID NO: 46539 - DNA, 20 bp, Artificial Sequence
  Description of Artificial Sequence: Synthetic oligonucleotide
  Target: ATXN1; (-) strand; PAM type: NRG; PAM sequence: TAG
agtgccgtgggcaggaaatg

SEQ ID NO: 46540 - DNA, 20 bp, Artificial Sequence
  Description of Artificial Sequence: Synthetic oligonucleotide
  Target: ATXN1; (-) strand; PAM type: NRG; PAM sequence: AGG
gtgcaaagagtgccgtgggc

SEQ ID NO: 46541 - DNA, 20 bp, Artificial Sequence
  Description of Artificial Sequence: Synthetic oligonucleotide
  Target: ATXN1; (-) strand; PAM type: NRG; PAM sequence: CAG
tgtgcaaagagtgccgtggg

SEQ ID NO: 46542 - DNA, 20 bp, Artificial Sequence
  Description of Artificial Sequence: Synthetic oligonucleotide
  Target: ATXN1; (-) strand; PAM type: NRG; PAM sequence: GGG
ttttgtgcaaagagtgccgt

SEQ ID NO: 46543 - DNA, 20 bp, Artificial Sequence
  Description of Artificial Sequence: Synthetic oligonucleotide
  Target: ATXN1; (-) strand; PAM type: NRG; PAM sequence: TGG
gttttgtgcaaagagtgccg

SEQ ID NO: 46544 - DNA, 20 bp, Artificial Sequence
  Description of Artificial Sequence: Synthetic oligonucleotide
  Target: ATXN1; (-) strand; PAM type: NRG; PAM sequence: GAG
ttactgaggttttgtgcaaa

SEQ ID NO: 46545 - DNA, 20 bp, Artificial Sequence
  Description of Artificial Sequence: Synthetic oligonucleotide
  Target: ATXN1; (-) strand; PAM type: NRG; PAM sequence: AAG
ttttactgaggttttgtgca

SEQ ID NO: 46546 - DNA, 20 bp, Artificial Sequence
  Description of Artificial Sequence: Synthetic oligonucleotide
  Target: ATXN1; (-) strand; PAM type: NRG; PAM sequence: AGG
tgtgccacgattttttactg

SEQ ID NO: 46547 - DNA, 20 bp, Artificial Sequence
  Description of Artificial Sequence: Synthetic oligonucleotide
  Target: ATXN1; (-) strand; PAM type: NRG; PAM sequence: GAG
ctgtgccacgattttttact

SEQ ID NO: 46548 - DNA, 20 bp, Artificial Sequence
  Description of Artificial Sequence: Synthetic oligonucleotide
  Target: ATXN1; (-) strand; PAM type: NRG; PAM sequence: AAG
tagaataagcagggaggagg

SEQ ID NO: 46549 - DNA, 20 bp, Artificial Sequence
  Description of Artificial Sequence: Synthetic oligonucleotide
  Target: ATXN1; (-) strand; PAM type: NRG; PAM sequence: AGG
tcatagaataagcagggagg

SEQ ID NO: 46550 - DNA, 20 bp, Artificial Sequence
  Description of Artificial Sequence: Synthetic oligonucleotide
  Target: ATXN1; (-) strand; PAM type: NRG; PAM sequence: GAG
gtcatagaataagcagggag

SEQ ID NO: 46551 - DNA, 20 bp, Artificial Sequence
  Description of Artificial Sequence: Synthetic oligonucleotide
  Target: ATXN1; (-) strand; PAM type: NRG; PAM sequence: AGG
gagtcatagaataagcaggg

SEQ ID NO: 46552 - DNA, 20 bp, Artificial Sequence
  Description of Artificial Sequence: Synthetic oligonucleotide
  Target: ATXN1; (-) strand; PAM type: NRG; PAM sequence: GAG
tgagtcatagaataagcagg

SEQ ID NO: 46553 - DNA, 20 bp, Artificial Sequence
  Description of Artificial Sequence: Synthetic oligonucleotide
  Target: ATXN1; (-) strand; PAM type: NRG; PAM sequence: GGG
tctgagtcatagaataagca

SEQ ID NO: 46554 - DNA, 20 bp, Artificial Sequence
  Description of Artificial Sequence: Synthetic oligonucleotide
  Target: ATXN1; (-) strand; PAM type: NRG; PAM sequence: AGG
ttctgagtcatagaataagc

SEQ ID NO: 46555 - DNA, 20 bp, Artificial Sequence
  Description of Artificial Sequence: Synthetic oligonucleotide
  Target: ATXN1; (-) strand; PAM type: NRG; PAM sequence: CAG
cttctgagtcatagaataag

SEQ ID NO: 46556 - DNA, 20 bp, Artificial Sequence
  Description of Artificial Sequence: Synthetic oligonucleotide
  Target: ATXN1; (-) strand; PAM type: NRG; PAM sequence: AAG
aaccttctgagtcatagaat

SEQ ID NO: 46557 - DNA, 20 bp, Artificial Sequence
  Description of Artificial Sequence: Synthetic oligonucleotide
  Target: ATXN1; (-) strand; PAM type: NRG; PAM sequence: TAG
gctttgaaccttctgagtca

SEQ ID NO: 46558 - DNA, 20 bp, Artificial Sequence
  Description of Artificial Sequence: Synthetic oligonucleotide
  Target: ATXN1; (-) strand; PAM type: NRG; PAM sequence: GAG
acctttgctttgaaccttct

SEQ ID NO: 46559 - DNA, 20 bp, Artificial Sequence
  Description of Artificial Sequence: Synthetic oligonucleotide
  Target: ATXN1; (-) strand; PAM type: NRG; PAM sequence: AGG
ttctgacttaaggccaaatt

SEQ ID NO: 46560 - DNA, 20 bp, Artificial Sequence
  Description of Artificial Sequence: Synthetic oligonucleotide
  Target: ATXN1; (-) strand; PAM type: NRG; PAM sequence: TAG
tttctgacttaaggccaaat

SEQ ID NO: 46561 - DNA, 20 bp, Artificial Sequence
  Description of Artificial Sequence: Synthetic oligonucleotide
  Target: ATXN1; (-) strand; PAM type: NRG; PAM sequence: AGG
gtggaaccttttctgactta

SEQ ID NO: 46562 - DNA, 20 bp, Artificial Sequence
  Description of Artificial Sequence: Synthetic oligonucleotide
  Target: ATXN1; (-) strand; PAM type: NRG; PAM sequence: AAG
agtggaaccttttctgactt

SEQ ID NO: 46563 - DNA, 20 bp, Artificial Sequence
  Description of Artificial Sequence: Synthetic oligonucleotide
  Target: ATXN1; (-) strand; PAM type: NRG; PAM sequence: TGG
aactcagtgtgagacagcag

SEQ ID NO: 46564 - DNA, 20 bp, Artificial Sequence
  Description of Artificial Sequence: Synthetic oligonucleotide
  Target: ATXN1; (-) strand; PAM type: NRG; PAM sequence: CAG
tgaaactcagtgtgagacag

SEQ ID NO: 46565 - DNA, 20 bp, Artificial Sequence
  Description of Artificial Sequence: Synthetic oligonucleotide
  Target: ATXN1; (-) strand; PAM type: NRG; PAM sequence: CAG
ctttgaaactcagtgtgaga

SEQ ID NO: 46566 - DNA, 20 bp, Artificial Sequence
  Description of Artificial Sequence: Synthetic oligonucleotide
  Target: ATXN1; (-) strand; PAM type: NRG; PAM sequence: GAG
tttgctttgaaactcagtgt

SEQ ID NO: 46567 - DNA, 20 bp, Artificial Sequence
  Description of Artificial Sequence: Synthetic oligonucleotide
  Target: ATXN1; (-) strand; PAM type: NRG; PAM sequence: CAG
ttcttctttgctttgaaact

SEQ ID NO: 46568 - DNA, 20 bp, Artificial Sequence
  Description of Artificial Sequence: Synthetic oligonucleotide
  Target: ATXN1; (-) strand; PAM type: NRG; PAM sequence: CAG
attatattcagaattaaata

SEQ ID NO: 46569 - DNA, 20 bp, Artificial Sequence
  Description of Artificial Sequence: Synthetic oligonucleotide
  Target: ATXN1; (-) strand; PAM type: NRG; PAM sequence: CAG
aacagcaaagagattatatt

SEQ ID NO: 46570 - DNA, 20 bp, Artificial Sequence
  Description of Artificial Sequence: Synthetic oligonucleotide
  Target: ATXN1; (-) strand; PAM type: NRG; PAM sequence: GAG
ataacattgccaacagcaaa

SEQ ID NO: 46571 - DNA, 20 bp, Artificial Sequence
  Description of Artificial Sequence: Synthetic oligonucleotide
  Target: ATXN1; (-) strand; PAM type: NRG; PAM sequence: AAG
ccataacattgccaacagca

SEQ ID NO: 46572 - DNA, 20 bp, Artificial Sequence
  Description of Artificial Sequence: Synthetic oligonucleotide
  Target: ATXN1; (-) strand; PAM type: NRG; PAM sequence: CAG
tattcccataacattgccaa

SEQ ID NO: 46573 - DNA, 20 bp, Artificial Sequence
  Description of Artificial Sequence: Synthetic oligonucleotide
  Target: ATXN1; (-) strand; PAM type: NRG; PAM sequence: AAG
ctgaaaaatttattcatgga

SEQ ID NO: 46574 - DNA, 20 bp, Artificial Sequence
  Description of Artificial Sequence: Synthetic oligonucleotide
  Target: ATXN1; (-) strand; PAM type: NRG; PAM sequence: TGG
gattctgaaaaatttattca

SEQ ID NO: 46575 - DNA, 20 bp, Artificial Sequence
  Description of Artificial Sequence: Synthetic oligonucleotide
  Target: ATXN1; (-) strand; PAM type: NRG; PAM sequence: TAG
aattatgtgagcctcaactt

SEQ ID NO: 46576 - DNA, 20 bp, Artificial Sequence
  Description of Artificial Sequence: Synthetic oligonucleotide
  Target: ATXN1; (-) strand; PAM type: NRG; PAM sequence: GAG
gaaaatactaacaattatgt

SEQ ID NO: 46577 - DNA, 20 bp, Artificial Sequence
  Description of Artificial Sequence: Synthetic oligonucleotide
  Target: ATXN1; (-) strand; PAM type: NRG; PAM sequence: GGG
gaaaattgaaaaacactgtg

SEQ ID NO: 46578 - DNA, 20 bp, Artificial Sequence
  Description of Artificial Sequence: Synthetic oligonucleotide
  Target: ATXN1; (-) strand; PAM type: NRG; PAM sequence: GGG
ggaaaattgaaaaacactgt

SEQ ID NO: 46579 - DNA, 20 bp, Artificial Sequence
  Description of Artificial Sequence: Synthetic oligonucleotide
  Target: ATXN1; (-) strand; PAM type: NRG; PAM sequence: TGG
aggaaaattgaaaaacactg

SEQ ID NO: 46580 - DNA, 20 bp, Artificial Sequence
  Description of Artificial Sequence: Synthetic oligonucleotide
  Target: ATXN1; (-) strand; PAM type: NRG; PAM sequence: AGG
ttcagtctacttcccttcca

SEQ ID NO: 46581 - DNA, 20 bp, Artificial Sequence
  Description of Artificial Sequence: Synthetic oligonucleotide
  Target: ATXN1; (-) strand; PAM type: NRG; PAM sequence: AAG
attcagtctacttcccttcc

SEQ ID NO: 46582 - DNA, 20 bp, Artificial Sequence
  Description of Artificial Sequence: Synthetic oligonucleotide
  Target: ATXN1; (-) strand; PAM type: NRG; PAM sequence: CAG
gaaactgaggtattgtaatt

SEQ ID NO: 46583 - DNA, 20 bp, Artificial Sequence
  Description of Artificial Sequence: Synthetic oligonucleotide
  Target: ATXN1; (-) strand; PAM type: NRG; PAM sequence: AGG
gcttacaaaatgagaaactg

SEQ ID NO: 46584 - DNA, 20 bp, Artificial Sequence
  Description of Artificial Sequence: Synthetic oligonucleotide
  Target: ATXN1; (-) strand; PAM type: NRG; PAM sequence: GAG
agcttacaaaatgagaaact

SEQ ID NO: 46585 - DNA, 20 bp, Artificial Sequence
  Description of Artificial Sequence: Synthetic oligonucleotide
  Target: ATXN1; (-) strand; PAM type: NRG; PAM sequence: GAG
ttcttggcagcttacaaaat

SEQ ID NO: 46586 - DNA, 20 bp, Artificial Sequence
  Description of Artificial Sequence: Synthetic oligonucleotide
  Target: ATXN1; (-) strand; PAM type: NRG; PAM sequence: CAG
acagttcatactgttcttgg

SEQ ID NO: 46587 - DNA, 20 bp, Artificial Sequence
  Description of Artificial Sequence: Synthetic oligonucleotide
  Target: ATXN1; (-) strand; PAM type: NRG; PAM sequence: TGG
aggacagttcatactgttct

SEQ ID NO: 46588 - DNA, 20 bp, Artificial Sequence
  Description of Artificial Sequence: Synthetic oligonucleotide
  Target: ATXN1; (-) strand; PAM type: NRG; PAM sequence: CAG
atgtttctttagttccagga

SEQ ID NO: 46589 - DNA, 20 bp, Artificial Sequence
  Description of Artificial Sequence: Synthetic oligonucleotide
  Target: ATXN1; (-) strand; PAM type: NRG; PAM sequence: AGG
ccttatgtttctttagttcc

SEQ ID NO: 46590 - DNA, 20 bp, Artificial Sequence
  Description of Artificial Sequence: Synthetic oligonucleotide
  Target: ATXN1; (-) strand; PAM type: NRG; PAM sequence: CAG
tccttatgtttctttagttc

SEQ ID NO: 46591 - DNA, 20 bp, Artificial Sequence
  Description of Artificial Sequence: Synthetic oligonucleotide
  Target: ATXN1; (-) strand; PAM type: NRG; PAM sequence: TAG
catttgtccttatgtttctt

SEQ ID NO: 46592 - DNA, 20 bp, Artificial Sequence
  Description of Artificial Sequence: Synthetic oligonucleotide
  Target: ATXN1; (-) strand; PAM type: NRG; PAM sequence: TGG
agaatttcaaacggctttcc

SEQ ID NO: 46593 - DNA, 20 bp, Artificial Sequence
  Description of Artificial Sequence: Synthetic oligonucleotide
  Target: ATXN1; (-) strand; PAM type: NRG; PAM sequence: CGG
ttcccccaaagaatttcaaa

SEQ ID NO: 46594 - DNA, 20 bp, Artificial Sequence
  Description of Artificial Sequence: Synthetic oligonucleotide
  Target: ATXN1; (-) strand; PAM type: NRG; PAM sequence: AAG
agttatatgcttttccccca

SEQ ID NO: 46595 - DNA, 20 bp, Artificial Sequence
  Description of Artificial Sequence: Synthetic oligonucleotide
  Target: ATXN1; (-) strand; PAM type: NRG; PAM sequence: AAG
taacccagggtggtctgcat

SEQ ID NO: 46596 - DNA, 20 bp, Artificial Sequence
  Description of Artificial Sequence: Synthetic oligonucleotide
  Target: ATXN1; (-) strand; PAM type: NRG; PAM sequence: TGG
aaaaactggataacccaggg

SEQ ID NO: 46597 - DNA, 20 bp, Artificial Sequence
  Description of Artificial Sequence: Synthetic oligonucleotide
  Target: ATXN1; (-) strand; PAM type: NRG; PAM sequence: GGG
tttaaaaactggataaccca

SEQ ID NO: 46598 - DNA, 20 bp, Artificial Sequence
  Description of Artificial Sequence: Synthetic oligonucleotide
  Target: ATXN1; (-) strand; PAM type: NRG; PAM sequence: AGG
ttttaaaaactggataaccc

SEQ ID NO: 46599 - DNA, 20 bp, Artificial Sequence
  Description of Artificial Sequence: Synthetic oligonucleotide
  Target: ATXN1; (-) strand; PAM type: NRG; PAM sequence: CAG
tttttaaaaactggataacc

SEQ ID NO: 46600 - DNA, 20 bp, Artificial Sequence
  Description of Artificial Sequence: Synthetic oligonucleotide
  Target: ATXN1; (-) strand; PAM type: NRG; PAM sequence: TGG
atgcagggatttttaaaaac

SEQ ID NO: 46601 - DNA, 20 bp, Artificial Sequence
  Description of Artificial Sequence: Synthetic oligonucleotide
  Target: ATXN1; (-) strand; PAM type: NRG; PAM sequence: GGG
agaagtttgtctagtatgca

SEQ ID NO: 46602 - DNA, 20 bp, Artificial Sequence
  Description of Artificial Sequence: Synthetic oligonucleotide
  Target: ATXN1; (-) strand; PAM type: NRG; PAM sequence: AGG
aagaagtttgtctagtatgc

SEQ ID NO: 46603 - DNA, 20 bp, Artificial Sequence
  Description of Artificial Sequence: Synthetic oligonucleotide
  Target: ATXN1; (-) strand; PAM type: NRG; PAM sequence: CAG
aaagaagtttgtctagtatg

SEQ ID NO: 46604 - DNA, 20 bp, Artificial Sequence
  Description of Artificial Sequence: Synthetic oligonucleotide
  Target: ATXN1; (-) strand; PAM type: NRG; PAM sequence: TAG
tggtccaaaagaagtttgtc

SEQ ID NO: 46605 - DNA, 20 bp, Artificial Sequence
  Description of Artificial Sequence: Synthetic oligonucleotide
  Target: ATXN1; (-) strand; PAM type: NRG; PAM sequence: AAG
aaagaaacgtggtccaaaag

SEQ ID NO: 46606 - DNA, 20 bp, Artificial Sequence
  Description of Artificial Sequence: Synthetic oligonucleotide
  Target: ATXN1; (-) strand; PAM type: NRG; PAM sequence: AAG
aggaaagaaacgtggtccaa

SEQ ID NO: 46607 - DNA, 20 bp, Artificial Sequence
  Description of Artificial Sequence: Synthetic oligonucleotide
  Target: ATXN1; (-) strand; PAM type: NRG; PAM sequence: TGG
cttctcttaggaaagaaacg

SEQ ID NO: 46608 - DNA, 20 bp, Artificial Sequence
  Description of Artificial Sequence: Synthetic oligonucleotide
  Target: ATXN1; (-) strand; PAM type: NRG; PAM sequence: AAG
tcttcaagcttctcttagga

SEQ ID NO: 46609 - DNA, 20 bp, Artificial Sequence
  Description of Artificial Sequence: Synthetic oligonucleotide
  Target: ATXN1; (-) strand; PAM type: NRG; PAM sequence: AGG
gctgtcttcaagcttctctt

SEQ ID NO: 46610 - DNA, 20 bp, Artificial Sequence
  Description of Artificial Sequence: Synthetic oligonucleotide
  Target: ATXN1; (-) strand; PAM type: NRG; PAM sequence: TAG
tgctgtcttcaagcttctct

SEQ ID NO: 46611 - DNA, 20 bp, Artificial Sequence
  Description of Artificial Sequence: Synthetic oligonucleotide
  Target: ATXN1; (-) strand; PAM type: NRG; PAM sequence: AAG
aaaattagtttgctgtcttc

SEQ ID NO: 46612 - DNA, 20 bp, Artificial Sequence
  Description of Artificial Sequence: Synthetic oligonucleotide
  Target: ATXN1; (-) strand; PAM type: NRG; PAM sequence: TAG
caaatgcctaatttgaaaat

SEQ ID NO: 46613 - DNA, 20 bp, Artificial Sequence
  Description of Artificial Sequence: Synthetic oligonucleotide
  Target: ATXN1; (-) strand; PAM type: NRG; PAM sequence: AAG
atcaaaagtttgttttgctc

SEQ ID NO: 46614 - DNA, 20 bp, Artificial Sequence
  Description of Artificial Sequence: Synthetic oligonucleotide
  Target: ATXN1; (-) strand; PAM type: NRG; PAM sequence: AAG
tgttttttgaatataatcaa

SEQ ID NO: 46615 - DNA, 20 bp, Artificial Sequence
  Description of Artificial Sequence: Synthetic oligonucleotide
  Target: ATXN1; (-) strand; PAM type: NRG; PAM sequence: TGG
ctagatctccagaatttttt

SEQ ID NO: 46616 - DNA, 20 bp, Artificial Sequence
  Description of Artificial Sequence: Synthetic oligonucleotide
  Target: ATXN1; (-) strand; PAM type: NRG; PAM sequence: CAG
gctttcccaatctagatctc

SEQ ID NO: 46617 - DNA, 20 bp, Artificial Sequence
  Description of Artificial Sequence: Synthetic oligonucleotide
  Target: ATXN1; (-) strand; PAM type: NRG; PAM sequence: TAG
tgacccctgctttcccaatc

SEQ ID NO: 46618 - DNA, 20 bp, Artificial Sequence
  Description of Artificial Sequence: Synthetic oligonucleotide
  Target: ATXN1; (-) strand; PAM type: NRG; PAM sequence: TAG
gtcaccacagtcctccatat

SEQ ID NO: 46619 - DNA, 20 bp, Artificial Sequence
  Description of Artificial Sequence: Synthetic oligonucleotide
  Target: ATXN1; (-) strand; PAM type: NRG; PAM sequence: CAG
ttatggtctgattgtcacca

SEQ ID NO: 46620 - DNA, 20 bp, Artificial Sequence
  Description of Artificial Sequence: Synthetic oligonucleotide
  Target: ATXN1; (-) strand; PAM type: NRG; PAM sequence: TGG
acatattactgtccgtatta

SEQ ID NO: 46621 - DNA, 20 bp, Artificial Sequence
  Description of Artificial Sequence: Synthetic oligonucleotide
  Target: ATXN1; (-) strand; PAM type: NRG; PAM sequence: TGG
aagaatataaagaggtggtg

SEQ ID NO: 46622 - DNA, 20 bp, Artificial Sequence
  Description of Artificial Sequence: Synthetic oligonucleotide
  Target: ATXN1; (-) strand; PAM type: NRG; PAM sequence: TGG
gtgaaaagaatataaagagg

SEQ ID NO: 46623 - DNA, 20 bp, Artificial Sequence
  Description of Artificial Sequence: Synthetic oligonucleotide
  Target: ATXN1; (-) strand; PAM type: NRG; PAM sequence: AGG
ttggtgaaaagaatataaag

SEQ ID NO: 46624 - DNA, 20 bp, Artificial Sequence
  Description of Artificial Sequence: Synthetic oligonucleotide
  Target: ATXN1; (-) strand; PAM type: NRG; PAM sequence: GAG
gttggtgaaaagaatataaa

SEQ ID NO: 46625 - DNA, 20 bp, Artificial Sequence
  Description of Artificial Sequence: Synthetic oligonucleotide
  Target: ATXN1; (-) strand; PAM type: NRG; PAM sequence: AAG
ctgttggtgaaaagaatata

SEQ ID NO: 46626 - DNA, 20 bp, Artificial Sequence
  Description of Artificial Sequence: Synthetic oligonucleotide
  Target: ATXN1; (-) strand; PAM type: NRG; PAM sequence: AAG
catttgagactgttggtgaa

SEQ ID NO: 46627 - DNA, 20 bp, Artificial Sequence
  Description of Artificial Sequence: Synthetic oligonucleotide
  Target: ATXN1; (-) strand; PAM type: NRG; PAM sequence: TGG
aaaccagcatttgagactgt

SEQ ID NO: 46628 - DNA, 20 bp, Artificial Sequence
  Description of Artificial Sequence: Synthetic oligonucleotide
  Target: ATXN1; (-) strand; PAM type: NRG; PAM sequence: GAG
ttatgctgaaaccagcattt

SEQ ID NO: 46629 - DNA, 20 bp, Artificial Sequence
  Description of Artificial Sequence: Synthetic oligonucleotide
  Target: ATXN1; (-) strand; PAM type: NRG; PAM sequence: CAG
tcttggccttatgctgaaac

SEQ ID NO: 46630 - DNA, 20 bp, Artificial Sequence
  Description of Artificial Sequence: Synthetic oligonucleotide
  Target: ATXN1; (-) strand; PAM type: NRG; PAM sequence: TGG
ccatatagatttgggtttct

SEQ ID NO: 46631 - DNA, 20 bp, Artificial Sequence
  Description of Artificial Sequence: Synthetic oligonucleotide
  Target: ATXN1; (-) strand; PAM type: NRG; PAM sequence: GGG
cataaattccatatagattt

SEQ ID NO: 46632 - DNA, 20 bp, Artificial Sequence
  Description of Artificial Sequence: Synthetic oligonucleotide
  Target: ATXN1; (-) strand; PAM type: NRG; PAM sequence: TGG
gcataaattccatatagatt

SEQ ID NO: 46633 - DNA, 20 bp, Artificial Sequence
  Description of Artificial Sequence: Synthetic oligonucleotide
  Target: ATXN1; (-) strand; PAM type: NRG; PAM sequence: TAG
gaatttgcataaattccata

SEQ ID NO: 46634 - DNA, 20 bp, Artificial Sequence
  Description of Artificial Sequence: Synthetic oligonucleotide
  Target: ATXN1; (-) strand; PAM type: NRG; PAM sequence: TGG
taaatgaatataaatcgatg

SEQ ID NO: 46635 - DNA, 20 bp, Artificial Sequence
  Description of Artificial Sequence: Synthetic oligonucleotide
  Target: ATXN1; (-) strand; PAM type: NRG; PAM sequence: TGG
aataagctgcattttataaa

SEQ ID NO: 46636 - DNA, 20 bp, Artificial Sequence
  Description of Artificial Sequence: Synthetic oligonucleotide
  Target: ATXN1; (-) strand; PAM type: NRG; PAM sequence: AAG
tgtttcgccacctataaaat

SEQ ID NO: 46637 - DNA, 20 bp, Artificial Sequence
  Description of Artificial Sequence: Synthetic oligonucleotide
  Target: ATXN1; (-) strand; PAM type: NRG; PAM sequence: AGG
agtagtgcatatttgtctct

SEQ ID NO: 46638 - DNA, 20 bp, Artificial Sequence
  Description of Artificial Sequence: Synthetic oligonucleotide
  Target: ATXN1; (-) strand; PAM type: NRG; PAM sequence: TAG
tagtagtgcatatttgtctc

SEQ ID NO: 46639 - DNA, 20 bp, Artificial Sequence
  Description of Artificial Sequence: Synthetic oligonucleotide
  Target: ATXN1; (-) strand; PAM type: NRG; PAM sequence: TAG
tcaaacccataggaccttag

SEQ ID NO: 46640 - DNA, 20 bp, Artificial Sequence
  Description of Artificial Sequence: Synthetic oligonucleotide
  Target: ATXN1; (-) strand; PAM type: NRG; PAM sequence: TAG
gtctcaaacccataggacct

SEQ ID NO: 46641 - DNA, 20 bp, Artificial Sequence
  Description of Artificial Sequence: Synthetic oligonucleotide
  Target: ATXN1; (-) strand; PAM type: NRG; PAM sequence: AGG
taaaaatgtctcaaacccat

SEQ ID NO: 46642 - DNA, 20 bp, Artificial Sequence
  Description of Artificial Sequence: Synthetic oligonucleotide
  Target: ATXN1; (-) strand; PAM type: NRG; PAM sequence: TAG
ataaaaatgtctcaaaccca

SEQ ID NO: 46643 - DNA, 20 bp, Artificial Sequence
  Description of Artificial Sequence: Synthetic oligonucleotide
  Target: ATXN1; (-) strand; PAM type: NRG; PAM sequence: AAG
gagtgagactgcgtctcaaa

SEQ ID NO: 46644 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggtgacagagt

SEQ ID NO: 46645 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggtgaca

SEQ ID NO: 46646 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggtga

SEQ ID NO: 46647 - DNA, 20 bp, Artificial Sequence
  Description of Artificial Sequence: Synthetic oligonucleotide
  Target: ATXN1; (-) strand; PAM type: NRG; PAM sequence: GGG
acgccactgcactccagcct

SEQ ID NO: 46648 - DNA, 20 bp, Artificial Sequence
  Description of Artificial Sequence: Synthetic oligonucleotide
  Target: ATXN1; (-) strand; PAM type: NRG; PAM sequence: TGG
cacgccactgcactccagcc

SEQ ID NO: 46649 - DNA, 20 bp, Artificial Sequence
  Description of Artificial Sequence: Synthetic oligonucleotide
  Target: ATXN1; (-) strand; PAM type: NRG; PAM sequence: CAG
ggggtcacgccactgcactc

SEQ ID NO: 46650 - DNA, 20 bp, Artificial Sequence
  Description of Artificial Sequence: Synthetic oligonucleotide
  Target: ATXN1; (-) strand; PAM type: NRG; PAM sequence: GGG
gcagaggttgcagtgagccg

SEQ ID NO: 46651 - DNA, 20 bp, Artificial Sequence
  Description of Artificial Sequence: Synthetic oligonucleotide
  Target: ATXN1; (-) strand; PAM type: NRG; PAM sequence: GGG
ggcagaggttgcagtgagcc

SEQ ID NO: 46652 - DNA, 20 bp, Artificial Sequence
  Description of Artificial Sequence: Synthetic oligonucleotide
  Target: ATXN1; (-) strand; PAM type: NRG; PAM sequence: CGG
aggcagaggttgcagtgagc

SEQ ID NO: 46653 - DNA, 20 bp, Artificial Sequence
  Description of Artificial Sequence: Synthetic oligonucleotide
  Target: ATXN1; (-) strand; PAM type: NRG; PAM sequence: GAG
cgggaggcagaggttgcagt

SEQ ID NO: 46654 - DNA, 20 bp, Artificial Sequence
  Description of Artificial Sequence: Synthetic oligonucleotide
  Target: ATXN1; (-) strand; PAM type: NRG; PAM sequence: CAG
aacccgggaggcagaggttg

SEQ ID NO: 46655 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacccgggaggcag

SEQ ID NO: 46656 - DNA, 20 bp, Artificial Sequence
  Description of Artificial Sequence: Synthetic oligonucleotide
  Target: ATXN1; (-) strand; PAM type: NRG; PAM sequence: GAG
ccgcttgaacccgggaggca

SEQ ID NO: 46657 - DNA, 20 bp, Artificial Sequence
  Description of Artificial Sequence: Synthetic oligonucleotide
  Target: ATXN1; (-) strand; PAM type: NRG; PAM sequence: CAG
aaccgcttgaacccgggagg

SEQ ID NO: 46658 - DNA, 20 bp, Artificial Sequence
  Description of Artificial Sequence: Synthetic oligonucleotide
  Target: ATXN1; (-) strand; PAM type: NRG; PAM sequence: AGG
aagaaccgcttgaacccggg

SEQ ID NO: 46659 - DNA, 20 bp, Artificial Sequence
  Description of Artificial Sequence: Synthetic oligonucleotide
  Target: ATXN1; (-) strand; PAM type: NRG; PAM sequence: GAG
gaagaaccgcttgaacccgg

SEQ ID NO: 46660 - DNA, 20 bp, Artificial Sequence
  Description of Artificial Sequence: Synthetic oligonucleotide
  Target: ATXN1; (-) strand; PAM type: NRG; PAM sequence: GGG
cagaagaaccgcttgaaccc

SEQ ID NO: 46661 - DNA, 20 bp, Artificial Sequence
  Description of Artificial Sequence: Synthetic oligonucleotide
  Target: ATXN1; (-) strand; PAM type: NRG; PAM sequence: CGG
gcagaagaaccgcttgaacc

SEQ ID NO: 46662 - DNA, 20 bp, Artificial Sequence
  Description of Artificial Sequence: Synthetic oligonucleotide
  Target: ATXN1; (-) strand; PAM type: NRG; PAM sequence: AAG
tactcaggaggctgaggcag

SEQ ID NO: 46663 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgagg

SEQ ID NO: 46664 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 46665 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 46666 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctactcagg

SEQ ID NO: 46667 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctactcag

SEQ ID NO: 46668 - DNA, 20 bp, Artificial Sequence
  Description of Artificial Sequence: Synthetic oligonucleotide
  Target: ATXN1; (-) strand; PAM type: NRG; PAM sequence: AGG
acctgtagtcccagctactc

SEQ ID NO: 46669 - DNA, 20 bp, Artificial Sequence
  Description of Artificial Sequence: Synthetic oligonucleotide
  Target: ATXN1; (-) strand; PAM type: NRG; PAM sequence: CAG
cacctgtagtcccagctact

SEQ ID NO: 46670 - DNA, 20 bp, Artificial Sequence
  Description of Artificial Sequence: Synthetic oligonucleotide
  Target: ATXN1; (-) strand; PAM type: NRG; PAM sequence: CAG
gtggcgggcacctgtagtcc

SEQ ID NO: 46671 - DNA, 20 bp, Artificial Sequence
  Description of Artificial Sequence: Synthetic oligonucleotide
  Target: ATXN1; (-) strand; PAM type: NRG; PAM sequence: TAG
ggcatggtggcgggcacctg

SEQ ID NO: 46672 - DNA, 20 bp, Artificial Sequence
  Description of Artificial Sequence: Synthetic oligonucleotide
  Target: ATXN1; (-) strand; PAM type: NRG; PAM sequence: GGG
aattagccgggcatggtggc

SEQ ID NO: 46673 - DNA, 20 bp, Artificial Sequence
  Description of Artificial Sequence: Synthetic oligonucleotide
  Target: ATXN1; (-) strand; PAM type: NRG; PAM sequence: CGG
aaattagccgggcatggtgg

SEQ ID NO: 46674 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccgggcatgg

SEQ ID NO: 46675 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagccgggca

SEQ ID NO: 46676 - DNA, 20 bp, Artificial Sequence
  Description of Artificial Sequence: Synthetic oligonucleotide
  Target: ATXN1; (-) strand; PAM type: NRG; PAM sequence: GGG
caaaaatacaaaaattagcc

SEQ ID NO: 46677 - DNA, 20 bp, Artificial Sequence
  Description of Artificial Sequence: Synthetic oligonucleotide
  Target: ATXN1; (-) strand; PAM type: NRG; PAM sequence: CGG
ccaaaaatacaaaaattagc

SEQ ID NO: 46678 - DNA, 20 bp, Artificial Sequence
  Description of Artificial Sequence: Synthetic oligonucleotide
  Target: ATXN1; (-) strand; PAM type: NRG; PAM sequence: TAG
tctaccaaaaatacaaaaat

SEQ ID NO: 46679 - DNA, 20 bp, Artificial Sequence
  Description of Artificial Sequence: Synthetic oligonucleotide
  Target: ATXN1; (-) strand; PAM type: NRG; PAM sequence: TGG
tgagaccagcctgaccaaca

SEQ ID NO: 46680 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagtttgagac

SEQ ID NO: 46681 - DNA, 20 bp, Artificial Sequence
  Description of Artificial Sequence: Synthetic oligonucleotide
  Target: ATXN1; (-) strand; PAM type: NRG; PAM sequence: GAG
tcatttgaggtcaggagttt

SEQ ID NO: 46682 - DNA, 20 bp, Artificial Sequence
  Description of Artificial Sequence: Synthetic oligonucleotide
  Target: ATXN1; (-) strand; PAM type: NRG; PAM sequence: GAG
ggtggatcatttgaggtcag

SEQ ID NO: 46683 - DNA, 20 bp, Artificial Sequence
  Description of Artificial Sequence: Synthetic oligonucleotide
  Target: ATXN1; (-) strand; PAM type: NRG; PAM sequence: AGG
tgggtggatcatttgaggtc

SEQ ID NO: 46684 - DNA, 20 bp, Artificial Sequence
  Description of Artificial Sequence: Synthetic oligonucleotide
  Target: ATXN1; (-) strand; PAM type: NRG; PAM sequence: CAG
gtgggtggatcatttgaggt

SEQ ID NO: 46685 - DNA, 20 bp, Artificial Sequence
  Description of Artificial Sequence: Synthetic oligonucleotide
  Target: ATXN1; (-) strand; PAM type: NRG; PAM sequence: AGG
cgatgtgggtggatcatttg

SEQ ID NO: 46686 - DNA, 20 bp, Artificial Sequence
  Description of Artificial Sequence: Synthetic oligonucleotide
  Target: ATXN1; (-) strand; PAM type: NRG; PAM sequence: GAG
ccgatgtgggtggatcattt

SEQ ID NO: 46687 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccgatgtggg

SEQ ID NO: 46688 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccgatgt

SEQ ID NO: 46689 - DNA, 20 bp, Artificial Sequence
  Description of Artificial Sequence: Synthetic oligonucleotide
  Target: ATXN1; (-) strand; PAM type: NRG; PAM sequence: TGG
agcactttgggaggccgatg

SEQ ID NO: 46690 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 46691 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 46692 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagcacttt

SEQ ID NO: 46693 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagcactt

SEQ ID NO: 46694 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatcc

SEQ ID NO: 46695 - DNA, 20 bp, Artificial Sequence
  Description of Artificial Sequence: Synthetic oligonucleotide
  Target: ATXN1; (-) strand; PAM type: NRG; PAM sequence: TGG
aatgtcttggccaggcatgg

SEQ ID NO: 46696 - DNA, 20 bp, Artificial Sequence
  Description of Artificial Sequence: Synthetic oligonucleotide
  Target: ATXN1; (-) strand; PAM type: NRG; PAM sequence: TGG
taaaatgtcttggccaggca

SEQ ID NO: 46697 - DNA, 20 bp, Artificial Sequence
  Description of Artificial Sequence: Synthetic oligonucleotide
  Target: ATXN1; (-) strand; PAM type: NRG; PAM sequence: AGG
ttaattaaaatgtcttggcc

SEQ ID NO: 46698 - DNA, 20 bp, Artificial Sequence
  Description of Artificial Sequence: Synthetic oligonucleotide
  Target: ATXN1; (-) strand; PAM type: NRG; PAM sequence: CAG
tttaattaaaatgtcttggc

SEQ ID NO: 46699 - DNA, 20 bp, Artificial Sequence
  Description of Artificial Sequence: Synthetic oligonucleotide
  Target: ATXN1; (-) strand; PAM type: NRG; PAM sequence: TGG
agcatttaattaaaatgtct

SEQ ID NO: 46700 - DNA, 20 bp, Artificial Sequence
  Description of Artificial Sequence: Synthetic oligonucleotide
  Target: ATXN1; (-) strand; PAM type: NRG; PAM sequence: AAG
atcaaattctggactcggtt

SEQ ID NO: 46701 - DNA, 20 bp, Artificial Sequence
  Description of Artificial Sequence: Synthetic oligonucleotide
  Target: ATXN1; (-) strand; PAM type: NRG; PAM sequence: CGG
gaaagatcaaattctggact

SEQ ID NO: 46702 - DNA, 20 bp, Artificial Sequence
  Description of Artificial Sequence: Synthetic oligonucleotide
  Target: ATXN1; (-) strand; PAM type: NRG; PAM sequence: TGG
gagttagaaagatcaaattc

SEQ ID NO: 46703 - DNA, 20 bp, Artificial Sequence
  Description of Artificial Sequence: Synthetic oligonucleotide
  Target: ATXN1; (-) strand; PAM type: NRG; PAM sequence: AAG
gtaatggatgtggagttaga

SEQ ID NO: 46704 - DNA, 20 bp, Artificial Sequence
  Description of Artificial Sequence: Synthetic oligonucleotide
  Target: ATXN1; (-) strand; PAM type: NRG; PAM sequence: TAG
aagtgtaatggatgtggagt

SEQ ID NO: 46705 - DNA, 20 bp, Artificial Sequence
  Description of Artificial Sequence: Synthetic oligonucleotide
  Target: ATXN1; (-) strand; PAM type: NRG; PAM sequence: GAG
tggaaagtgtaatggatgtg

SEQ ID NO: 46706 - DNA, 20 bp, Artificial Sequence
  Description of Artificial Sequence: Synthetic oligonucleotide
  Target: ATXN1; (-) strand; PAM type: NRG; PAM sequence: TGG
agtggaaagtgtaatggatg

SEQ ID NO: 46707 - DNA, 20 bp, Artificial Sequence
  Description of Artificial Sequence: Synthetic oligonucleotide
  Target: ATXN1; (-) strand; PAM type: NRG; PAM sequence: TGG
gtgtagagtggaaagtgtaa

SEQ ID NO: 46708 - DNA, 20 bp, Artificial Sequence
  Description of Artificial Sequence: Synthetic oligonucleotide
  Target: ATXN1; (-) strand; PAM type: NRG; PAM sequence: AAG
gagccatggtgtagagtgga

SEQ ID NO: 46709 - DNA, 20 bp, Artificial Sequence
  Description of Artificial Sequence: Synthetic oligonucleotide
  Target: ATXN1; (-) strand; PAM type: NRG; PAM sequence: TGG
cggggagccatggtgtagag

SEQ ID NO: 46710 - DNA, 20 bp, Artificial Sequence
  Description of Artificial Sequence: Synthetic oligonucleotide
  Target: ATXN1; (-) strand; PAM type: NRG; PAM sequence: GAG
gcacggggagccatggtgta

SEQ ID NO: 46711 - DNA, 20 bp, Artificial Sequence
  Description of Artificial Sequence: Synthetic oligonucleotide
  Target: ATXN1; (-) strand; PAM type: NRG; PAM sequence: TAG
ctgcacggggagccatggtg

SEQ ID NO: 46712 - DNA, 20 bp, Artificial Sequence
  Description of Artificial Sequence: Synthetic oligonucleotide
  Target: ATXN1; (-) strand; PAM type: NRG; PAM sequence: TGG
gtcttctgcacggggagcca

SEQ ID NO: 46713 - DNA, 20 bp, Artificial Sequence
  Description of Artificial Sequence: Synthetic oligonucleotide
  Target: ATXN1; (-) strand; PAM type: NRG; PAM sequence: GAG
attgcagtcttctgcacggg

SEQ ID NO: 46714 - DNA, 20 bp, Artificial Sequence
  Description of Artificial Sequence: Synthetic oligonucleotide
  Target: ATXN1; (-) strand; PAM type: NRG; PAM sequence: GGG
ggattgcagtcttctgcacg

SEQ ID NO: 46715 - DNA, 20 bp, Artificial Sequence
  Description of Artificial Sequence: Synthetic oligonucleotide
  Target: ATXN1; (-) strand; PAM type: NRG; PAM sequence: GGG
tggattgcagtcttctgcac

SEQ ID NO: 46716 - DNA, 20 bp, Artificial Sequence
  Description of Artificial Sequence: Synthetic oligonucleotide
  Target: ATXN1; (-) strand; PAM type: NRG; PAM sequence: CGG
ttggattgcagtcttctgca

SEQ ID NO: 46717 - DNA, 20 bp, Artificial Sequence
  Description of Artificial Sequence: Synthetic oligonucleotide
  Target: ATXN1; (-) strand; PAM type: NRG; PAM sequence: CAG
gaactgagctgattggattg

SEQ ID NO: 46718 - DNA, 20 bp, Artificial Sequence
  Description of Artificial Sequence: Synthetic oligonucleotide
  Target: ATXN1; (-) strand; PAM type: NRG; PAM sequence: TGG
cctctgggaactgagctgat

SEQ ID NO: 46719 - DNA, 20 bp, Artificial Sequence
  Description of Artificial Sequence: Synthetic oligonucleotide
  Target: ATXN1; (-) strand; PAM type: NRG; PAM sequence: GAG
gtctagaccctctgggaact

SEQ ID NO: 46720 - DNA, 20 bp, Artificial Sequence
  Description of Artificial Sequence: Synthetic oligonucleotide
  Target: ATXN1; (-) strand; PAM type: NRG; PAM sequence: GGG
tacctgagtctagaccctct

SEQ ID NO: 46721 - DNA, 20 bp, Artificial Sequence
  Description of Artificial Sequence: Synthetic oligonucleotide
  Target: ATXN1; (-) strand; PAM type: NRG; PAM sequence: TGG
ctacctgagtctagaccctc

SEQ ID NO: 46722 - DNA, 20 bp, Artificial Sequence
  Description of Artificial Sequence: Synthetic oligonucleotide
  Target: ATXN1; (-) strand; PAM type: NRG; PAM sequence: TAG
ttattgtcgctacctgagtc

SEQ ID NO: 46723 - DNA, 20 bp, Artificial Sequence
  Description of Artificial Sequence: Synthetic oligonucleotide
  Target: ATXN1; (-) strand; PAM type: NRG; PAM sequence: GAG
catgtttattgtcgctacct

SEQ ID NO: 46724 - DNA, 20 bp, Artificial Sequence
  Description of Artificial Sequence: Synthetic oligonucleotide
  Target: ATXN1; (-) strand; PAM type: NRG; PAM sequence: GAG
gcttccatcaatcattcctc

SEQ ID NO: 46725 - DNA, 20 bp, Artificial Sequence
  Description of Artificial Sequence: Synthetic oligonucleotide
  Target: ATXN1; (-) strand; PAM type: NRG; PAM sequence: CAG
cccactcctttggttcaacc

SEQ ID NO: 46726 - DNA, 20 bp, Artificial Sequence
  Description of Artificial Sequence: Synthetic oligonucleotide
  Target: ATXN1; (-) strand; PAM type: NRG; PAM sequence: TGG
cctgagagctcccactcctt

SEQ ID NO: 46727 - DNA, 20 bp, Artificial Sequence
  Description of Artificial Sequence: Synthetic oligonucleotide
  Target: ATXN1; (-) strand; PAM type: NRG; PAM sequence: GAG
cctttcctattcccacctga

SEQ ID NO: 46728 - DNA, 20 bp, Artificial Sequence
  Description of Artificial Sequence: Synthetic oligonucleotide
  Target: ATXN1; (-) strand; PAM type: NRG; PAM sequence: GAG
tacctttcctattcccacct

SEQ ID NO: 46729 - DNA, 20 bp, Artificial Sequence
  Description of Artificial Sequence: Synthetic oligonucleotide
  Target: ATXN1; (-) strand; PAM type: NRG; PAM sequence: CAG
ccattctgtgtatcttattg

SEQ ID NO: 46730 - DNA, 20 bp, Artificial Sequence
  Description of Artificial Sequence: Synthetic oligonucleotide
  Target: ATXN1; (-) strand; PAM type: NRG; PAM sequence: TAG
tatctgcccctcctctagct

SEQ ID NO: 46731 - DNA, 20 bp, Artificial Sequence
  Description of Artificial Sequence: Synthetic oligonucleotide
  Target: ATXN1; (-) strand; PAM type: NRG; PAM sequence: TAG
tttattatctgcccctcctc

SEQ ID NO: 46732 - DNA, 20 bp, Artificial Sequence
  Description of Artificial Sequence: Synthetic oligonucleotide
  Target: ATXN1; (-) strand; PAM type: NRG; PAM sequence: GAG
gtcttactatctttattaac

SEQ ID NO: 46733 - DNA, 20 bp, Artificial Sequence
  Description of Artificial Sequence: Synthetic oligonucleotide
  Target: ATXN1; (-) strand; PAM type: NRG; PAM sequence: GGG
agagccacgtaaagctaaat

SEQ ID NO: 46734 - DNA, 20 bp, Artificial Sequence
  Description of Artificial Sequence: Synthetic oligonucleotide
  Target: ATXN1; (-) strand; PAM type: NRG; PAM sequence: TGG
tagagccacgtaaagctaaa

SEQ ID NO: 46735 - DNA, 20 bp, Artificial Sequence
  Description of Artificial Sequence: Synthetic oligonucleotide
  Target: ATXN1; (-) strand; PAM type: NRG; PAM sequence: AAG
gtttatcttagagccacgta

SEQ ID NO: 46736 - DNA, 20 bp, Artificial Sequence
  Description of Artificial Sequence: Synthetic oligonucleotide
  Target: ATXN1; (-) strand; PAM type: NRG; PAM sequence: GAG
gttcctgtatgtttatctta

SEQ ID NO: 46737 - DNA, 20 bp, Artificial Sequence
  Description of Artificial Sequence: Synthetic oligonucleotide
  Target: ATXN1; (-) strand; PAM type: NRG; PAM sequence: TAG
gagttcctgtatgtttatct

SEQ ID NO: 46738 - DNA, 20 bp, Artificial Sequence
  Description of Artificial Sequence: Synthetic oligonucleotide
  Target: ATXN1; (-) strand; PAM type: NRG; PAM sequence: GAG
tactcttggtcctttcagga

SEQ ID NO: 46739 - DNA, 20 bp, Artificial Sequence
  Description of Artificial Sequence: Synthetic oligonucleotide
  Target: ATXN1; (-) strand; PAM type: NRG; PAM sequence: GAG
cctactcttggtcctttcag

SEQ ID NO: 46740 - DNA, 20 bp, Artificial Sequence
  Description of Artificial Sequence: Synthetic oligonucleotide
  Target: ATXN1; (-) strand; PAM type: NRG; PAM sequence: AGG
tacctactcttggtcctttc

SEQ ID NO: 46741 - DNA, 20 bp, Artificial Sequence
  Description of Artificial Sequence: Synthetic oligonucleotide
  Target: ATXN1; (-) strand; PAM type: NRG; PAM sequence: CAG
ttacctactcttggtccttt

SEQ ID NO: 46742 - DNA, 20 bp, Artificial Sequence
  Description of Artificial Sequence: Synthetic oligonucleotide
  Target: ATXN1; (-) strand; PAM type: NRG; PAM sequence: TGG
cccgttcccttacctactct

SEQ ID NO: 46743 - DNA, 20 bp, Artificial Sequence
  Description of Artificial Sequence: Synthetic oligonucleotide
  Target: ATXN1; (-) strand; PAM type: NRG; PAM sequence: TGG
tcagcttccctcccgggtac

SEQ ID NO: 46744 - DNA, 20 bp, Artificial Sequence
  Description of Artificial Sequence: Synthetic oligonucleotide
  Target: ATXN1; (-) strand; PAM type: NRG; PAM sequence: GGG
ccagtgtcagcttccctccc

SEQ ID NO: 46745 - DNA, 20 bp, Artificial Sequence
  Description of Artificial Sequence: Synthetic oligonucleotide
  Target: ATXN1; (-) strand; PAM type: NRG; PAM sequence: CGG
cccagtgtcagcttccctcc

SEQ ID NO: 46746 - DNA, 20 bp, Artificial Sequence
  Description of Artificial Sequence: Synthetic oligonucleotide
  Target: ATXN1; (-) strand; PAM type: NRG; PAM sequence: CAG
ttggatatttctcccagtgt

SEQ ID NO: 46747 - DNA, 20 bp, Artificial Sequence
  Description of Artificial Sequence: Synthetic oligonucleotide
  Target: ATXN1; (-) strand; PAM type: NRG; PAM sequence: CAG
cctttcttggatatttctcc

SEQ ID NO: 46748 - DNA, 20 bp, Artificial Sequence
  Description of Artificial Sequence: Synthetic oligonucleotide
  Target: ATXN1; (-) strand; PAM type: NRG; PAM sequence: TGG
tgccttttgattgcctttct

SEQ ID NO: 46749 - DNA, 20 bp, Artificial Sequence
  Description of Artificial Sequence: Synthetic oligonucleotide
  Target: ATXN1; (-) strand; PAM type: NRG; PAM sequence: AGG
tctctaaccaaaattatggt

SEQ ID NO: 46750 - DNA, 20 bp, Artificial Sequence
  Description of Artificial Sequence: Synthetic oligonucleotide
  Target: ATXN1; (-) strand; PAM type: NRG; PAM sequence: TAG
ctctctaaccaaaattatgg

SEQ ID NO: 46751 - DNA, 20 bp, Artificial Sequence
  Description of Artificial Sequence: Synthetic oligonucleotide
  Target: ATXN1; (-) strand; PAM type: NRG; PAM sequence: TGG
cctctctctaaccaaaatta

SEQ ID NO: 46752 - DNA, 20 bp, Artificial Sequence
  Description of Artificial Sequence: Synthetic oligonucleotide
  Target: ATXN1; (-) strand; PAM type: NRG; PAM sequence: TGG
atctatcattttttttatta

SEQ ID NO: 46753 - DNA, 20 bp, Artificial Sequence
  Description of Artificial Sequence: Synthetic oligonucleotide
  Target: ATXN1; (-) strand; PAM type: NRG; PAM sequence: AAG
cattcccaccagcaatgtaa

SEQ ID NO: 46754 - DNA, 20 bp, Artificial Sequence
  Description of Artificial Sequence: Synthetic oligonucleotide
  Target: ATXN1; (-) strand; PAM type: NRG; PAM sequence: CAG
gtattagtctacattcccac

SEQ ID NO: 46755 - DNA, 20 bp, Artificial Sequence
  Description of Artificial Sequence: Synthetic oligonucleotide
  Target: ATXN1; (-) strand; PAM type: NRG; PAM sequence: TAG
gttttccatagtggttgtat

SEQ ID NO: 46756 - DNA, 20 bp, Artificial Sequence
  Description of Artificial Sequence: Synthetic oligonucleotide
  Target: ATXN1; (-) strand; PAM type: NRG; PAM sequence: TGG
ctccacactgttttccatag

SEQ ID NO: 46757 - DNA, 20 bp, Artificial Sequence
  Description of Artificial Sequence: Synthetic oligonucleotide
  Target: ATXN1; (-) strand; PAM type: NRG; PAM sequence: TAG
aatctccacactgttttcca

SEQ ID NO: 46758 - DNA, 20 bp, Artificial Sequence
  Description of Artificial Sequence: Synthetic oligonucleotide
  Target: ATXN1; (-) strand; PAM type: NRG; PAM sequence: AGG
gttctactttaagttcttta

SEQ ID NO: 46759 - DNA, 20 bp, Artificial Sequence
  Description of Artificial Sequence: Synthetic oligonucleotide
  Target: ATXN1; (-) strand; PAM type: NRG; PAM sequence: AAG
agttctactttaagttcttt

SEQ ID NO: 46760 - DNA, 20 bp, Artificial Sequence
  Description of Artificial Sequence: Synthetic oligonucleotide
  Target: ATXN1; (-) strand; PAM type: NRG; PAM sequence: AAG
tcaaatggtagttctacttt

SEQ ID NO: 46761 - DNA, 20 bp, Artificial Sequence
  Description of Artificial Sequence: Synthetic oligonucleotide
  Target: ATXN1; (-) strand; PAM type: NRG; PAM sequence: TAG
gggattgttggatcaaatgg

SEQ ID NO: 46762 - DNA, 20 bp, Artificial Sequence
  Description of Artificial Sequence: Synthetic oligonucleotide
  Target: ATXN1; (-) strand; PAM type: NRG; PAM sequence: TGG
agtgggattgttggatcaaa

SEQ ID NO: 46763 - DNA, 20 bp, Artificial Sequence
  Description of Artificial Sequence: Synthetic oligonucleotide
  Target: ATXN1; (-) strand; PAM type: NRG; PAM sequence: TGG
atacccagtagtgggattgt

SEQ ID NO: 46764 - DNA, 20 bp, Artificial Sequence
  Description of Artificial Sequence: Synthetic oligonucleotide
  Target: ATXN1; (-) strand; PAM type: NRG; PAM sequence: GGG
ctgggtagatacccagtagt

SEQ ID NO: 46765 - DNA, 20 bp, Artificial Sequence
  Description of Artificial Sequence: Synthetic oligonucleotide
  Target: ATXN1; (-) strand; PAM type: NRG; PAM sequence: TGG
tctgggtagatacccagtag

SEQ ID NO: 46766 - DNA, 20 bp, Artificial Sequence
  Description of Artificial Sequence: Synthetic oligonucleotide
  Target: ATXN1; (-) strand; PAM type: NRG; PAM sequence: TAG
tcctctgggtagatacccag

SEQ ID NO: 46767 - DNA, 20 bp, Artificial Sequence
  Description of Artificial Sequence: Synthetic oligonucleotide
  Target: ATXN1; (-) strand; PAM type: NRG; PAM sequence: CAG
gtctcctctgggtagatacc

SEQ ID NO: 46768 - DNA, 20 bp, Artificial Sequence
  Description of Artificial Sequence: Synthetic oligonucleotide
  Target: ATXN1; (-) strand; PAM type: NRG; PAM sequence: TAG
cataagacgtctcctctggg

SEQ ID NO: 46769 - DNA, 20 bp, Artificial Sequence
  Description of Artificial Sequence: Synthetic oligonucleotide
  Target: ATXN1; (-) strand; PAM type: NRG; PAM sequence: GGG
tttcataagacgtctcctct

SEQ ID NO: 46770 - DNA, 20 bp, Artificial Sequence
  Description of Artificial Sequence: Synthetic oligonucleotide
  Target: ATXN1; (-) strand; PAM type: NRG; PAM sequence: TGG
ttttcataagacgtctcctc

SEQ ID NO: 46771 - DNA, 20 bp, Artificial Sequence
  Description of Artificial Sequence: Synthetic oligonucleotide
  Target: ATXN1; (-) strand; PAM type: NRG; PAM sequence: AAG
tgtgcaagtatctttttcat

SEQ ID NO: 46772 - DNA, 20 bp, Artificial Sequence
  Description of Artificial Sequence: Synthetic oligonucleotide
  Target: ATXN1; (-) strand; PAM type: NRG; PAM sequence: AAG
tgctgtaaacatgcatgtgc

SEQ ID NO: 46773 - DNA, 20 bp, Artificial Sequence
  Description of Artificial Sequence: Synthetic oligonucleotide
  Target: ATXN1; (-) strand; PAM type: NRG; PAM sequence: TGG
tgattgatgggcatttgggc

SEQ ID NO: 46774 - DNA, 20 bp, Artificial Sequence
  Description of Artificial Sequence: Synthetic oligonucleotide
  Target: ATXN1; (-) strand; PAM type: NRG; PAM sequence: GGG
tcattgattgatgggcattt

SEQ ID NO: 46775 - DNA, 20 bp, Artificial Sequence
  Description of Artificial Sequence: Synthetic oligonucleotide
  Target: ATXN1; (-) strand; PAM type: NRG; PAM sequence: TGG
ctcattgattgatgggcatt

SEQ ID NO: 46776 - DNA, 20 bp, Artificial Sequence
  Description of Artificial Sequence: Synthetic oligonucleotide
  Target: ATXN1; (-) strand; PAM type: NRG; PAM sequence: GGG
ttatccactcattgattgat

SEQ ID NO: 46777 - DNA, 20 bp, Artificial Sequence
  Description of Artificial Sequence: Synthetic oligonucleotide
  Target: ATXN1; (-) strand; PAM type: NRG; PAM sequence: TGG
tttatccactcattgattga

SEQ ID NO: 46778 - DNA, 20 bp, Artificial Sequence
  Description of Artificial Sequence: Synthetic oligonucleotide
  Target: ATXN1; (-) strand; PAM type: NRG; PAM sequence: TAG
tgttcctttttatggctgag

SEQ ID NO: 46779 - DNA, 20 bp, Artificial Sequence
  Description of Artificial Sequence: Synthetic oligonucleotide
  Target: ATXN1; (-) strand; PAM type: NRG; PAM sequence: GAG
ttttgttcctttttatggct

SEQ ID NO: 46780 - DNA, 20 bp, Artificial Sequence
  Description of Artificial Sequence: Synthetic oligonucleotide
  Target: ATXN1; (-) strand; PAM type: NRG; PAM sequence: TGG
tattattttgttccttttta

SEQ ID NO: 46781 - DNA, 20 bp, Artificial Sequence
  Description of Artificial Sequence: Synthetic oligonucleotide
  Target: ATXN1; (-) strand; PAM type: NRG; PAM sequence: AGG
aatggtatccagttccaaac

SEQ ID NO: 46782 - DNA, 20 bp, Artificial Sequence
  Description of Artificial Sequence: Synthetic oligonucleotide
  Target: ATXN1; (-) strand; PAM type: NRG; PAM sequence: CAG
taatggtatccagttccaaa

SEQ ID NO: 46783 - DNA, 20 bp, Artificial Sequence
  Description of Artificial Sequence: Synthetic oligonucleotide
  Target: ATXN1; (-) strand; PAM type: NRG; PAM sequence: CAG
tcacttagaataatggtatc

SEQ ID NO: 46784 - DNA, 20 bp, Artificial Sequence
  Description of Artificial Sequence: Synthetic oligonucleotide
  Target: ATXN1; (-) strand; PAM type: NRG; PAM sequence: TGG
agttacttcacttagaataa

SEQ ID NO: 46785 - DNA, 20 bp, Artificial Sequence
  Description of Artificial Sequence: Synthetic oligonucleotide
  Target: ATXN1; (-) strand; PAM type: NRG; PAM sequence: TAG
cattcctgagttacttcact

SEQ ID NO: 46786 - DNA, 20 bp, Artificial Sequence
  Description of Artificial Sequence: Synthetic oligonucleotide
  Target: ATXN1; (-) strand; PAM type: NRG; PAM sequence: GAG
gtgttcagttttccattcct

SEQ ID NO: 46787 - DNA, 20 bp, Artificial Sequence
  Description of Artificial Sequence: Synthetic oligonucleotide
  Target: ATXN1; (-) strand; PAM type: NRG; PAM sequence: CAG
actgccatcattacggtgtt

SEQ ID NO: 46788 - DNA, 20 bp, Artificial Sequence
  Description of Artificial Sequence: Synthetic oligonucleotide
  Target: ATXN1; (-) strand; PAM type: NRG; PAM sequence: CGG
agcagccactgccatcatta

SEQ ID NO: 46789 - DNA, 20 bp, Artificial Sequence
  Description of Artificial Sequence: Synthetic oligonucleotide
  Target: ATXN1; (-) strand; PAM type: NRG; PAM sequence: CAG
cgcagccagcttgatggcag

SEQ ID NO: 46790 - DNA, 20 bp, Artificial Sequence
  Description of Artificial Sequence: Synthetic oligonucleotide
  Target: ATXN1; (-) strand; PAM type: NRG; PAM sequence: CAG
ccgcgcagccagcttgatgg

SEQ ID NO: 46791 - DNA, 20 bp, Artificial Sequence
  Description of Artificial Sequence: Synthetic oligonucleotide
  Target: ATXN1; (-) strand; PAM type: NRG; PAM sequence: TGG
cagccgcgcagccagcttga

SEQ ID NO: 46792 - DNA, 20 bp, Artificial Sequence
  Description of Artificial Sequence: Synthetic oligonucleotide
  Target: ATXN1; (-) strand; PAM type: NRG; PAM sequence: CAG
tgcagcaccagccgcgcagc

SEQ ID NO: 46793 - DNA, 20 bp, Artificial Sequence
  Description of Artificial Sequence: Synthetic oligonucleotide
  Target: ATXN1; (-) strand; PAM type: NRG; PAM sequence: CAG
agtatgcagcaccagccgcg

SEQ ID NO: 46794 - DNA, 20 bp, Artificial Sequence
  Description of Artificial Sequence: Synthetic oligonucleotide
  Target: ATXN1; (-) strand; PAM type: NRG; PAM sequence: CAG
ctccatggagtatgcagcac

SEQ ID NO: 46795 - DNA, 20 bp, Artificial Sequence
  Description of Artificial Sequence: Synthetic oligonucleotide
  Target: ATXN1; (-) strand; PAM type: NRG; PAM sequence: CAG
caccagctccatggagtatg

SEQ ID NO: 46796 - DNA, 20 bp, Artificial Sequence
  Description of Artificial Sequence: Synthetic oligonucleotide
  Target: ATXN1; (-) strand; PAM type: NRG; PAM sequence: GAG
gggctgccaccagctccatg

SEQ ID NO: 46797 - DNA, 20 bp, Artificial Sequence
  Description of Artificial Sequence: Synthetic oligonucleotide
  Target: ATXN1; (-) strand; PAM type: NRG; PAM sequence: TGG
cagggctgccaccagctcca

SEQ ID NO: 46798 - DNA, 20 bp, Artificial Sequence
  Description of Artificial Sequence: Synthetic oligonucleotide
  Target: ATXN1; (-) strand; PAM type: NRG; PAM sequence: CAG
ggaatgaacagggctgccac

SEQ ID NO: 46799 - DNA, 20 bp, Artificial Sequence
  Description of Artificial Sequence: Synthetic oligonucleotide
  Target: ATXN1; (-) strand; PAM type: NRG; PAM sequence: GGG
atcccaactcggaatgaaca

SEQ ID NO: 46800 - DNA, 20 bp, Artificial Sequence
  Description of Artificial Sequence: Synthetic oligonucleotide
  Target: ATXN1; (-) strand; PAM type: NRG; PAM sequence: AGG
catcccaactcggaatgaac

SEQ ID NO: 46801 - DNA, 20 bp, Artificial Sequence
  Description of Artificial Sequence: Synthetic oligonucleotide
  Target: ATXN1; (-) strand; PAM type: NRG; PAM sequence: CAG
ccatcccaactcggaatgaa

SEQ ID NO: 46802 - DNA, 20 bp, Artificial Sequence
  Description of Artificial Sequence: Synthetic oligonucleotide
  Target: ATXN1; (-) strand; PAM type: NRG; PAM sequence: CGG
gcggagctcccatcccaact

SEQ ID NO: 46803 - DNA, 20 bp, Artificial Sequence
  Description of Artificial Sequence: Synthetic oligonucleotide
  Target: ATXN1; (-) strand; PAM type: NRG; PAM sequence: GAG
ggtggctgcagtggcacgcg

SEQ ID NO: 46804 - DNA, 20 bp, Artificial Sequence
  Description of Artificial Sequence: Synthetic oligonucleotide
  Target: ATXN1; (-) strand; PAM type: NRG; PAM sequence: CGG
caggtggctgcagtggcacg

SEQ ID NO: 46805 - DNA, 20 bp, Artificial Sequence
  Description of Artificial Sequence: Synthetic oligonucleotide
  Target: ATXN1; (-) strand; PAM type: NRG; PAM sequence: TGG
tgcagttcaggtggctgcag

SEQ ID NO: 46806 - DNA, 20 bp, Artificial Sequence
  Description of Artificial Sequence: Synthetic oligonucleotide
  Target: ATXN1; (-) strand; PAM type: NRG; PAM sequence: CAG
agctgcagttcaggtggctg

SEQ ID NO: 46807 - DNA, 20 bp, Artificial Sequence
  Description of Artificial Sequence: Synthetic oligonucleotide
  Target: ATXN1; (-) strand; PAM type: NRG; PAM sequence: TGG
gtctgcagctgcagttcagg

SEQ ID NO: 46808 - DNA, 20 bp, Artificial Sequence
  Description of Artificial Sequence: Synthetic oligonucleotide
  Target: ATXN1; (-) strand; PAM type: NRG; PAM sequence: AGG
tgggtctgcagctgcagttc

SEQ ID NO: 46809 - DNA, 20 bp, Artificial Sequence
  Description of Artificial Sequence: Synthetic oligonucleotide
  Target: ATXN1; (-) strand; PAM type: NRG; PAM sequence: CAG
ctgggtctgcagctgcagtt

SEQ ID NO: 46810 - DNA, 20 bp, Artificial Sequence
  Description of Artificial Sequence: Synthetic oligonucleotide
  Target: ATXN1; (-) strand; PAM type: NRG; PAM sequence: CAG
gaggcctgggtctgcagctg

SEQ ID NO: 46811 - DNA, 20 bp, Artificial Sequence
  Description of Artificial Sequence: Synthetic oligonucleotide
  Target: ATXN1; (-) strand; PAM type: NRG; PAM sequence: CAG
gagcaggaggcctgggtctg

SEQ ID NO: 46812 - DNA, 20 bp, Artificial Sequence
  Description of Artificial Sequence: Synthetic oligonucleotide
  Target: ATXN1; (-) strand; PAM type: NRG; PAM sequence: GGG
ctctgtggagcaggaggcct

SEQ ID NO: 46813 - DNA, 20 bp, Artificial Sequence
  Description of Artificial Sequence: Synthetic oligonucleotide
  Target: ATXN1; (-) strand; PAM type: NRG; PAM sequence: TGG
gctctgtggagcaggaggcc

SEQ ID NO: 46814 - DNA, 20 bp, Artificial Sequence
  Description of Artificial Sequence: Synthetic oligonucleotide
  Target: ATXN1; (-) strand; PAM type: NRG; PAM sequence: AGG
tgcttgctctgtggagcagg

SEQ ID NO: 46815 - DNA, 20 bp, Artificial Sequence
  Description of Artificial Sequence: Synthetic oligonucleotide
  Target: ATXN1; (-) strand; PAM type: NRG; PAM sequence: GAG
ctgcttgctctgtggagcag

SEQ ID NO: 46816 - DNA, 20 bp, Artificial Sequence
  Description of Artificial Sequence: Synthetic oligonucleotide
  Target: ATXN1; (-) strand; PAM type: NRG; PAM sequence: AGG
tcctgcttgctctgtggagc

SEQ ID NO: 46817 - DNA, 20 bp, Artificial Sequence
  Description of Artificial Sequence: Synthetic oligonucleotide
  Target: ATXN1; (-) strand; PAM type: NRG; PAM sequence: CAG
ctcctgcttgctctgtggag

SEQ ID NO: 46818 - DNA, 20 bp, Artificial Sequence
  Description of Artificial Sequence: Synthetic oligonucleotide
  Target: ATXN1; (-) strand; PAM type: NRG; PAM sequence: GAG
gggctcctgcttgctctgtg

SEQ ID NO: 46819 - DNA, 20 bp, Artificial Sequence
  Description of Artificial Sequence: Synthetic oligonucleotide
  Target: ATXN1; (-) strand; PAM type: NRG; PAM sequence: TGG
cggggctcctgcttgctctg

SEQ ID NO: 46820 - DNA, 20 bp, Artificial Sequence
  Description of Artificial Sequence: Synthetic oligonucleotide
  Target: ATXN1; (-) strand; PAM type: NRG; PAM sequence: GGG
gctgtggccccaagagggcg

SEQ ID NO: 46821 - DNA, 20 bp, Artificial Sequence
  Description of Artificial Sequence: Synthetic oligonucleotide
  Target: ATXN1; (-) strand; PAM type: NRG; PAM sequence: GGG
ggctgtggccccaagagggc

SEQ ID NO: 46822 - DNA, 20 bp, Artificial Sequence
  Description of Artificial Sequence: Synthetic oligonucleotide
  Target: ATXN1; (-) strand; PAM type: NRG; PAM sequence: CGG
tggctgtggccccaagaggg

SEQ ID NO: 46823 - DNA, 20 bp, Artificial Sequence
  Description of Artificial Sequence: Synthetic oligonucleotide
  Target: ATXN1; (-) strand; PAM type: NRG; PAM sequence: GGG
gggtggctgtggccccaaga

SEQ ID NO: 46824 - DNA, 20 bp, Artificial Sequence
  Description of Artificial Sequence: Synthetic oligonucleotide
  Target: ATXN1; (-) strand; PAM type: NRG; PAM sequence: AGG
tgggtggctgtggccccaag

SEQ ID NO: 46825 - DNA, 20 bp, Artificial Sequence
  Description of Artificial Sequence: Synthetic oligonucleotide
  Target: ATXN1; (-) strand; PAM type: NRG; PAM sequence: GAG
ttgggtggctgtggccccaa

SEQ ID NO: 46826 - DNA, 20 bp, Artificial Sequence
  Description of Artificial Sequence: Synthetic oligonucleotide
  Target: ATXN1; (-) strand; PAM type: NRG; PAM sequence: AAG
gtttgggtggctgtggcccc

SEQ ID NO: 46827 - DNA, 20 bp, Artificial Sequence
  Description of Artificial Sequence: Synthetic oligonucleotide
  Target: ATXN1; (-) strand; PAM type: NRG; PAM sequence: TGG
agctgcagtttgggtggctg

SEQ ID NO: 46828 - DNA, 20 bp, Artificial Sequence
  Description of Artificial Sequence: Synthetic oligonucleotide
  Target: ATXN1; (-) strand; PAM type: NRG; PAM sequence: TGG
atctacagctgcagtttggg

SEQ ID NO: 46829 - DNA, 20 bp, Artificial Sequence
  Description of Artificial Sequence: Synthetic oligonucleotide
  Target: ATXN1; (-) strand; PAM type: NRG; PAM sequence: GGG
cggatctacagctgcagttt

SEQ ID NO: 46830 - DNA, 20 bp, Artificial Sequence
  Description of Artificial Sequence: Synthetic oligonucleotide
  Target: ATXN1; (-) strand; PAM type: NRG; PAM sequence: TGG
tcggatctacagctgcagtt

SEQ ID NO: 46831 - DNA, 20 bp, Artificial Sequence
  Description of Artificial Sequence: Synthetic oligonucleotide
  Target: ATXN1; (-) strand; PAM type: NRG; PAM sequence: CAG
gagactcggatctacagctg

SEQ ID NO: 46832 - DNA, 20 bp, Artificial Sequence
  Description of Artificial Sequence: Synthetic oligonucleotide
  Target: ATXN1; (-) strand; PAM type: NRG; PAM sequence: CAG
cacagggagactcggatcta

SEQ ID NO: 46833 - DNA, 20 bp, Artificial Sequence
  Description of Artificial Sequence: Synthetic oligonucleotide
  Target: ATXN1; (-) strand; PAM type: NRG; PAM sequence: CGG
cccaagagcacagggagact

SEQ ID NO: 46834 - DNA, 20 bp, Artificial Sequence
  Description of Artificial Sequence: Synthetic oligonucleotide
  Target: ATXN1; (-) strand; PAM type: NRG; PAM sequence: GAG
ggctcccccaagagcacagg

SEQ ID NO: 46835 - DNA, 20 bp, Artificial Sequence
  Description of Artificial Sequence: Synthetic oligonucleotide
  Target: ATXN1; (-) strand; PAM type: NRG; PAM sequence: GGG
caggctcccccaagagcaca

SEQ ID NO: 46836 - DNA, 20 bp, Artificial Sequence
  Description of Artificial Sequence: Synthetic oligonucleotide
  Target: ATXN1; (-) strand; PAM type: NRG; PAM sequence: AGG
ccaggctcccccaagagcac

SEQ ID NO: 46837 - DNA, 20 bp, Artificial Sequence
  Description of Artificial Sequence: Synthetic oligonucleotide
  Target: ATXN1; (-) strand; PAM type: NRG; PAM sequence: CAG
tccaggctcccccaagagca

SEQ ID NO: 46838 - DNA, 20 bp, Artificial Sequence
  Description of Artificial Sequence: Synthetic oligonucleotide
  Target: ATXN1; (-) strand; PAM type: NRG; PAM sequence: GAG
cctgttccaggctcccccaa

SEQ ID NO: 46839 - DNA, 20 bp, Artificial Sequence
  Description of Artificial Sequence: Synthetic oligonucleotide
  Target: ATXN1; (-) strand; PAM type: NRG; PAM sequence: AAG
tgcctgttccaggctccccc

SEQ ID NO: 46840 - DNA, 20 bp, Artificial Sequence
  Description of Artificial Sequence: Synthetic oligonucleotide
  Target: ATXN1; (-) strand; PAM type: NRG; PAM sequence: AGG
aggcagatcctgcctgttcc

SEQ ID NO: 46841 - DNA, 20 bp, Artificial Sequence
  Description of Artificial Sequence: Synthetic oligonucleotide
  Target: ATXN1; (-) strand; PAM type: NRG; PAM sequence: CAG
aaggcagatcctgcctgttc

SEQ ID NO: 46842 - DNA, 20 bp, Artificial Sequence
  Description of Artificial Sequence: Synthetic oligonucleotide
  Target: ATXN1; (-) strand; PAM type: NRG; PAM sequence: CAG
tgcagctgcacctgggaagg

SEQ ID NO: 46843 - DNA, 20 bp, Artificial Sequence
  Description of Artificial Sequence: Synthetic oligonucleotide
  Target: ATXN1; (-) strand; PAM type: NRG; PAM sequence: AGG
agctgcagctgcacctggga

SEQ ID NO: 46844 - DNA, 20 bp, Artificial Sequence
  Description of Artificial Sequence: Synthetic oligonucleotide
  Target: ATXN1; (-) strand; PAM type: NRG; PAM sequence: AAG
cagctgcagctgcacctggg

SEQ ID NO: 46845 - DNA, 20 bp, Artificial Sequence
  Description of Artificial Sequence: Synthetic oligonucleotide
  Target: ATXN1; (-) strand; PAM type: NRG; PAM sequence: GGG
cggcagctgcagctgcacct

SEQ ID NO: 46846 - DNA, 20 bp, Artificial Sequence
  Description of Artificial Sequence: Synthetic oligonucleotide
  Target: ATXN1; (-) strand; PAM type: NRG; PAM sequence: TGG
gcggcagctgcagctgcacc

SEQ ID NO: 46847 - DNA, 20 bp, Artificial Sequence
  Description of Artificial Sequence: Synthetic oligonucleotide
  Target: ATXN1; (-) strand; PAM type: NRG; PAM sequence: CAG
agccgtgggtgcggcagctg

SEQ ID NO: 46848 - DNA, 20 bp, Artificial Sequence
  Description of Artificial Sequence: Synthetic oligonucleotide
  Target: ATXN1; (-) strand; PAM type: NRG; PAM sequence: CAG
gtctgcagccgtgggtgcgg

SEQ ID NO: 46849 - DNA, 20 bp, Artificial Sequence
  Description of Artificial Sequence: Synthetic oligonucleotide
  Target: ATXN1; (-) strand; PAM type: NRG; PAM sequence: CGG
caggtctgcagccgtgggtg

SEQ ID NO: 46850 - DNA, 20 bp, Artificial Sequence
  Description of Artificial Sequence: Synthetic oligonucleotide
  Target: ATXN1; (-) strand; PAM type: NRG; PAM sequence: GGG
aggcccaggtctgcagccgt

SEQ ID NO: 46851 - DNA, 20 bp, Artificial Sequence
  Description of Artificial Sequence: Synthetic oligonucleotide
  Target: ATXN1; (-) strand; PAM type: NRG; PAM sequence: TGG
gaggcccaggtctgcagccg

SEQ ID NO: 46852 - DNA, 20 bp, Artificial Sequence
  Description of Artificial Sequence: Synthetic oligonucleotide
  Target: ATXN1; (-) strand; PAM type: NRG; PAM sequence: CAG
gaatgggaggcccaggtctg

SEQ ID NO: 46853 - DNA, 20 bp, Artificial Sequence
  Description of Artificial Sequence: Synthetic oligonucleotide
  Target: ATXN1; (-) strand; PAM type: NRG; PAM sequence: AGG
cttcctggaatgggaggccc

SEQ ID NO: 46854 - DNA, 20 bp, Artificial Sequence
  Description of Artificial Sequence: Synthetic oligonucleotide
  Target: ATXN1; (-) strand; PAM type: NRG; PAM sequence: CAG
gcttcctggaatgggaggcc

SEQ ID NO: 46855 - DNA, 20 bp, Artificial Sequence
  Description of Artificial Sequence: Synthetic oligonucleotide
  Target: ATXN1; (-) strand; PAM type: NRG; PAM sequence: AGG
tgcctgcttcctggaatggg

SEQ ID NO: 46856 - DNA, 20 bp, Artificial Sequence
  Description of Artificial Sequence: Synthetic oligonucleotide
  Target: ATXN1; (-) strand; PAM type: NRG; PAM sequence: GAG
ctgcctgcttcctggaatgg

SEQ ID NO: 46857 - DNA, 20 bp, Artificial Sequence
  Description of Artificial Sequence: Synthetic oligonucleotide
  Target: ATXN1; (-) strand; PAM type: NRG; PAM sequence: GGG
tcctgcctgcttcctggaat

SEQ ID NO: 46858 - DNA, 20 bp, Artificial Sequence
  Description of Artificial Sequence: Synthetic oligonucleotide
  Target: ATXN1; (-) strand; PAM type: NRG; PAM sequence: TGG
ctcctgcctgcttcctggaa

SEQ ID NO: 46859 - DNA, 20 bp, Artificial Sequence
  Description of Artificial Sequence: Synthetic oligonucleotide
  Target: ATXN1; (-) strand; PAM type: NRG; PAM sequence: TGG
cctggctcctgcctgcttcc

SEQ ID NO: 46860 - DNA, 20 bp, Artificial Sequence
  Description of Artificial Sequence: Synthetic oligonucleotide
  Target: ATXN1; (-) strand; PAM type: NRG; PAM sequence: TGG
gcagggctcccgcttgttcc

SEQ ID NO: 46861 - DNA, 20 bp, Artificial Sequence
  Description of Artificial Sequence: Synthetic oligonucleotide
  Target: ATXN1; (-) strand; PAM type: NRG; PAM sequence: GGG
ctgacaactcggaaggggca

SEQ ID NO: 46862 - DNA, 20 bp, Artificial Sequence
  Description of Artificial Sequence: Synthetic oligonucleotide
  Target: ATXN1; (-) strand; PAM type: NRG; PAM sequence: AGG
cctgacaactcggaaggggc

SEQ ID NO: 46863 - DNA, 20 bp, Artificial Sequence
  Description of Artificial Sequence: Synthetic oligonucleotide
  Target: ATXN1; (-) strand; PAM type: NRG; PAM sequence: CAG
ccctgacaactcggaagggg

SEQ ID NO: 46864 - DNA, 20 bp, Artificial Sequence
  Description of Artificial Sequence: Synthetic oligonucleotide
  Target: ATXN1; (-) strand; PAM type: NRG; PAM sequence: GGG
ccgccctgacaactcggaag

SEQ ID NO: 46865 - DNA, 20 bp, Artificial Sequence
  Description of Artificial Sequence: Synthetic oligonucleotide
  Target: ATXN1; (-) strand; PAM type: NRG; PAM sequence: GGG
cccgccctgacaactcggaa

SEQ ID NO: 46866 - DNA, 20 bp, Artificial Sequence
  Description of Artificial Sequence: Synthetic oligonucleotide
  Target: ATXN1; (-) strand; PAM type: NRG; PAM sequence: AGG
tcccgccctgacaactcgga

SEQ ID NO: 46867 - DNA, 20 bp, Artificial Sequence
  Description of Artificial Sequence: Synthetic oligonucleotide
  Target: ATXN1; (-) strand; PAM type: NRG; PAM sequence: AAG
ctcccgccctgacaactcgg

SEQ ID NO: 46868 - DNA, 20 bp, Artificial Sequence
  Description of Artificial Sequence: Synthetic oligonucleotide
  Target: ATXN1; (-) strand; PAM type: NRG; PAM sequence: CGG
gagctcccgccctgacaact

SEQ ID NO: 46869 - DNA, 20 bp, Artificial Sequence
  Description of Artificial Sequence: Synthetic oligonucleotide
  Target: ATXN1; (-) strand; PAM type: NRG; PAM sequence: GAG
ttggccacagctgcacccgg

SEQ ID NO: 46870 - DNA, 20 bp, Artificial Sequence
  Description of Artificial Sequence: Synthetic oligonucleotide
  Target: ATXN1; (-) strand; PAM type: NRG; PAM sequence: GGG
ggttggccacagctgcaccc

SEQ ID NO: 46871 - DNA, 20 bp, Artificial Sequence
  Description of Artificial Sequence: Synthetic oligonucleotide
  Target: ATXN1; (-) strand; PAM type: NRG; PAM sequence: CGG
gggttggccacagctgcacc

SEQ ID NO: 46872 - DNA, 20 bp, Artificial Sequence
  Description of Artificial Sequence: Synthetic oligonucleotide
  Target: ATXN1; (-) strand; PAM type: NRG; PAM sequence: CAG
gtgcctgggagggttggcca

SEQ ID NO: 46873 - DNA, 20 bp, Artificial Sequence
  Description of Artificial Sequence: Synthetic oligonucleotide
  Target: ATXN1; (-) strand; PAM type: NRG; PAM sequence: TGG
ggtcctgtgcctgggagggt

SEQ ID NO: 46874 - DNA, 20 bp, Artificial Sequence
  Description of Artificial Sequence: Synthetic oligonucleotide
  Target: ATXN1; (-) strand; PAM type: NRG; PAM sequence: GGG
cccaggtcctgtgcctggga

SEQ ID NO: 46875 - DNA, 20 bp, Artificial Sequence
  Description of Artificial Sequence: Synthetic oligonucleotide
  Target: ATXN1; (-) strand; PAM type: NRG; PAM sequence: AGG
gcccaggtcctgtgcctggg

SEQ ID NO: 46876 - DNA, 20 bp, Artificial Sequence
  Description of Artificial Sequence: Synthetic oligonucleotide
  Target: ATXN1; (-) strand; PAM type: NRG; PAM sequence: GAG
cgcccaggtcctgtgcctgg

SEQ ID NO: 46877 - DNA, 20 bp, Artificial Sequence
  Description of Artificial Sequence: Synthetic oligonucleotide
  Target: ATXN1; (-) strand; PAM type: NRG; PAM sequence: GGG
gacgcccaggtcctgtgcct

SEQ ID NO: 46878 - DNA, 20 bp, Artificial Sequence
  Description of Artificial Sequence: Synthetic oligonucleotide
  Target: ATXN1; (-) strand; PAM type: NRG; PAM sequence: TGG
agacgcccaggtcctgtgcc

SEQ ID NO: 46879 - DNA, 20 bp, Artificial Sequence
  Description of Artificial Sequence: Synthetic oligonucleotide
  Target: ATXN1; (-) strand; PAM type: NRG; PAM sequence: AGG
tgcaggctgcagagacgccc

SEQ ID NO: 46880 - DNA, 20 bp, Artificial Sequence
  Description of Artificial Sequence: Synthetic oligonucleotide
  Target: ATXN1; (-) strand; PAM type: NRG; PAM sequence: CAG
gtgcaggctgcagagacgcc

SEQ ID NO: 46881 - DNA, 20 bp, Artificial Sequence
  Description of Artificial Sequence: Synthetic oligonucleotide
  Target: ATXN1; (-) strand; PAM type: NRG; PAM sequence: GAG
gcccaagggtgcaggctgca

SEQ ID NO: 46882 - DNA, 20 bp, Artificial Sequence
  Description of Artificial Sequence: Synthetic oligonucleotide
  Target: ATXN1; (-) strand; PAM type: NRG; PAM sequence: CAG
gcgcccaagggtgcaggctg

SEQ ID NO: 46883 - DNA, 20 bp, Artificial Sequence
  Description of Artificial Sequence: Synthetic oligonucleotide
  Target: ATXN1; (-) strand; PAM type: NRG; PAM sequence: AGG
cctggggcgcccaagggtgc

SEQ ID NO: 46884 - DNA, 20 bp, Artificial Sequence
  Description of Artificial Sequence: Synthetic oligonucleotide
  Target: ATXN1; (-) strand; PAM type: NRG; PAM sequence: CAG
tcctggggcgcccaagggtg

SEQ ID NO: 46885 - DNA, 20 bp, Artificial Sequence
  Description of Artificial Sequence: Synthetic oligonucleotide
  Target: ATXN1; (-) strand; PAM type: NRG; PAM sequence: GGG
gtccttcctggggcgcccaa

SEQ ID NO: 46886 - DNA, 20 bp, Artificial Sequence
  Description of Artificial Sequence: Synthetic oligonucleotide
  Target: ATXN1; (-) strand; PAM type: NRG; PAM sequence: AGG
ggtccttcctggggcgccca

SEQ ID NO: 46887 - DNA, 20 bp, Artificial Sequence
  Description of Artificial Sequence: Synthetic oligonucleotide
  Target: ATXN1; (-) strand; PAM type: NRG; PAM sequence: AAG
gggtccttcctggggcgccc

SEQ ID NO: 46888 - DNA, 20 bp, Artificial Sequence
  Description of Artificial Sequence: Synthetic oligonucleotide
  Target: ATXN1; (-) strand; PAM type: NRG; PAM sequence: GGG
gatggggagggtccttcctg

SEQ ID NO: 46889 - DNA, 20 bp, Artificial Sequence
  Description of Artificial Sequence: Synthetic oligonucleotide
  Target: ATXN1; (-) strand; PAM type: NRG; PAM sequence: GGG
agatggggagggtccttcct

SEQ ID NO: 46890 - DNA, 20 bp, Artificial Sequence
  Description of Artificial Sequence: Synthetic oligonucleotide
  Target: ATXN1; (-) strand; PAM type: NRG; PAM sequence: TGG
gagatggggagggtccttcc

SEQ ID NO: 46891 - DNA, 20 bp, Artificial Sequence
  Description of Artificial Sequence: Synthetic oligonucleotide
  Target: ATXN1; (-) strand; PAM type: NRG; PAM sequence: GGG
tgagcatgcagagatgggga

SEQ ID NO: 46892 - DNA, 20 bp, Artificial Sequence
  Description of Artificial Sequence: Synthetic oligonucleotide
  Target: ATXN1; (-) strand; PAM type: NRG; PAM sequence: AGG
ctgagcatgcagagatgggg

SEQ ID NO: 46893 - DNA, 20 bp, Artificial Sequence
  Description of Artificial Sequence: Synthetic oligonucleotide
  Target: ATXN1; (-) strand; PAM type: NRG; PAM sequence: GAG
tctgagcatgcagagatggg

SEQ ID NO: 46894 - DNA, 20 bp, Artificial Sequence
  Description of Artificial Sequence: Synthetic oligonucleotide
  Target: ATXN1; (-) strand; PAM type: NRG; PAM sequence: GGG
catctgagcatgcagagatg

SEQ ID NO: 46895 - DNA, 20 bp, Artificial Sequence
  Description of Artificial Sequence: Synthetic oligonucleotide
  Target: ATXN1; (-) strand; PAM type: NRG; PAM sequence: GGG
acatctgagcatgcagagat

SEQ ID NO: 46896 - DNA, 20 bp, Artificial Sequence
  Description of Artificial Sequence: Synthetic oligonucleotide
  Target: ATXN1; (-) strand; PAM type: NRG; PAM sequence: TGG
cacatctgagcatgcagaga

SEQ ID NO: 46897 - DNA, 20 bp, Artificial Sequence
  Description of Artificial Sequence: Synthetic oligonucleotide
  Target: ATXN1; (-) strand; PAM type: NRG; PAM sequence: GAG
cagacacatctgagcatgca

SEQ ID NO: 46898 - DNA, 20 bp, Artificial Sequence
  Description of Artificial Sequence: Synthetic oligonucleotide
  Target: ATXN1; (-) strand; PAM type: NRG; PAM sequence: CAG
cgcagacacatctgagcatg

SEQ ID NO: 46899 - DNA, 20 bp, Artificial Sequence
  Description of Artificial Sequence: Synthetic oligonucleotide
  Target: ATXN1; (-) strand; PAM type: NRG; PAM sequence: GAG
cagtgggcgcagacacatct

SEQ ID NO: 46900 - DNA, 20 bp, Artificial Sequence
  Description of Artificial Sequence: Synthetic oligonucleotide
  Target: ATXN1; (-) strand; PAM type: NRG; PAM sequence: CAG
gagaggccaggcagtgggcg

SEQ ID NO: 46901 - DNA, 20 bp, Artificial Sequence
  Description of Artificial Sequence: Synthetic oligonucleotide
  Target: ATXN1; (-) strand; PAM type: NRG; PAM sequence: GGG
acggagagaggccaggcagt

SEQ ID NO: 46902 - DNA, 20 bp, Artificial Sequence
  Description of Artificial Sequence: Synthetic oligonucleotide
  Target: ATXN1; (-) strand; PAM type: NRG; PAM sequence: TGG
aacggagagaggccaggcag

SEQ ID NO: 46903 - DNA, 20 bp, Artificial Sequence
  Description of Artificial Sequence: Synthetic oligonucleotide
  Target: ATXN1; (-) strand; PAM type: NRG; PAM sequence: CAG
tggaacggagagaggccagg

SEQ ID NO: 46904 - DNA, 20 bp, Artificial Sequence
  Description of Artificial Sequence: Synthetic oligonucleotide
  Target: ATXN1; (-) strand; PAM type: NRG; PAM sequence: AGG
gcctggaacggagagaggcc

SEQ ID NO: 46905 - DNA, 20 bp, Artificial Sequence
  Description of Artificial Sequence: Synthetic oligonucleotide
  Target: ATXN1; (-) strand; PAM type: NRG; PAM sequence: CAG
tgcctggaacggagagaggc

SEQ ID NO: 46906 - DNA, 20 bp, Artificial Sequence
  Description of Artificial Sequence: Synthetic oligonucleotide
  Target: ATXN1; (-) strand; PAM type: NRG; PAM sequence: AGG
tgggtgcctggaacggagag

SEQ ID NO: 46907 - DNA, 20 bp, Artificial Sequence
  Description of Artificial Sequence: Synthetic oligonucleotide
  Target: ATXN1; (-) strand; PAM type: NRG; PAM sequence: GAG
gtgggtgcctggaacggaga

SEQ ID NO: 46908 - DNA, 20 bp, Artificial Sequence
  Description of Artificial Sequence: Synthetic oligonucleotide
  Target: ATXN1; (-) strand; PAM type: NRG; PAM sequence: GAG
gagtgggtgcctggaacgga

SEQ ID NO: 46909 - DNA, 20 bp, Artificial Sequence
  Description of Artificial Sequence: Synthetic oligonucleotide
  Target: ATXN1; (-) strand; PAM type: NRG; PAM sequence: GAG
ctgagtgggtgcctggaacg

SEQ ID NO: 46910 - DNA, 20 bp, Artificial Sequence
  Description of Artificial Sequence: Synthetic oligonucleotide
  Target: ATXN1; (-) strand; PAM type: NRG; PAM sequence: CGG
atctgagtgggtgcctggaa

SEQ ID NO: 46911 - DNA, 20 bp, Artificial Sequence
  Description of Artificial Sequence: Synthetic oligonucleotide
  Target: ATXN1; (-) strand; PAM type: NRG; PAM sequence: TGG
ctgagatctgagtgggtgcc

SEQ ID NO: 46912 - DNA, 20 bp, Artificial Sequence
  Description of Artificial Sequence: Synthetic oligonucleotide
  Target: ATXN1; (-) strand; PAM type: NRG; PAM sequence: GGG
cccagctctgagatctgagt

SEQ ID NO: 46913 - DNA, 20 bp, Artificial Sequence
  Description of Artificial Sequence: Synthetic oligonucleotide
  Target: ATXN1; (-) strand; PAM type: NRG; PAM sequence: TGG
acccagctctgagatctgag

SEQ ID NO: 46914 - DNA, 20 bp, Artificial Sequence
  Description of Artificial Sequence: Synthetic oligonucleotide
  Target: ATXN1; (-) strand; PAM type: NRG; PAM sequence: GAG
ccaacccagctctgagatct

SEQ ID NO: 46915 - DNA, 20 bp, Artificial Sequence
  Description of Artificial Sequence: Synthetic oligonucleotide
  Target: ATXN1; (-) strand; PAM type: NRG; PAM sequence: GAG
cttggccccaacccagctct

SEQ ID NO: 46916 - DNA, 20 bp, Artificial Sequence
  Description of Artificial Sequence: Synthetic oligonucleotide
  Target: ATXN1; (-) strand; PAM type: NRG; PAM sequence: CAG
cccggggcttggccccaacc

SEQ ID NO: 46917 - DNA, 20 bp, Artificial Sequence
  Description of Artificial Sequence: Synthetic oligonucleotide
  Target: ATXN1; (-) strand; PAM type: NRG; PAM sequence: TGG
ccattcatggccccggggct

SEQ ID NO: 46918 - DNA, 20 bp, Artificial Sequence
  Description of Artificial Sequence: Synthetic oligonucleotide
  Target: ATXN1; (-) strand; PAM type: NRG; PAM sequence: GGG
tgctgccattcatggccccg

SEQ ID NO: 46919 - DNA, 20 bp, Artificial Sequence
  Description of Artificial Sequence: Synthetic oligonucleotide
  Target: ATXN1; (-) strand; PAM type: NRG; PAM sequence: GGG
ctgctgccattcatggcccc

SEQ ID NO: 46920 - DNA, 20 bp, Artificial Sequence
  Description of Artificial Sequence: Synthetic oligonucleotide
  Target: ATXN1; (-) strand; PAM type: NRG; PAM sequence: CGG
cctgctgccattcatggccc

SEQ ID NO: 46921 - DNA, 20 bp, Artificial Sequence
  Description of Artificial Sequence: Synthetic oligonucleotide
  Target: ATXN1; (-) strand; PAM type: NRG; PAM sequence: TGG
cttcctcctgctgccattca

SEQ ID NO: 46922 - DNA, 20 bp, Artificial Sequence
  Description of Artificial Sequence: Synthetic oligonucleotide
  Target: ATXN1; (-) strand; PAM type: NRG; PAM sequence: CGG
gactcccctcttttctgccc

SEQ ID NO: 46923 - DNA, 20 bp, Artificial Sequence
  Description of Artificial Sequence: Synthetic oligonucleotide
  Target: ATXN1; (-) strand; PAM type: NRG; PAM sequence: GGG
ctgaaggtggggcctaattg

SEQ ID NO: 46924 - DNA, 20 bp, Artificial Sequence
  Description of Artificial Sequence: Synthetic oligonucleotide
  Target: ATXN1; (-) strand; PAM type: NRG; PAM sequence: GGG
cctgaaggtggggcctaatt

SEQ ID NO: 46925 - DNA, 20 bp, Artificial Sequence
  Description of Artificial Sequence: Synthetic oligonucleotide
  Target: ATXN1; (-) strand; PAM type: NRG; PAM sequence: TGG
gcctgaaggtggggcctaat

SEQ ID NO: 46926 - DNA, 20 bp, Artificial Sequence
  Description of Artificial Sequence: Synthetic oligonucleotide
  Target: ATXN1; (-) strand; PAM type: NRG; PAM sequence: GGG
ccctccctcgcctgaaggtg

SEQ ID NO: 46927 - DNA, 20 bp, Artificial Sequence
  Description of Artificial Sequence: Synthetic oligonucleotide
  Target: ATXN1; (-) strand; PAM type: NRG; PAM sequence: GGG
gccctccctcgcctgaaggt

SEQ ID NO: 46928 - DNA, 20 bp, Artificial Sequence
  Description of Artificial Sequence: Synthetic oligonucleotide
  Target: ATXN1; (-) strand; PAM type: NRG; PAM sequence: TGG
ggccctccctcgcctgaagg

SEQ ID NO: 46929 - DNA, 20 bp, Artificial Sequence
  Description of Artificial Sequence: Synthetic oligonucleotide
  Target: ATXN1; (-) strand; PAM type: NRG; PAM sequence: AGG
tcaggccctccctcgcctga

SEQ ID NO: 46930 - DNA, 20 bp, Artificial Sequence
  Description of Artificial Sequence: Synthetic oligonucleotide
  Target: ATXN1; (-) strand; PAM type: NRG; PAM sequence: AAG
ttcaggccctccctcgcctg

SEQ ID NO: 46931 - DNA, 20 bp, Artificial Sequence
  Description of Artificial Sequence: Synthetic oligonucleotide
  Target: ATXN1; (-) strand; PAM type: NRG; PAM sequence: AGG
cagcccggcccccagccttc

SEQ ID NO: 46932 - DNA, 20 bp, Artificial Sequence
  Description of Artificial Sequence: Synthetic oligonucleotide
  Target: ATXN1; (-) strand; PAM type: NRG; PAM sequence: CAG
gcagcccggcccccagcctt

SEQ ID NO: 46933 - DNA, 20 bp, Artificial Sequence
  Description of Artificial Sequence: Synthetic oligonucleotide
  Target: ATXN1; (-) strand; PAM type: NRG; PAM sequence: CAG
aggactggcagcccggcccc

SEQ ID NO: 46934 - DNA, 20 bp, Artificial Sequence
  Description of Artificial Sequence: Synthetic oligonucleotide
  Target: ATXN1; (-) strand; PAM type: NRG; PAM sequence: CGG
ggtcggcaggactggcagcc

SEQ ID NO: 46935 - DNA, 20 bp, Artificial Sequence
  Description of Artificial Sequence: Synthetic oligonucleotide
  Target: ATXN1; (-) strand; PAM type: NRG; PAM sequence: CAG
actctggtcggcaggactgg

SEQ ID NO: 46936 - DNA, 20 bp, Artificial Sequence
  Description of Artificial Sequence: Synthetic oligonucleotide
  Target: ATXN1; (-) strand; PAM type: NRG; PAM sequence: TGG
cccactctggtcggcaggac

SEQ ID NO: 46937 - DNA, 20 bp, Artificial Sequence
  Description of Artificial Sequence: Synthetic oligonucleotide
  Target: ATXN1; (-) strand; PAM type: NRG; PAM sequence: AGG
gagtccccactctggtcggc

SEQ ID NO: 46938 - DNA, 20 bp, Artificial Sequence
  Description of Artificial Sequence: Synthetic oligonucleotide
  Target: ATXN1; (-) strand; PAM type: NRG; PAM sequence: CAG
cgagtccccactctggtcgg

SEQ ID NO: 46939 - DNA, 20 bp, Artificial Sequence
  Description of Artificial Sequence: Synthetic oligonucleotide
  Target: ATXN1; (-) strand; PAM type: NRG; PAM sequence: CGG
ccacgagtccccactctggt

SEQ ID NO: 46940 - DNA, 20 bp, Artificial Sequence
  Description of Artificial Sequence: Synthetic oligonucleotide
  Target: ATXN1; (-) strand; PAM type: NRG; PAM sequence: TGG
ggcaccacgagtccccactc

SEQ ID NO: 46941 - DNA, 20 bp, Artificial Sequence
  Description of Artificial Sequence: Synthetic oligonucleotide
  Target: ATXN1; (-) strand; PAM type: NRG; PAM sequence: GAG
gtggacggaagaggcaccac

SEQ ID NO: 46942 - DNA, 20 bp, Artificial Sequence
  Description of Artificial Sequence: Synthetic oligonucleotide
  Target: ATXN1; (-) strand; PAM type: NRG; PAM sequence: AGG
tggccatgggtggacggaag

SEQ ID NO: 46943 - DNA, 20 bp, Artificial Sequence
  Description of Artificial Sequence: Synthetic oligonucleotide
  Target: ATXN1; (-) strand; PAM type: NRG; PAM sequence: GAG
gtggccatgggtggacggaa

SEQ ID NO: 46944 - DNA, 20 bp, Artificial Sequence
  Description of Artificial Sequence: Synthetic oligonucleotide
  Target: ATXN1; (-) strand; PAM type: NRG; PAM sequence: AAG
gggtggccatgggtggacgg

SEQ ID NO: 46945 - DNA, 20 bp, Artificial Sequence
  Description of Artificial Sequence: Synthetic oligonucleotide
  Target: ATXN1; (-) strand; PAM type: NRG; PAM sequence: CGG
catgggtggccatgggtgga

SEQ ID NO: 46946 - DNA, 20 bp, Artificial Sequence
  Description of Artificial Sequence: Synthetic oligonucleotide
  Target: ATXN1; (-) strand; PAM type: NRG; PAM sequence: TGG
ggtccatgggtggccatggg

SEQ ID NO: 46947 - DNA, 20 bp, Artificial Sequence
  Description of Artificial Sequence: Synthetic oligonucleotide
  Target: ATXN1; (-) strand; PAM type: NRG; PAM sequence: GGG
attggtccatgggtggccat

SEQ ID NO: 46948 - DNA, 20 bp, Artificial Sequence
  Description of Artificial Sequence: Synthetic oligonucleotide
  Target: ATXN1; (-) strand; PAM type: NRG; PAM sequence: TGG
aattggtccatgggtggcca

SEQ ID NO: 46949 - DNA, 20 bp, Artificial Sequence
  Description of Artificial Sequence: Synthetic oligonucleotide
  Target: ATXN1; (-) strand; PAM type: NRG; PAM sequence: TGG
tgtgccaattggtccatggg

SEQ ID NO: 46950 - DNA, 20 bp, Artificial Sequence
  Description of Artificial Sequence: Synthetic oligonucleotide
  Target: ATXN1; (-) strand; PAM type: NRG; PAM sequence: GGG
gtatgtgccaattggtccat

SEQ ID NO: 46951 - DNA, 20 bp, Artificial Sequence
  Description of Artificial Sequence: Synthetic oligonucleotide
  Target: ATXN1; (-) strand; PAM type: NRG; PAM sequence: TGG
agtatgtgccaattggtcca

SEQ ID NO: 46952 - DNA, 20 bp, Artificial Sequence
  Description of Artificial Sequence: Synthetic oligonucleotide
  Target: ATXN1; (-) strand; PAM type: NRG; PAM sequence: TGG
gggaggaagtatgtgccaat

SEQ ID NO: 46953 - DNA, 20 bp, Artificial Sequence
  Description of Artificial Sequence: Synthetic oligonucleotide
  Target: ATXN1; (-) strand; PAM type: NRG; PAM sequence: AAG
tatggacctcagaggggagg

SEQ ID NO: 46954 - DNA, 20 bp, Artificial Sequence
  Description of Artificial Sequence: Synthetic oligonucleotide
  Target: ATXN1; (-) strand; PAM type: NRG; PAM sequence: AGG
ttttatggacctcagagggg

SEQ ID NO: 46955 - DNA, 20 bp, Artificial Sequence
  Description of Artificial Sequence: Synthetic oligonucleotide
  Target: ATXN1; (-) strand; PAM type: NRG; PAM sequence: GAG
cttttatggacctcagaggg

SEQ ID NO: 46956 - DNA, 20 bp, Artificial Sequence
  Description of Artificial Sequence: Synthetic oligonucleotide
  Target: ATXN1; (-) strand; PAM type: NRG; PAM sequence: GGG
ggcttttatggacctcagag

SEQ ID NO: 46957 - DNA, 20 bp, Artificial Sequence
  Description of Artificial Sequence: Synthetic oligonucleotide
  Target: ATXN1; (-) strand; PAM type: NRG; PAM sequence: GGG
gggcttttatggacctcaga

SEQ ID NO: 46958 - DNA, 20 bp, Artificial Sequence
  Description of Artificial Sequence: Synthetic oligonucleotide
  Target: ATXN1; (-) strand; PAM type: NRG; PAM sequence: AGG
agggcttttatggacctcag

SEQ ID NO: 46959 - DNA, 20 bp, Artificial Sequence
  Description of Artificial Sequence: Synthetic oligonucleotide
  Target: ATXN1; (-) strand; PAM type: NRG; PAM sequence: GAG
cagggcttttatggacctca

SEQ ID NO: 46960 - DNA, 20 bp, Artificial Sequence
  Description of Artificial Sequence: Synthetic oligonucleotide
  Target: ATXN1; (-) strand; PAM type: NRG; PAM sequence: CAG
cccagggcttttatggacct

SEQ ID NO: 46961 - DNA, 20 bp, Artificial Sequence
  Description of Artificial Sequence: Synthetic oligonucleotide
  Target: ATXN1; (-) strand; PAM type: NRG; PAM sequence: TGG
ggctaagcccagggctttta

SEQ ID NO: 46962 - DNA, 20 bp, Artificial Sequence
  Description of Artificial Sequence: Synthetic oligonucleotide
  Target: ATXN1; (-) strand; PAM type: NRG; PAM sequence: GGG
gcctgctgtggctaagccca

SEQ ID NO: 46963 - DNA, 20 bp, Artificial Sequence
  Description of Artificial Sequence: Synthetic oligonucleotide
  Target: ATXN1; (-) strand; PAM type: NRG; PAM sequence: AGG
tgcctgctgtggctaagccc

SEQ ID NO: 46964 - DNA, 20 bp, Artificial Sequence
  Description of Artificial Sequence: Synthetic oligonucleotide
  Target: ATXN1; (-) strand; PAM type: NRG; PAM sequence: CAG
ctgcctgctgtggctaagcc

SEQ ID NO: 46965 - DNA, 20 bp, Artificial Sequence
  Description of Artificial Sequence: Synthetic oligonucleotide
  Target: ATXN1; (-) strand; PAM type: NRG; PAM sequence: AAG
tcctcctgcctgctgtggct

SEQ ID NO: 46966 - DNA, 20 bp, Artificial Sequence
  Description of Artificial Sequence: Synthetic oligonucleotide
  Target: ATXN1; (-) strand; PAM type: NRG; PAM sequence: TGG
ggccatcctcctgcctgctg

SEQ ID NO: 46967 - DNA, 20 bp, Artificial Sequence
  Description of Artificial Sequence: Synthetic oligonucleotide
  Target: ATXN1; (-) strand; PAM type: NRG; PAM sequence: TGG
ctctctgccccctttgtccc

SEQ ID NO: 46968 - DNA, 20 bp, Artificial Sequence
  Description of Artificial Sequence: Synthetic oligonucleotide
  Target: ATXN1; (-) strand; PAM type: NRG; PAM sequence: CAG
cctctctgcaactggtcatc

SEQ ID NO: 46969 - DNA, 20 bp, Artificial Sequence
  Description of Artificial Sequence: Synthetic oligonucleotide
  Target: ATXN1; (-) strand; PAM type: NRG; PAM sequence: TGG
agggtactcctctctgcaac

SEQ ID NO: 46970 - DNA, 20 bp, Artificial Sequence
  Description of Artificial Sequence: Synthetic oligonucleotide
  Target: ATXN1; (-) strand; PAM type: NRG; PAM sequence: GGG
tctccagctatcagcagaga

SEQ ID NO: 46971 - DNA, 20 bp, Artificial Sequence
  Description of Artificial Sequence: Synthetic oligonucleotide
  Target: ATXN1; (-) strand; PAM type: NRG; PAM sequence: AGG
gtctccagctatcagcagag

SEQ ID NO: 46972 - DNA, 20 bp, Artificial Sequence
  Description of Artificial Sequence: Synthetic oligonucleotide
  Target: ATXN1; (-) strand; PAM type: NRG; PAM sequence: GAG
cgtctccagctatcagcaga

SEQ ID NO: 46973 - DNA, 20 bp, Artificial Sequence
  Description of Artificial Sequence: Synthetic oligonucleotide
  Target: ATXN1; (-) strand; PAM type: NRG; PAM sequence: GAG
atcgtctccagctatcagca

SEQ ID NO: 46974 - DNA, 20 bp, Artificial Sequence
  Description of Artificial Sequence: Synthetic oligonucleotide
  Target: ATXN1; (-) strand; PAM type: NRG; PAM sequence: CAG
ccatcgtctccagctatcag

SEQ ID NO: 46975 - DNA, 20 bp, Artificial Sequence
  Description of Artificial Sequence: Synthetic oligonucleotide
  Target: ATXN1; (-) strand; PAM type: NRG; PAM sequence: CAG
gtcccatcgtctccagctat

SEQ ID NO: 46976 - DNA, 20 bp, Artificial Sequence
  Description of Artificial Sequence: Synthetic oligonucleotide
  Target: ATXN1; (-) strand; PAM type: NRG; PAM sequence: CAG
gctggttgtcccatcgtctc

SEQ ID NO: 46977 - DNA, 20 bp, Artificial Sequence
  Description of Artificial Sequence: Synthetic oligonucleotide
  Target: ATXN1; (-) strand; PAM type: NRG; PAM sequence: TGG
cagcaggtcatctctgcagc

SEQ ID NO: 46978 - DNA, 20 bp, Artificial Sequence
  Description of Artificial Sequence: Synthetic oligonucleotide
  Target: ATXN1; (-) strand; PAM type: NRG; PAM sequence: CAG
ctgccagcaggtcatctctg

SEQ ID NO: 46979 - DNA, 20 bp, Artificial Sequence
  Description of Artificial Sequence: Synthetic oligonucleotide
  Target: ATXN1; (-) strand; PAM type: NRG; PAM sequence: AGG
ggtagctcctctctgccagc

SEQ ID NO: 46980 - DNA, 20 bp, Artificial Sequence
  Description of Artificial Sequence: Synthetic oligonucleotide
  Target: ATXN1; (-) strand; PAM type: NRG; PAM sequence: CAG
gggtagctcctctctgccag

SEQ ID NO: 46981 - DNA, 20 bp, Artificial Sequence
  Description of Artificial Sequence: Synthetic oligonucleotide
  Target: ATXN1; (-) strand; PAM type: NRG; PAM sequence: CAG
agagggtagctcctctctgc

SEQ ID NO: 46982 - DNA, 20 bp, Artificial Sequence
  Description of Artificial Sequence: Synthetic oligonucleotide
  Target: ATXN1; (-) strand; PAM type: NRG; PAM sequence: TAG
actcctcttagcagagaggg

SEQ ID NO: 46983 - DNA, 20 bp, Artificial Sequence
  Description of Artificial Sequence: Synthetic oligonucleotide
  Target: ATXN1; (-) strand; PAM type: NRG; PAM sequence: GGG
agcactcctcttagcagaga

SEQ ID NO: 46984 - DNA, 20 bp, Artificial Sequence
  Description of Artificial Sequence: Synthetic oligonucleotide
  Target: ATXN1; (-) strand; PAM type: NRG; PAM sequence: AGG
aagcactcctcttagcagag

SEQ ID NO: 46985 - DNA, 20 bp, Artificial Sequence
  Description of Artificial Sequence: Synthetic oligonucleotide
  Target: ATXN1; (-) strand; PAM type: NRG; PAM sequence: GAG
gaagcactcctcttagcaga

SEQ ID NO: 46986 - DNA, 20 bp, Artificial Sequence
  Description of Artificial Sequence: Synthetic oligonucleotide
  Target: ATXN1; (-) strand; PAM type: NRG; PAM sequence: GAG
ctgaagcactcctcttagca

SEQ ID NO: 46987 - DNA, 20 bp, Artificial Sequence
  Description of Artificial Sequence: Synthetic oligonucleotide
  Target: ATXN1; (-) strand; PAM type: NRG; PAM sequence: CAG
ctctgaagcactcctcttag

SEQ ID NO: 46988 - DNA, 20 bp, Artificial Sequence
  Description of Artificial Sequence: Synthetic oligonucleotide
  Target: ATXN1; (-) strand; PAM type: NRG; PAM sequence: TAG
ggtctctgaagcactcctct

SEQ ID NO: 46989 - DNA, 20 bp, Artificial Sequence
  Description of Artificial Sequence: Synthetic oligonucleotide
  Target: ATXN1; (-) strand; PAM type: NRG; PAM sequence: AAG
agtcattctgcaggtctctg

SEQ ID NO: 46990 - DNA, 20 bp, Artificial Sequence
  Description of Artificial Sequence: Synthetic oligonucleotide
  Target: ATXN1; (-) strand; PAM type: NRG; PAM sequence: AGG
ctgcaggcaagtcattctgc

SEQ ID NO: 46991 - DNA, 20 bp, Artificial Sequence
  Description of Artificial Sequence: Synthetic oligonucleotide
  Target: ATXN1; (-) strand; PAM type: NRG; PAM sequence: CAG
tctgcaggcaagtcattctg

SEQ ID NO: 46992 - DNA, 20 bp, Artificial Sequence
  Description of Artificial Sequence: Synthetic oligonucleotide
  Target: ATXN1; (-) strand; PAM type: NRG; PAM sequence: AAG
ggtggctcctctctgcaggc

SEQ ID NO: 46993 - DNA, 20 bp, Artificial Sequence
  Description of Artificial Sequence: Synthetic oligonucleotide
  Target: ATXN1; (-) strand; PAM type: NRG; PAM sequence: AGG
aaagggtggctcctctctgc

SEQ ID NO: 46994 - DNA, 20 bp, Artificial Sequence
  Description of Artificial Sequence: Synthetic oligonucleotide
  Target: ATXN1; (-) strand; PAM type: NRG; PAM sequence: CAG
gaaagggtggctcctctctg

SEQ ID NO: 46995 - DNA, 20 bp, Artificial Sequence
  Description of Artificial Sequence: Synthetic oligonucleotide
  Target: ATXN1; (-) strand; PAM type: NRG; PAM sequence: TGG
agaggaggccctggaaaggg

SEQ ID NO: 46996 - DNA, 20 bp, Artificial Sequence
  Description of Artificial Sequence: Synthetic oligonucleotide
  Target: ATXN1; (-) strand; PAM type: NRG; PAM sequence: GGG
cagagaggaggccctggaaa

SEQ ID NO: 46997 - DNA, 20 bp, Artificial Sequence
  Description of Artificial Sequence: Synthetic oligonucleotide
  Target: ATXN1; (-) strand; PAM type: NRG; PAM sequence: AGG
gcagagaggaggccctggaa

SEQ ID NO: 46998 - DNA, 20 bp, Artificial Sequence
  Description of Artificial Sequence: Synthetic oligonucleotide
  Target: ATXN1; (-) strand; PAM type: NRG; PAM sequence: AAG
agcagagaggaggccctgga

SEQ ID NO: 46999 - DNA, 20 bp, Artificial Sequence
  Description of Artificial Sequence: Synthetic oligonucleotide
  Target: ATXN1; (-) strand; PAM type: NRG; PAM sequence: TGG
tctcagcagagaggaggccc

SEQ ID NO: 47000 - DNA, 20 bp, Artificial Sequence
  Description of Artificial Sequence: Synthetic oligonucleotide
  Target: ATXN1; (-) strand; PAM type: NRG; PAM sequence: AGG
ttcagctctcagcagagagg

SEQ ID NO: 47001 - DNA, 20 bp, Artificial Sequence
  Description of Artificial Sequence: Synthetic oligonucleotide
  Target: ATXN1; (-) strand; PAM type: NRG; PAM sequence: GAG
gttcagctctcagcagagag

SEQ ID NO: 47002 - DNA, 20 bp, Artificial Sequence
  Description of Artificial Sequence: Synthetic oligonucleotide
  Target: ATXN1; (-) strand; PAM type: NRG; PAM sequence: AGG
gtgttcagctctcagcagag

SEQ ID NO: 47003 - DNA, 20 bp, Artificial Sequence
  Description of Artificial Sequence: Synthetic oligonucleotide
  Target: ATXN1; (-) strand; PAM type: NRG; PAM sequence: GAG
agtgttcagctctcagcaga

SEQ ID NO: 47004 - DNA, 20 bp, Artificial Sequence
  Description of Artificial Sequence: Synthetic oligonucleotide
  Target: ATXN1; (-) strand; PAM type: NRG; PAM sequence: GAG
tgagtgttcagctctcagca

SEQ ID NO: 47005 - DNA, 20 bp, Artificial Sequence
  Description of Artificial Sequence: Synthetic oligonucleotide
  Target: ATXN1; (-) strand; PAM type: NRG; PAM sequence: CAG
attgagtgttcagctctcag

SEQ ID NO: 47006 - DNA, 20 bp, Artificial Sequence
  Description of Artificial Sequence: Synthetic oligonucleotide
  Target: ATXN1; (-) strand; PAM type: NRG; PAM sequence: CAG
cccattgagtgttcagctct

SEQ ID NO: 47007 - DNA, 20 bp, Artificial Sequence
  Description of Artificial Sequence: Synthetic oligonucleotide
  Target: ATXN1; (-) strand; PAM type: NRG; PAM sequence: CAG
agatcgtcccattgagtgtt

SEQ ID NO: 47008 - DNA, 20 bp, Artificial Sequence
  Description of Artificial Sequence: Synthetic oligonucleotide
  Target: ATXN1; (-) strand; PAM type: NRG; PAM sequence: GAG
tataagcagatcgtcccatt

SEQ ID NO: 47009 - DNA, 20 bp, Artificial Sequence
  Description of Artificial Sequence: Synthetic oligonucleotide
  Target: ATXN1; (-) strand; PAM type: NRG; PAM sequence: CAG
ggggagctcctctctataag

SEQ ID NO: 47010 - DNA, 20 bp, Artificial Sequence
  Description of Artificial Sequence: Synthetic oligonucleotide
  Target: ATXN1; (-) strand; PAM type: NRG; PAM sequence: AAG
agtggggagctcctctctat

SEQ ID NO: 47011 - DNA, 20 bp, Artificial Sequence
  Description of Artificial Sequence: Synthetic oligonucleotide
  Target: ATXN1; (-) strand; PAM type: NRG; PAM sequence: GAG
gaacaactcggaggagtggg

SEQ ID NO: 47012 - DNA, 20 bp, Artificial Sequence
  Description of Artificial Sequence: Synthetic oligonucleotide
  Target: ATXN1; (-) strand; PAM type: NRG; PAM sequence: GGG
tagaacaactcggaggagtg

SEQ ID NO: 47013 - DNA, 20 bp, Artificial Sequence
  Description of Artificial Sequence: Synthetic oligonucleotide
  Target: ATXN1; (-) strand; PAM type: NRG; PAM sequence: GGG
ttagaacaactcggaggagt

SEQ ID NO: 47014 - DNA, 20 bp, Artificial Sequence
  Description of Artificial Sequence: Synthetic oligonucleotide
  Target: ATXN1; (-) strand; PAM type: NRG; PAM sequence: TGG
gttagaacaactcggaggag

SEQ ID NO: 47015 - DNA, 20 bp, Artificial Sequence
  Description of Artificial Sequence: Synthetic oligonucleotide
  Target: ATXN1; (-) strand; PAM type: NRG; PAM sequence: GAG
agtgttagaacaactcggag

SEQ ID NO: 47016 - DNA, 20 bp, Artificial Sequence
  Description of Artificial Sequence: Synthetic oligonucleotide
  Target: ATXN1; (-) strand; PAM type: NRG; PAM sequence: AGG
ttagtgttagaacaactcgg

SEQ ID NO: 47017 - DNA, 20 bp, Artificial Sequence
  Description of Artificial Sequence: Synthetic oligonucleotide
  Target: ATXN1; (-) strand; PAM type: NRG; PAM sequence: GAG
tttagtgttagaacaactcg

SEQ ID NO: 47018 - DNA, 20 bp, Artificial Sequence
  Description of Artificial Sequence: Synthetic oligonucleotide
  Target: ATXN1; (-) strand; PAM type: NRG; PAM sequence: CGG
tatttagtgttagaacaact

SEQ ID NO: 47019 - DNA, 20 bp, Artificial Sequence
  Description of Artificial Sequence: Synthetic oligonucleotide
  Target: ATXN1; (-) strand; PAM type: NRG; PAM sequence: TAG
agaagagttttatttagtgt

SEQ ID NO: 47020 - DNA, 20 bp, Artificial Sequence
  Description of Artificial Sequence: Synthetic oligonucleotide
  Target: ATXN1; (-) strand; PAM type: NRG; PAM sequence: TAG
tgaaaaagaagagttttatt

SEQ ID NO: 47021 - DNA, 20 bp, Artificial Sequence
  Description of Artificial Sequence: Synthetic oligonucleotide
  Target: ATXN1; (-) strand; PAM type: NRG; PAM sequence: GAG
atgtgaagggtgaaaaagaa

SEQ ID NO: 47022 - DNA, 20 bp, Artificial Sequence
  Description of Artificial Sequence: Synthetic oligonucleotide
  Target: ATXN1; (-) strand; PAM type: NRG; PAM sequence: AAG
acatgtgaagggtgaaaaag

SEQ ID NO: 47023 - DNA, 20 bp, Artificial Sequence
  Description of Artificial Sequence: Synthetic oligonucleotide
  Target: ATXN1; (-) strand; PAM type: NRG; PAM sequence: AAG
cagacatgtgaagggtgaaa

SEQ ID NO: 47024 - DNA, 20 bp, Artificial Sequence
  Description of Artificial Sequence: Synthetic oligonucleotide
  Target: ATXN1; (-) strand; PAM type: NRG; PAM sequence: GGG
gaggtacacagacatgtgaa

SEQ ID NO: 47025 - DNA, 20 bp, Artificial Sequence
  Description of Artificial Sequence: Synthetic oligonucleotide
  Target: ATXN1; (-) strand; PAM type: NRG; PAM sequence: AGG
tgaggtacacagacatgtga

SEQ ID NO: 47026 - DNA, 20 bp, Artificial Sequence
  Description of Artificial Sequence: Synthetic oligonucleotide
  Target: ATXN1; (-) strand; PAM type: NRG; PAM sequence: AAG
atgaggtacacagacatgtg

SEQ ID NO: 47027 - DNA, 20 bp, Artificial Sequence
  Description of Artificial Sequence: Synthetic oligonucleotide
  Target: ATXN1; (-) strand; PAM type: NRG; PAM sequence: CAG
tccagaaagaatgaggtaca

SEQ ID NO: 47028 - DNA, 20 bp, Artificial Sequence
  Description of Artificial Sequence: Synthetic oligonucleotide
  Target: ATXN1; (-) strand; PAM type: NRG; PAM sequence: AGG
tcctgcgtccagaaagaatg

SEQ ID NO: 47029 - DNA, 20 bp, Artificial Sequence
  Description of Artificial Sequence: Synthetic oligonucleotide
  Target: ATXN1; (-) strand; PAM type: NRG; PAM sequence: GAG
gtcctgcgtccagaaagaat

SEQ ID NO: 47030 - DNA, 20 bp, Artificial Sequence
  Description of Artificial Sequence: Synthetic oligonucleotide
  Target: ATXN1; (-) strand; PAM type: NRG; PAM sequence: AAG
gtttttgtcctgcgtccaga

SEQ ID NO: 47031 - DNA, 20 bp, Artificial Sequence
  Description of Artificial Sequence: Synthetic oligonucleotide
  Target: ATXN1; (-) strand; PAM type: NRG; PAM sequence: CAG
ccaagtttttgtcctgcgtc

SEQ ID NO: 47032 - DNA, 20 bp, Artificial Sequence
  Description of Artificial Sequence: Synthetic oligonucleotide
  Target: ATXN1; (-) strand; PAM type: NRG; PAM sequence: AAG
ccgcaacgccttttaagccc

SEQ ID NO: 47033 - DNA, 20 bp, Artificial Sequence
  Description of Artificial Sequence: Synthetic oligonucleotide
  Target: ATXN1; (-) strand; PAM type: NRG; PAM sequence: AAG
ctgtggccgcaacgcctttt

SEQ ID NO: 47034 - DNA, 20 bp, Artificial Sequence
  Description of Artificial Sequence: Synthetic oligonucleotide
  Target: ATXN1; (-) strand; PAM type: NRG; PAM sequence: TGG
tttctgatgggaaacttctg

SEQ ID NO: 47035 - DNA, 20 bp, Artificial Sequence
  Description of Artificial Sequence: Synthetic oligonucleotide
  Target: ATXN1; (-) strand; PAM type: NRG; PAM sequence: GGG
ggggtgtcaatttttctgat

SEQ ID NO: 47036 - DNA, 20 bp, Artificial Sequence
  Description of Artificial Sequence: Synthetic oligonucleotide
  Target: ATXN1; (-) strand; PAM type: NRG; PAM sequence: TGG
tggggtgtcaatttttctga

SEQ ID NO: 47037 - DNA, 20 bp, Artificial Sequence
  Description of Artificial Sequence: Synthetic oligonucleotide
  Target: ATXN1; (-) strand; PAM type: NRG; PAM sequence: GGG
atactgttataggatctctg

SEQ ID NO: 47038 - DNA, 20 bp, Artificial Sequence
  Description of Artificial Sequence: Synthetic oligonucleotide
  Target: ATXN1; (-) strand; PAM type: NRG; PAM sequence: GGG
catactgttataggatctct

SEQ ID NO: 47039 - DNA, 20 bp, Artificial Sequence
  Description of Artificial Sequence: Synthetic oligonucleotide
  Target: ATXN1; (-) strand; PAM type: NRG; PAM sequence: TGG
acatactgttataggatctc

SEQ ID NO: 47040 - DNA, 20 bp, Artificial Sequence
  Description of Artificial Sequence: Synthetic oligonucleotide
  Target: ATXN1; (-) strand; PAM type: NRG; PAM sequence: AGG
gcgtgagaacatactgttat

SEQ ID NO: 47041 - DNA, 20 bp, Artificial Sequence
  Description of Artificial Sequence: Synthetic oligonucleotide
  Target: ATXN1; (-) strand; PAM type: NRG; PAM sequence: TAG
tgcgtgagaacatactgtta

SEQ ID NO: 47042 - DNA, 20 bp, Artificial Sequence
  Description of Artificial Sequence: Synthetic oligonucleotide
  Target: ATXN1; (-) strand; PAM type: NRG; PAM sequence: GAG
cttggctcccacttatgcgt

SEQ ID NO: 47043 - DNA, 20 bp, Artificial Sequence
  Description of Artificial Sequence: Synthetic oligonucleotide
  Target: ATXN1; (-) strand; PAM type: NRG; PAM sequence: TGG
gcctttgcatcctcatggct

SEQ ID NO: 47044 - DNA, 20 bp, Artificial Sequence
  Description of Artificial Sequence: Synthetic oligonucleotide
  Target: ATXN1; (-) strand; PAM type: NRG; PAM sequence: TGG
gtgaggcctttgcatcctca

SEQ ID NO: 47045 - DNA, 20 bp, Artificial Sequence
  Description of Artificial Sequence: Synthetic oligonucleotide
  Target: ATXN1; (-) strand; PAM type: NRG; PAM sequence: AGG
aagtccactgtatcattgtg

SEQ ID NO: 47046 - DNA, 20 bp, Artificial Sequence
  Description of Artificial Sequence: Synthetic oligonucleotide
  Target: ATXN1; (-) strand; PAM type: NRG; PAM sequence: GAG
aaagtccactgtatcattgt

SEQ ID NO: 47047 - DNA, 20 bp, Artificial Sequence
  Description of Artificial Sequence: Synthetic oligonucleotide
  Target: ATXN1; (-) strand; PAM type: NRG; PAM sequence: AAG
ccctttctcccaagtcccca

SEQ ID NO: 47048 - DNA, 20 bp, Artificial Sequence
  Description of Artificial Sequence: Synthetic oligonucleotide
  Target: ATXN1; (-) strand; PAM type: NRG; PAM sequence: AAG
cccctcccaccctttctccc

SEQ ID NO: 47049 - DNA, 20 bp, Artificial Sequence
  Description of Artificial Sequence: Synthetic oligonucleotide
  Target: ATXN1; (-) strand; PAM type: NRG; PAM sequence: TAG
tatacactgtacccattttg

SEQ ID NO: 47050 - DNA, 20 bp, Artificial Sequence
  Description of Artificial Sequence: Synthetic oligonucleotide
  Target: ATXN1; (-) strand; PAM type: NRG; PAM sequence: GAG
tttcggtgcagccatcaccc

SEQ ID NO: 47051 - DNA, 20 bp, Artificial Sequence
  Description of Artificial Sequence: Synthetic oligonucleotide
  Target: ATXN1; (-) strand; PAM type: NRG; PAM sequence: CAG
gatttctgagattttcggtg

SEQ ID NO: 47052 - DNA, 20 bp, Artificial Sequence
  Description of Artificial Sequence: Synthetic oligonucleotide
  Target: ATXN1; (-) strand; PAM type: NRG; PAM sequence: CGG
gtggtgatttctgagatttt

SEQ ID NO: 47053 - DNA, 20 bp, Artificial Sequence
  Description of Artificial Sequence: Synthetic oligonucleotide
  Target: ATXN1; (-) strand; PAM type: NRG; PAM sequence: GAG
gttcttcggtggtgatttct

SEQ ID NO: 47054 - DNA, 20 bp, Artificial Sequence
  Description of Artificial Sequence: Synthetic oligonucleotide
  Target: ATXN1; (-) strand; PAM type: NRG; PAM sequence: TGG
tacatgaataagttcttcgg

SEQ ID NO: 47055 - DNA, 20 bp, Artificial Sequence
  Description of Artificial Sequence: Synthetic oligonucleotide
  Target: ATXN1; (-) strand; PAM type: NRG; PAM sequence: CGG
ggttacatgaataagttctt

SEQ ID NO: 47056 - DNA, 20 bp, Artificial Sequence
  Description of Artificial Sequence: Synthetic oligonucleotide
  Target: ATXN1; (-) strand; PAM type: NRG; PAM sequence: AAG
tggtgtttggttacatgaat

SEQ ID NO: 47057 - DNA, 20 bp, Artificial Sequence
  Description of Artificial Sequence: Synthetic oligonucleotide
  Target: ATXN1; (-) strand; PAM type: NRG; PAM sequence: TGG
ttgggggaacaggtggtgtt

SEQ ID NO: 47058 - DNA, 20 bp, Artificial Sequence
  Description of Artificial Sequence: Synthetic oligonucleotide
  Target: ATXN1; (-) strand; PAM type: NRG; PAM sequence: TGG
ataggttttgggggaacagg

SEQ ID NO: 47059 - DNA, 20 bp, Artificial Sequence
  Description of Artificial Sequence: Synthetic oligonucleotide
  Target: ATXN1; (-) strand; PAM type: NRG; PAM sequence: AGG
tccataggttttgggggaac

SEQ ID NO: 47060 - DNA, 20 bp, Artificial Sequence
  Description of Artificial Sequence: Synthetic oligonucleotide
  Target: ATXN1; (-) strand; PAM type: NRG; PAM sequence: CAG
gtccataggttttgggggaa

SEQ ID NO: 47061 - DNA, 20 bp, Artificial Sequence
  Description of Artificial Sequence: Synthetic oligonucleotide
  Target: ATXN1; (-) strand; PAM type: NRG; PAM sequence: GGG
tttacgtccataggttttgg

SEQ ID NO: 47062 - DNA, 20 bp, Artificial Sequence
  Description of Artificial Sequence: Synthetic oligonucleotide
  Target: ATXN1; (-) strand; PAM type: NRG; PAM sequence: GGG
ttttacgtccataggttttg

SEQ ID NO: 47063 - DNA, 20 bp, Artificial Sequence
  Description of Artificial Sequence: Synthetic oligonucleotide
  Target: ATXN1; (-) strand; PAM type: NRG; PAM sequence: GGG
tttttacgtccataggtttt

SEQ ID NO: 47064 - DNA, 20 bp, Artificial Sequence
  Description of Artificial Sequence: Synthetic oligonucleotide
  Target: ATXN1; (-) strand; PAM type: NRG; PAM sequence: TGG
ttttttacgtccataggttt

SEQ ID NO: 47065 - DNA, 20 bp, Artificial Sequence
  Description of Artificial Sequence: Synthetic oligonucleotide
  Target: ATXN1; (-) strand; PAM type: NRG; PAM sequence: AGG
tttttattttttacgtccat

SEQ ID NO: 47066 - DNA, 20 bp, Artificial Sequence
  Description of Artificial Sequence: Synthetic oligonucleotide
  Target: ATXN1; (-) strand; PAM type: NRG; PAM sequence: TAG
atttttattttttacgtcca

SEQ ID NO: 47067 - DNA, 20 bp, Artificial Sequence
  Description of Artificial Sequence: Synthetic oligonucleotide
  Target: ATXN1; (-) strand; PAM type: NRG; PAM sequence: TAG
tctaatccaatggccattct

SEQ ID NO: 47068 - DNA, 20 bp, Artificial Sequence
  Description of Artificial Sequence: Synthetic oligonucleotide
  Target: ATXN1; (-) strand; PAM type: NRG; PAM sequence: TGG
gaacccatggtctaatccaa

SEQ ID NO: 47069 - DNA, 20 bp, Artificial Sequence
  Description of Artificial Sequence: Synthetic oligonucleotide
  Target: ATXN1; (-) strand; PAM type: NRG; PAM sequence: TGG
cagcagatattgagaaccca

SEQ ID NO: 47070 - DNA, 20 bp, Artificial Sequence
  Description of Artificial Sequence: Synthetic oligonucleotide
  Target: ATXN1; (-) strand; PAM type: NRG; PAM sequence: GAG
tctaatattcagcagatatt

SEQ ID NO: 47071 - DNA, 20 bp, Artificial Sequence
  Description of Artificial Sequence: Synthetic oligonucleotide
  Target: ATXN1; (-) strand; PAM type: NRG; PAM sequence: CAG
ccggtgcttctaatattcag

SEQ ID NO: 47072 - DNA, 20 bp, Artificial Sequence
  Description of Artificial Sequence: Synthetic oligonucleotide
  Target: ATXN1; (-) strand; PAM type: NRG; PAM sequence: CAG
tctccggtgcttctaatatt

SEQ ID NO: 47073 - DNA, 20 bp, Artificial Sequence
  Description of Artificial Sequence: Synthetic oligonucleotide
  Target: ATXN1; (-) strand; PAM type: NRG; PAM sequence: CGG
agtgtcttgtagaagctctc

SEQ ID NO: 47074 - DNA, 20 bp, Artificial Sequence
  Description of Artificial Sequence: Synthetic oligonucleotide
  Target: ATXN1; (-) strand; PAM type: NRG; PAM sequence: AAG
tctgggttagtgtcttgtag

SEQ ID NO: 47075 - DNA, 20 bp, Artificial Sequence
  Description of Artificial Sequence: Synthetic oligonucleotide
  Target: ATXN1; (-) strand; PAM type: NRG; PAM sequence: TAG
gattctgggttagtgtcttg

SEQ ID NO: 47076 - DNA, 20 bp, Artificial Sequence
  Description of Artificial Sequence: Synthetic oligonucleotide
  Target: ATXN1; (-) strand; PAM type: NRG; PAM sequence: TAG
cattaattcagattctgggt

SEQ ID NO: 47077 - DNA, 20 bp, Artificial Sequence
  Description of Artificial Sequence: Synthetic oligonucleotide
  Target: ATXN1; (-) strand; PAM type: NRG; PAM sequence: GGG
tgggcattaattcagattct

SEQ ID NO: 47078 - DNA, 20 bp, Artificial Sequence
  Description of Artificial Sequence: Synthetic oligonucleotide
  Target: ATXN1; (-) strand; PAM type: NRG; PAM sequence: TGG
gtgggcattaattcagattc

SEQ ID NO: 47079 - DNA, 20 bp, Artificial Sequence
  Description of Artificial Sequence: Synthetic oligonucleotide
  Target: ATXN1; (-) strand; PAM type: NRG; PAM sequence: CAG
taatccagtgggcattaatt

SEQ ID NO: 47080 - DNA, 20 bp, Artificial Sequence
  Description of Artificial Sequence: Synthetic oligonucleotide
  Target: ATXN1; (-) strand; PAM type: NRG; PAM sequence: GGG
accatacagtttaatccagt

SEQ ID NO: 47081 - DNA, 20 bp, Artificial Sequence
  Description of Artificial Sequence: Synthetic oligonucleotide
  Target: ATXN1; (-) strand; PAM type: NRG; PAM sequence: TGG
gaccatacagtttaatccag

SEQ ID NO: 47082 - DNA, 20 bp, Artificial Sequence
  Description of Artificial Sequence: Synthetic oligonucleotide
  Target: ATXN1; (-) strand; PAM type: NRG; PAM sequence: CAG
tctgaccatacagtttaatc

SEQ ID NO: 47083 - DNA, 20 bp, Artificial Sequence
  Description of Artificial Sequence: Synthetic oligonucleotide
  Target: ATXN1; (-) strand; PAM type: NRG; PAM sequence: CAG
tgaagtcatctctgaccata

SEQ ID NO: 47084 - DNA, 20 bp, Artificial Sequence
  Description of Artificial Sequence: Synthetic oligonucleotide
  Target: ATXN1; (-) strand; PAM type: NRG; PAM sequence: AAG
ctatagagctgttctctttg

SEQ ID NO: 47085 - DNA, 20 bp, Artificial Sequence
  Description of Artificial Sequence: Synthetic oligonucleotide
  Target: ATXN1; (-) strand; PAM type: NRG; PAM sequence: GAG
tactttaaaataggactata

SEQ ID NO: 47086 - DNA, 20 bp, Artificial Sequence
  Description of Artificial Sequence: Synthetic oligonucleotide
  Target: ATXN1; (-) strand; PAM type: NRG; PAM sequence: TAG
cctactttaaaataggacta

SEQ ID NO: 47087 - DNA, 20 bp, Artificial Sequence
  Description of Artificial Sequence: Synthetic oligonucleotide
  Target: ATXN1; (-) strand; PAM type: NRG; PAM sequence: AGG
ctgttcccctactttaaaat

SEQ ID NO: 47088 - DNA, 20 bp, Artificial Sequence
  Description of Artificial Sequence: Synthetic oligonucleotide
  Target: ATXN1; (-) strand; PAM type: NRG; PAM sequence: TAG
tctgttcccctactttaaaa

SEQ ID NO: 47089 - DNA, 20 bp, Artificial Sequence
  Description of Artificial Sequence: Synthetic oligonucleotide
  Target: ATXN1; (-) strand; PAM type: NRG; PAM sequence: GGG
aacacatttccgatgtcact

SEQ ID NO: 47090 - DNA, 20 bp, Artificial Sequence
  Description of Artificial Sequence: Synthetic oligonucleotide
  Target: ATXN1; (-) strand; PAM type: NRG; PAM sequence: TGG
aaacacatttccgatgtcac

SEQ ID NO: 47091 - DNA, 20 bp, Artificial Sequence
  Description of Artificial Sequence: Synthetic oligonucleotide
  Target: ATXN1; (-) strand; PAM type: NRG; PAM sequence: TGG
tacatattgaatcttgggaa

SEQ ID NO: 47092 - DNA, 20 bp, Artificial Sequence
  Description of Artificial Sequence: Synthetic oligonucleotide
  Target: ATXN1; (-) strand; PAM type: NRG; PAM sequence: GGG
aaatttacatattgaatctt

SEQ ID NO: 47093 - DNA, 20 bp, Artificial Sequence
  Description of Artificial Sequence: Synthetic oligonucleotide
  Target: ATXN1; (-) strand; PAM type: NRG; PAM sequence: TGG
caaatttacatattgaatct

SEQ ID NO: 47094 - DNA, 20 bp, Artificial Sequence
  Description of Artificial Sequence: Synthetic oligonucleotide
  Target: ATXN1; (-) strand; PAM type: NRG; PAM sequence: AAG
aaatgctgaatatgttattc

SEQ ID NO: 47095 - DNA, 20 bp, Artificial Sequence
  Description of Artificial Sequence: Synthetic oligonucleotide
  Target: ATXN1; (-) strand; PAM type: NRG; PAM sequence: GAG
gccagtgtaatcccaggcat

SEQ ID NO: 47096 - DNA, 20 bp, Artificial Sequence
  Description of Artificial Sequence: Synthetic oligonucleotide
  Target: ATXN1; (-) strand; PAM type: NRG; PAM sequence: AGG
ggctcagccagtgtaatccc

SEQ ID NO: 47097 - DNA, 20 bp, Artificial Sequence
  Description of Artificial Sequence: Synthetic oligonucleotide
  Target: ATXN1; (-) strand; PAM type: NRG; PAM sequence: CAG
aggctcagccagtgtaatcc

SEQ ID NO: 47098 - DNA, 20 bp, Artificial Sequence
  Description of Artificial Sequence: Synthetic oligonucleotide
  Target: ATXN1; (-) strand; PAM type: NRG; PAM sequence: CAG
cgtgatgtgggaggctcagc

SEQ ID NO: 47099 - DNA, 20 bp, Artificial Sequence
  Description of Artificial Sequence: Synthetic oligonucleotide
  Target: ATXN1; (-) strand; PAM type: NRG; PAM sequence: CAG
gcttcgtgatgtgggaggct

SEQ ID NO: 47100 - DNA, 20 bp, Artificial Sequence
  Description of Artificial Sequence: Synthetic oligonucleotide
  Target: ATXN1; (-) strand; PAM type: NRG; PAM sequence: AGG
catttgcttcgtgatgtggg

SEQ ID NO: 47101 - DNA, 20 bp, Artificial Sequence
  Description of Artificial Sequence: Synthetic oligonucleotide
  Target: ATXN1; (-) strand; PAM type: NRG; PAM sequence: GAG
gcatttgcttcgtgatgtgg

SEQ ID NO: 47102 - DNA, 20 bp, Artificial Sequence
  Description of Artificial Sequence: Synthetic oligonucleotide
  Target: ATXN1; (-) strand; PAM type: NRG; PAM sequence: GGG
aagcatttgcttcgtgatgt

SEQ ID NO: 47103 - DNA, 20 bp, Artificial Sequence
  Description of Artificial Sequence: Synthetic oligonucleotide
  Target: ATXN1; (-) strand; PAM type: NRG; PAM sequence: TGG
caagcatttgcttcgtgatg

SEQ ID NO: 47104 - DNA, 20 bp, Artificial Sequence
  Description of Artificial Sequence: Synthetic oligonucleotide
  Target: ATXN1; (-) strand; PAM type: NRG; PAM sequence: AAG
cagagcccatatgtttattc

SEQ ID NO: 47105 - DNA, 20 bp, Artificial Sequence
  Description of Artificial Sequence: Synthetic oligonucleotide
  Target: ATXN1; (-) strand; PAM type: NRG; PAM sequence: GAG
gctctgagggcactttctca

SEQ ID NO: 47106 - DNA, 20 bp, Artificial Sequence
  Description of Artificial Sequence: Synthetic oligonucleotide
  Target: ATXN1; (-) strand; PAM type: NRG; PAM sequence: CAG
tggctctgagggcactttct

SEQ ID NO: 47107 - DNA, 20 bp, Artificial Sequence
  Description of Artificial Sequence: Synthetic oligonucleotide
  Target: ATXN1; (-) strand; PAM type: NRG; PAM sequence: GGG
gtcatgttccctggctctga

SEQ ID NO: 47108 - DNA, 20 bp, Artificial Sequence
  Description of Artificial Sequence: Synthetic oligonucleotide
  Target: ATXN1; (-) strand; PAM type: NRG; PAM sequence: AGG
agtcatgttccctggctctg

SEQ ID NO: 47109 - DNA, 20 bp, Artificial Sequence
  Description of Artificial Sequence: Synthetic oligonucleotide
  Target: ATXN1; (-) strand; PAM type: NRG; PAM sequence: GAG
tagtcatgttccctggctct

SEQ ID NO: 47110 - DNA, 20 bp, Artificial Sequence
  Description of Artificial Sequence: Synthetic oligonucleotide
  Target: ATXN1; (-) strand; PAM type: NRG; PAM sequence: TGG
tgaaatatagtcatgttccc

SEQ ID NO: 47111 - DNA, 20 bp, Artificial Sequence
  Description of Artificial Sequence: Synthetic oligonucleotide
  Target: ATXN1; (-) strand; PAM type: NRG; PAM sequence: TAG
acttctcttaaattgaaata

SEQ ID NO: 47112 - DNA, 20 bp, Artificial Sequence
  Description of Artificial Sequence: Synthetic oligonucleotide
  Target: ATXN1; (-) strand; PAM type: NRG; PAM sequence: AGG
gaggaacagtgttttccaag

SEQ ID NO: 47113 - DNA, 20 bp, Artificial Sequence
  Description of Artificial Sequence: Synthetic oligonucleotide
  Target: ATXN1; (-) strand; PAM type: NRG; PAM sequence: GAG
agaggaacagtgttttccaa

SEQ ID NO: 47114 - DNA, 20 bp, Artificial Sequence
  Description of Artificial Sequence: Synthetic oligonucleotide
  Target: ATXN1; (-) strand; PAM type: NRG; PAM sequence: AAG
caagaggaacagtgttttcc

SEQ ID NO: 47115 - DNA, 20 bp, Artificial Sequence
  Description of Artificial Sequence: Synthetic oligonucleotide
  Target: ATXN1; (-) strand; PAM type: NRG; PAM sequence: CAG
gagggagcaaacaagaggaa

SEQ ID NO: 47116 - DNA, 20 bp, Artificial Sequence
  Description of Artificial Sequence: Synthetic oligonucleotide
  Target: ATXN1; (-) strand; PAM type: NRG; PAM sequence: AGG
ttgaagagggagcaaacaag

SEQ ID NO: 47117 - DNA, 20 bp, Artificial Sequence
  Description of Artificial Sequence: Synthetic oligonucleotide
  Target: ATXN1; (-) strand; PAM type: NRG; PAM sequence: GAG
gttgaagagggagcaaacaa

SEQ ID NO: 47118 - DNA, 20 bp, Artificial Sequence
  Description of Artificial Sequence: Synthetic oligonucleotide
  Target: ATXN1; (-) strand; PAM type: NRG; PAM sequence: AAG
ccgttgaagagggagcaaac

SEQ ID NO: 47119 - DNA, 20 bp, Artificial Sequence
  Description of Artificial Sequence: Synthetic oligonucleotide
  Target: ATXN1; (-) strand; PAM type: NRG; PAM sequence: GAG
ttaaaaacccgttgaagagg

SEQ ID NO: 47120 - DNA, 20 bp, Artificial Sequence
  Description of Artificial Sequence: Synthetic oligonucleotide
  Target: ATXN1; (-) strand; PAM type: NRG; PAM sequence: GGG
acttaaaaacccgttgaaga

SEQ ID NO: 47121 - DNA, 20 bp, Artificial Sequence
  Description of Artificial Sequence: Synthetic oligonucleotide
  Target: ATXN1; (-) strand; PAM type: NRG; PAM sequence: AGG
gacttaaaaacccgttgaag

SEQ ID NO: 47122 - DNA, 20 bp, Artificial Sequence
  Description of Artificial Sequence: Synthetic oligonucleotide
  Target: ATXN1; (-) strand; PAM type: NRG; PAM sequence: GAG
ggacttaaaaacccgttgaa

SEQ ID NO: 47123 - DNA, 20 bp, Artificial Sequence
  Description of Artificial Sequence: Synthetic oligonucleotide
  Target: ATXN1; (-) strand; PAM type: NRG; PAM sequence: AAG
ctggacttaaaaacccgttg

SEQ ID NO: 47124 - DNA, 20 bp, Artificial Sequence
  Description of Artificial Sequence: Synthetic oligonucleotide
  Target: ATXN1; (-) strand; PAM type: NRG; PAM sequence: TGG
aggacttttggaatgagccc

SEQ ID NO: 47125 - DNA, 20 bp, Artificial Sequence
  Description of Artificial Sequence: Synthetic oligonucleotide
  Target: ATXN1; (-) strand; PAM type: NRG; PAM sequence: GAG
ggctaaaggacttttggaat

SEQ ID NO: 47126 - DNA, 20 bp, Artificial Sequence
  Description of Artificial Sequence: Synthetic oligonucleotide
  Target: ATXN1; (-) strand; PAM type: NRG; PAM sequence: TGG
aagattggctaaaggacttt

SEQ ID NO: 47127 - DNA, 20 bp, Artificial Sequence
  Description of Artificial Sequence: Synthetic oligonucleotide
  Target: ATXN1; (-) strand; PAM type: NRG; PAM sequence: AGG
gaggaactaagattggctaa

SEQ ID NO: 47128 - DNA, 20 bp, Artificial Sequence
  Description of Artificial Sequence: Synthetic oligonucleotide
  Target: ATXN1; (-) strand; PAM type: NRG; PAM sequence: AAG
agaggaactaagattggcta

SEQ ID NO: 47129 - DNA, 20 bp, Artificial Sequence
  Description of Artificial Sequence: Synthetic oligonucleotide
  Target: ATXN1; (-) strand; PAM type: NRG; PAM sequence: TGG
acgattagaggaactaagat

SEQ ID NO: 47130 - DNA, 20 bp, Artificial Sequence
  Description of Artificial Sequence: Synthetic oligonucleotide
  Target: ATXN1; (-) strand; PAM type: NRG; PAM sequence: AAG
atgttacgattagaggaact

SEQ ID NO: 47131 - DNA, 20 bp, Artificial Sequence
  Description of Artificial Sequence: Synthetic oligonucleotide
  Target: ATXN1; (-) strand; PAM type: NRG; PAM sequence: AGG
actgaatatgttacgattag

SEQ ID NO: 47132 - DNA, 20 bp, Artificial Sequence
  Description of Artificial Sequence: Synthetic oligonucleotide
  Target: ATXN1; (-) strand; PAM type: NRG; PAM sequence: GAG
cactgaatatgttacgatta

SEQ ID NO: 47133 - DNA, 20 bp, Artificial Sequence
  Description of Artificial Sequence: Synthetic oligonucleotide
  Target: ATXN1; (-) strand; PAM type: NRG; PAM sequence: TAG
ctcactgaatatgttacgat

SEQ ID NO: 47134 - DNA, 20 bp, Artificial Sequence
  Description of Artificial Sequence: Synthetic oligonucleotide
  Target: ATXN1; (-) strand; PAM type: NRG; PAM sequence: AGG
aacaatttgcctgaccttat

SEQ ID NO: 47135 - DNA, 20 bp, Artificial Sequence
  Description of Artificial Sequence: Synthetic oligonucleotide
  Target: ATXN1; (-) strand; PAM type: NRG; PAM sequence: TAG
caacaatttgcctgacctta

SEQ ID NO: 47136 - DNA, 20 bp, Artificial Sequence
  Description of Artificial Sequence: Synthetic oligonucleotide
  Target: ATXN1; (-) strand; PAM type: NRG; PAM sequence: TGG
ttcttcaaacctaaagttgc

SEQ ID NO: 47137 - DNA, 20 bp, Artificial Sequence
  Description of Artificial Sequence: Synthetic oligonucleotide
  Target: ATXN1; (-) strand; PAM type: NRG; PAM sequence: AAG
actggatttcttcaaaccta

SEQ ID NO: 47138 - DNA, 20 bp, Artificial Sequence
  Description of Artificial Sequence: Synthetic oligonucleotide
  Target: ATXN1; (-) strand; PAM type: NRG; PAM sequence: TGG
tgtgtgtgtgttttctccac

SEQ ID NO: 47139 - DNA, 20 bp, Artificial Sequence
  Description of Artificial Sequence: Synthetic oligonucleotide
  Target: ATXN1; (-) strand; PAM type: NRG; PAM sequence: GGG
tgaatgtgaggtgtggacgt

SEQ ID NO: 47140 - DNA, 20 bp, Artificial Sequence
  Description of Artificial Sequence: Synthetic oligonucleotide
  Target: ATXN1; (-) strand; PAM type: NRG; PAM sequence: TGG
ctgaatgtgaggtgtggacg

SEQ ID NO: 47141 - DNA, 20 bp, Artificial Sequence
  Description of Artificial Sequence: Synthetic oligonucleotide
  Target: ATXN1; (-) strand; PAM type: NRG; PAM sequence: TGG
acaggtctgaatgtgaggtg

SEQ ID NO: 47142 - DNA, 20 bp, Artificial Sequence
  Description of Artificial Sequence: Synthetic oligonucleotide
  Target: ATXN1; (-) strand; PAM type: NRG; PAM sequence: AGG
gacagacaggtctgaatgtg

SEQ ID NO: 47143 - DNA, 20 bp, Artificial Sequence
  Description of Artificial Sequence: Synthetic oligonucleotide
  Target: ATXN1; (-) strand; PAM type: NRG; PAM sequence: GAG
agacagacaggtctgaatgt

SEQ ID NO: 47144 - DNA, 20 bp, Artificial Sequence
  Description of Artificial Sequence: Synthetic oligonucleotide
  Target: ATXN1; (-) strand; PAM type: NRG; PAM sequence: AGG
ttgggataatggagacagac

SEQ ID NO: 47145 - DNA, 20 bp, Artificial Sequence
  Description of Artificial Sequence: Synthetic oligonucleotide
  Target: ATXN1; (-) strand; PAM type: NRG; PAM sequence: CAG
attgggataatggagacaga

SEQ ID NO: 47146 - DNA, 20 bp, Artificial Sequence
  Description of Artificial Sequence: Synthetic oligonucleotide
  Target: ATXN1; (-) strand; PAM type: NRG; PAM sequence: CAG
gtgtattgggataatggaga

SEQ ID NO: 47147 - DNA, 20 bp, Artificial Sequence
  Description of Artificial Sequence: Synthetic oligonucleotide
  Target: ATXN1; (-) strand; PAM type: NRG; PAM sequence: GAG
agtggtgtattgggataatg

SEQ ID NO: 47148 - DNA, 20 bp, Artificial Sequence
  Description of Artificial Sequence: Synthetic oligonucleotide
  Target: ATXN1; (-) strand; PAM type: NRG; PAM sequence: TGG
ccagtggtgtattgggataa

SEQ ID NO: 47149 - DNA, 20 bp, Artificial Sequence
  Description of Artificial Sequence: Synthetic oligonucleotide
  Target: ATXN1; (-) strand; PAM type: NRG; PAM sequence: GGG
aaagaccccagtggtgtatt

SEQ ID NO: 47150 - DNA, 20 bp, Artificial Sequence
  Description of Artificial Sequence: Synthetic oligonucleotide
  Target: ATXN1; (-) strand; PAM type: NRG; PAM sequence: TGG
gaaagaccccagtggtgtat

SEQ ID NO: 47151 - DNA, 20 bp, Artificial Sequence
  Description of Artificial Sequence: Synthetic oligonucleotide
  Target: ATXN1; (-) strand; PAM type: NRG; PAM sequence: TGG
aatacagggaaagaccccag

SEQ ID NO: 47152 - DNA, 20 bp, Artificial Sequence
  Description of Artificial Sequence: Synthetic oligonucleotide
  Target: ATXN1; (-) strand; PAM type: NRG; PAM sequence: CAG
ctgaatacagggaaagaccc

SEQ ID NO: 47153 - DNA, 20 bp, Artificial Sequence
  Description of Artificial Sequence: Synthetic oligonucleotide
  Target: ATXN1; (-) strand; PAM type: NRG; PAM sequence: AAG
ccacttcctgaatacaggga

SEQ ID NO: 47154 - DNA, 20 bp, Artificial Sequence
  Description of Artificial Sequence: Synthetic oligonucleotide
  Target: ATXN1; (-) strand; PAM type: NRG; PAM sequence: GGG
gaacccacttcctgaataca

SEQ ID NO: 47155 - DNA, 20 bp, Artificial Sequence
  Description of Artificial Sequence: Synthetic oligonucleotide
  Target: ATXN1; (-) strand; PAM type: NRG; PAM sequence: AGG
agaacccacttcctgaatac

SEQ ID NO: 47156 - DNA, 20 bp, Artificial Sequence
  Description of Artificial Sequence: Synthetic oligonucleotide
  Target: ATXN1; (-) strand; PAM type: NRG; PAM sequence: CAG
tagaacccacttcctgaata

SEQ ID NO: 47157 - DNA, 20 bp, Artificial Sequence
  Description of Artificial Sequence: Synthetic oligonucleotide
  Target: ATXN1; (-) strand; PAM type: NRG; PAM sequence: TAG
acaaatggacagggctgttc

SEQ ID NO: 47158 - DNA, 20 bp, Artificial Sequence
  Description of Artificial Sequence: Synthetic oligonucleotide
  Target: ATXN1; (-) strand; PAM type: NRG; PAM sequence: GGG
ttattccttacaaatggaca

SEQ ID NO: 47159 - DNA, 20 bp, Artificial Sequence
  Description of Artificial Sequence: Synthetic oligonucleotide
  Target: ATXN1; (-) strand; PAM type: NRG; PAM sequence: AGG
gttattccttacaaatggac

SEQ ID NO: 47160 - DNA, 20 bp, Artificial Sequence
  Description of Artificial Sequence: Synthetic oligonucleotide
  Target: ATXN1; (-) strand; PAM type: NRG; PAM sequence: CAG
tgttattccttacaaatgga

SEQ ID NO: 47161 - DNA, 20 bp, Artificial Sequence
  Description of Artificial Sequence: Synthetic oligonucleotide
  Target: ATXN1; (-) strand; PAM type: NRG; PAM sequence: TGG
cttgtgttattccttacaaa

SEQ ID NO: 47162 - DNA, 20 bp, Artificial Sequence
  Description of Artificial Sequence: Synthetic oligonucleotide
  Target: ATXN1; (-) strand; PAM type: NRG; PAM sequence: AGG
ctttctcacttgctagtttc

SEQ ID NO: 47163 - DNA, 20 bp, Artificial Sequence
  Description of Artificial Sequence: Synthetic oligonucleotide
  Target: ATXN1; (-) strand; PAM type: NRG; PAM sequence: CAG
actttctcacttgctagttt

SEQ ID NO: 47164 - DNA, 20 bp, Artificial Sequence
  Description of Artificial Sequence: Synthetic oligonucleotide
  Target: ATXN1; (-) strand; PAM type: NRG; PAM sequence: TAG
gtaaagactttctcacttgc

SEQ ID NO: 47165 - DNA, 20 bp, Artificial Sequence
  Description of Artificial Sequence: Synthetic oligonucleotide
  Target: ATXN1; (-) strand; PAM type: NRG; PAM sequence: AAG
tcatttacttagaataagta

SEQ ID NO: 47166 - DNA, 20 bp, Artificial Sequence
  Description of Artificial Sequence: Synthetic oligonucleotide
  Target: ATXN1; (-) strand; PAM type: NRG; PAM sequence: AAG
gggagtcatttacttagaat

SEQ ID NO: 47167 - DNA, 20 bp, Artificial Sequence
  Description of Artificial Sequence: Synthetic oligonucleotide
  Target: ATXN1; (-) strand; PAM type: NRG; PAM sequence: TAG
gtccttgggagtcatttact

SEQ ID NO: 47168 - DNA, 20 bp, Artificial Sequence
  Description of Artificial Sequence: Synthetic oligonucleotide
  Target: ATXN1; (-) strand; PAM type: NRG; PAM sequence: GAG
gagctacatcttgtccttgg

SEQ ID NO: 47169 - DNA, 20 bp, Artificial Sequence
  Description of Artificial Sequence: Synthetic oligonucleotide
  Target: ATXN1; (-) strand; PAM type: NRG; PAM sequence: GGG
gcgagctacatcttgtcctt

SEQ ID NO: 47170 - DNA, 20 bp, Artificial Sequence
  Description of Artificial Sequence: Synthetic oligonucleotide
  Target: ATXN1; (-) strand; PAM type: NRG; PAM sequence: TGG
tgcgagctacatcttgtcct

SEQ ID NO: 47171 - DNA, 20 bp, Artificial Sequence
  Description of Artificial Sequence: Synthetic oligonucleotide
  Target: ATXN1; (-) strand; PAM type: NRG; PAM sequence: GAG
agcaacactgaagaagctgc

SEQ ID NO: 47172 - DNA, 20 bp, Artificial Sequence
  Description of Artificial Sequence: Synthetic oligonucleotide
  Target: ATXN1; (-) strand; PAM type: NRG; PAM sequence: AAG
aatgtgcagcaacactgaag

SEQ ID NO: 47173 - DNA, 20 bp, Artificial Sequence
  Description of Artificial Sequence: Synthetic oligonucleotide
  Target: ATXN1; (-) strand; PAM type: NRG; PAM sequence: AAG
gtaaatgtgcagcaacactg

SEQ ID NO: 47174 - DNA, 20 bp, Artificial Sequence
  Description of Artificial Sequence: Synthetic oligonucleotide
  Target: ATXN1; (-) strand; PAM type: NRG; PAM sequence: CAG
aaatgtatgtcgtaaatgtg

SEQ ID NO: 47175 - DNA, 20 bp, Artificial Sequence
  Description of Artificial Sequence: Synthetic oligonucleotide
  Target: ATXN1; (-) strand; PAM type: NRG; PAM sequence: TAG
tcactattgagcattttcat

SEQ ID NO: 47176 - DNA, 20 bp, Artificial Sequence
  Description of Artificial Sequence: Synthetic oligonucleotide
  Target: ATXN1; (-) strand; PAM type: NRG; PAM sequence: GAG
gctcagacatattcactatt

SEQ ID NO: 47177 - DNA, 20 bp, Artificial Sequence
  Description of Artificial Sequence: Synthetic oligonucleotide
  Target: ATXN1; (-) strand; PAM type: NRG; PAM sequence: CAG
acttattctccataggggct

SEQ ID NO: 47178 - DNA, 20 bp, Artificial Sequence
  Description of Artificial Sequence: Synthetic oligonucleotide
  Target: ATXN1; (-) strand; PAM type: NRG; PAM sequence: GGG
gcactacttattctccatag

SEQ ID NO: 47179 - DNA, 20 bp, Artificial Sequence
  Description of Artificial Sequence: Synthetic oligonucleotide
  Target: ATXN1; (-) strand; PAM type: NRG; PAM sequence: GGG
tgcactacttattctccata

SEQ ID NO: 47180 - DNA, 20 bp, Artificial Sequence
  Description of Artificial Sequence: Synthetic oligonucleotide
  Target: ATXN1; (-) strand; PAM type: NRG; PAM sequence: AGG
ttgcactacttattctccat

SEQ ID NO: 47181 - DNA, 20 bp, Artificial Sequence
  Description of Artificial Sequence: Synthetic oligonucleotide
  Target: ATXN1; (-) strand; PAM type: NRG; PAM sequence: TAG
attgcactacttattctcca

SEQ ID NO: 47182 - DNA, 20 bp, Artificial Sequence
  Description of Artificial Sequence: Synthetic oligonucleotide
  Target: ATXN1; (-) strand; PAM type: NRG; PAM sequence: GGG
agagacagttaaatgtcttt

SEQ ID NO: 47183 - DNA, 20 bp, Artificial Sequence
  Description of Artificial Sequence: Synthetic oligonucleotide
  Target: ATXN1; (-) strand; PAM type: NRG; PAM sequence: TGG
cagagacagttaaatgtctt

SEQ ID NO: 47184 - DNA, 20 bp, Artificial Sequence
  Description of Artificial Sequence: Synthetic oligonucleotide
  Target: ATXN1; (-) strand; PAM type: NRG; PAM sequence: CAG
ttcttcttgcctctcagaga

SEQ ID NO: 47185 - DNA, 20 bp, Artificial Sequence
  Description of Artificial Sequence: Synthetic oligonucleotide
  Target: ATXN1; (-) strand; PAM type: NRG; PAM sequence: GAG
cagattcttcttgcctctca

SEQ ID NO: 47186 - DNA, 20 bp, Artificial Sequence
  Description of Artificial Sequence: Synthetic oligonucleotide
  Target: ATXN1; (-) strand; PAM type: NRG; PAM sequence: CAG
cacagattcttcttgcctct

SEQ ID NO: 47187 - DNA, 20 bp, Artificial Sequence
  Description of Artificial Sequence: Synthetic oligonucleotide
  Target: ATXN1; (-) strand; PAM type: NRG; PAM sequence: CAG
atagagccacacccctaaca

SEQ ID NO: 47188 - DNA, 20 bp, Artificial Sequence
  Description of Artificial Sequence: Synthetic oligonucleotide
  Target: ATXN1; (-) strand; PAM type: NRG; PAM sequence: GAG
atttaatgtctctatatata

SEQ ID NO: 47189 - DNA, 20 bp, Artificial Sequence
  Description of Artificial Sequence: Synthetic oligonucleotide
  Target: ATXN1; (-) strand; PAM type: NRG; PAM sequence: TAG
gaatttaatgtctctatata

SEQ ID NO: 47190 - DNA, 20 bp, Artificial Sequence
  Description of Artificial Sequence: Synthetic oligonucleotide
  Target: ATXN1; (-) strand; PAM type: NRG; PAM sequence: TGG
aataatcactattacccttt

SEQ ID NO: 47191 - DNA, 20 bp, Artificial Sequence
  Description of Artificial Sequence: Synthetic oligonucleotide
  Target: ATXN1; (-) strand; PAM type: NRG; PAM sequence: AGG
gtttcagaaacagaatgtga

SEQ ID NO: 47192 - DNA, 20 bp, Artificial Sequence
  Description of Artificial Sequence: Synthetic oligonucleotide
  Target: ATXN1; (-) strand; PAM type: NRG; PAM sequence: AAG
tgtttcagaaacagaatgtg

SEQ ID NO: 47193 - DNA, 20 bp, Artificial Sequence
  Description of Artificial Sequence: Synthetic oligonucleotide
  Target: ATXN1; (-) strand; PAM type: NRG; PAM sequence: CAG
cttgaatcctgtttcagaaa

SEQ ID NO: 47194 - DNA, 20 bp, Artificial Sequence
  Description of Artificial Sequence: Synthetic oligonucleotide
  Target: ATXN1; (-) strand; PAM type: NRG; PAM sequence: CAG
gtcctgcttgaatcctgttt

SEQ ID NO: 47195 - DNA, 20 bp, Artificial Sequence
  Description of Artificial Sequence: Synthetic oligonucleotide
  Target: ATXN1; (-) strand; PAM type: NRG; PAM sequence: TGG
cgaaaataatgaataccaaa

SEQ ID NO: 47196 - DNA, 20 bp, Artificial Sequence
  Description of Artificial Sequence: Synthetic oligonucleotide
  Target: ATXN1; (-) strand; PAM type: NRG; PAM sequence: TAG
ctgaatgctgtagaaataat

SEQ ID NO: 47197 - DNA, 20 bp, Artificial Sequence
  Description of Artificial Sequence: Synthetic oligonucleotide
  Target: ATXN1; (-) strand; PAM type: NRG; PAM sequence: TAG
ttaaagagatctgaatgctg

SEQ ID NO: 47198 - DNA, 20 bp, Artificial Sequence
  Description of Artificial Sequence: Synthetic oligonucleotide
  Target: ATXN1; (-) strand; PAM type: NRG; PAM sequence: GAG
caaaacatgtttgttttaaa

SEQ ID NO: 47199 - DNA, 20 bp, Artificial Sequence
  Description of Artificial Sequence: Synthetic oligonucleotide
  Target: ATXN1; (-) strand; PAM type: NRG; PAM sequence: AAG
tgcaaaacatgtttgtttta

SEQ ID NO: 47200 - DNA, 20 bp, Artificial Sequence
  Description of Artificial Sequence: Synthetic oligonucleotide
  Target: ATXN1; (-) strand; PAM type: NRG; PAM sequence: GGG
aaaggcatatttttaaaggt

SEQ ID NO: 47201 - DNA, 20 bp, Artificial Sequence
  Description of Artificial Sequence: Synthetic oligonucleotide
  Target: ATXN1; (-) strand; PAM type: NRG; PAM sequence: TGG
aaaaggcatatttttaaagg

SEQ ID NO: 47202 - DNA, 20 bp, Artificial Sequence
  Description of Artificial Sequence: Synthetic oligonucleotide
  Target: ATXN1; (-) strand; PAM type: NRG; PAM sequence: AGG
gataaaaggcatatttttaa

SEQ ID NO: 47203 - DNA, 20 bp, Artificial Sequence
  Description of Artificial Sequence: Synthetic oligonucleotide
  Target: ATXN1; (-) strand; PAM type: NRG; PAM sequence: AAG
ggataaaaggcatattttta

SEQ ID NO: 47204 - DNA, 20 bp, Artificial Sequence
  Description of Artificial Sequence: Synthetic oligonucleotide
  Target: ATXN1; (-) strand; PAM type: NRG; PAM sequence: AGG
gctgtggaaaaggggataaa

SEQ ID NO: 47205 - DNA, 20 bp, Artificial Sequence
  Description of Artificial Sequence: Synthetic oligonucleotide
  Target: ATXN1; (-) strand; PAM type: NRG; PAM sequence: AAG
ggctgtggaaaaggggataa

SEQ ID NO: 47206 - DNA, 20 bp, Artificial Sequence
  Description of Artificial Sequence: Synthetic oligonucleotide
  Target: ATXN1; (-) strand; PAM type: NRG; PAM sequence: GGG
tcctcaaggctgtggaaaag

SEQ ID NO: 47207 - DNA, 20 bp, Artificial Sequence
  Description of Artificial Sequence: Synthetic oligonucleotide
  Target: ATXN1; (-) strand; PAM type: NRG; PAM sequence: GGG
ttcctcaaggctgtggaaaa

SEQ ID NO: 47208 - DNA, 20 bp, Artificial Sequence
  Description of Artificial Sequence: Synthetic oligonucleotide
  Target: ATXN1; (-) strand; PAM type: NRG; PAM sequence: AGG
tttcctcaaggctgtggaaa

SEQ ID NO: 47209 - DNA, 20 bp, Artificial Sequence
  Description of Artificial Sequence: Synthetic oligonucleotide
  Target: ATXN1; (-) strand; PAM type: NRG; PAM sequence: AAG
atttcctcaaggctgtggaa

SEQ ID NO: 47210 - DNA, 20 bp, Artificial Sequence
  Description of Artificial Sequence: Synthetic oligonucleotide
  Target: ATXN1; (-) strand; PAM type: NRG; PAM sequence: TGG
cagatatttcctcaaggctg

SEQ ID NO: 47211 - DNA, 20 bp, Artificial Sequence
  Description of Artificial Sequence: Synthetic oligonucleotide
  Target: ATXN1; (-) strand; PAM type: NRG; PAM sequence: AGG
atccatcagatatttcctca

SEQ ID NO: 47212 - DNA, 20 bp, Artificial Sequence
  Description of Artificial Sequence: Synthetic oligonucleotide
  Target: ATXN1; (-) strand; PAM type: NRG; PAM sequence: AAG
aatccatcagatatttcctc

SEQ ID NO: 47213 - DNA, 20 bp, Artificial Sequence
  Description of Artificial Sequence: Synthetic oligonucleotide
  Target: ATXN1; (-) strand; PAM type: NRG; PAM sequence: CAG
ctgctcctgagacaatccat

SEQ ID NO: 47214 - DNA, 20 bp, Artificial Sequence
  Description of Artificial Sequence: Synthetic oligonucleotide
  Target: ATXN1; (-) strand; PAM type: NRG; PAM sequence: GAG
attcccaaaacactgctcct

SEQ ID NO: 47215 - DNA, 20 bp, Artificial Sequence
  Description of Artificial Sequence: Synthetic oligonucleotide
  Target: ATXN1; (-) strand; PAM type: NRG; PAM sequence: TAG
ggggacaagttacgtttttt

SEQ ID NO: 47216 - DNA, 20 bp, Artificial Sequence
  Description of Artificial Sequence: Synthetic oligonucleotide
  Target: ATXN1; (-) strand; PAM type: NRG; PAM sequence: AAG
ttatgcaagttttaggggac

SEQ ID NO: 47217 - DNA, 20 bp, Artificial Sequence
  Description of Artificial Sequence: Synthetic oligonucleotide
  Target: ATXN1; (-) strand; PAM type: NRG; PAM sequence: GGG
tttgtttatgcaagttttag

SEQ ID NO: 47218 - DNA, 20 bp, Artificial Sequence
  Description of Artificial Sequence: Synthetic oligonucleotide
  Target: ATXN1; (-) strand; PAM type: NRG; PAM sequence: GGG
atttgtttatgcaagtttta

SEQ ID NO: 47219 - DNA, 20 bp, Artificial Sequence
  Description of Artificial Sequence: Synthetic oligonucleotide
  Target: ATXN1; (-) strand; PAM type: NRG; PAM sequence: AGG
gatttgtttatgcaagtttt

SEQ ID NO: 47220 - DNA, 20 bp, Artificial Sequence
  Description of Artificial Sequence: Synthetic oligonucleotide
  Target: ATXN1; (-) strand; PAM type: NRG; PAM sequence: TAG
tgatttgtttatgcaagttt

SEQ ID NO: 47221 - DNA, 20 bp, Artificial Sequence
  Description of Artificial Sequence: Synthetic oligonucleotide
  Target: ATXN1; (-) strand; PAM type: NRG; PAM sequence: AAG
gtcctttgatttgtttatgc

SEQ ID NO: 47222 - DNA, 20 bp, Artificial Sequence
  Description of Artificial Sequence: Synthetic oligonucleotide
  Target: ATXN1; (-) strand; PAM type: NRG; PAM sequence: GAG
agatctgcaagttaagttga

SEQ ID NO: 47223 - DNA, 20 bp, Artificial Sequence
  Description of Artificial Sequence: Synthetic oligonucleotide
  Target: ATXN1; (-) strand; PAM type: NRG; PAM sequence: GAG
aaagatctgcaagttaagtt

SEQ ID NO: 47224 - DNA, 20 bp, Artificial Sequence
  Description of Artificial Sequence: Synthetic oligonucleotide
  Target: ATXN1; (-) strand; PAM type: NRG; PAM sequence: AAG
taaaaaaagatctgcaagtt

SEQ ID NO: 47225 - DNA, 20 bp, Artificial Sequence
  Description of Artificial Sequence: Synthetic oligonucleotide
  Target: ATXN1; (-) strand; PAM type: NRG; PAM sequence: AAG
aacattaaaaaaagatctgc

SEQ ID NO: 47226 - DNA, 20 bp, Artificial Sequence
  Description of Artificial Sequence: Synthetic oligonucleotide
  Target: ATXN1; (-) strand; PAM type: NRG; PAM sequence: AAG
ttattactgaacattaaaaa

SEQ ID NO: 47227 - DNA, 20 bp, Artificial Sequence
  Description of Artificial Sequence: Synthetic oligonucleotide
  Target: ATXN1; (-) strand; PAM type: NRG; PAM sequence: GAG
aggacagtgtaatcttctgg

SEQ ID NO: 47228 - DNA, 20 bp, Artificial Sequence
  Description of Artificial Sequence: Synthetic oligonucleotide
  Target: ATXN1; (-) strand; PAM type: NRG; PAM sequence: GGG
agaggacagtgtaatcttct

SEQ ID NO: 47229 - DNA, 20 bp, Artificial Sequence
  Description of Artificial Sequence: Synthetic oligonucleotide
  Target: ATXN1; (-) strand; PAM type: NRG; PAM sequence: TGG
gagaggacagtgtaatcttc

SEQ ID NO: 47230 - DNA, 20 bp, Artificial Sequence
  Description of Artificial Sequence: Synthetic oligonucleotide
  Target: ATXN1; (-) strand; PAM type: NRG; PAM sequence: CAG
aagtttgggaagagagagga

SEQ ID NO: 47231 - DNA, 20 bp, Artificial Sequence
  Description of Artificial Sequence: Synthetic oligonucleotide
  Target: ATXN1; (-) strand; PAM type: NRG; PAM sequence: AGG
ggagaagtttgggaagagag

SEQ ID NO: 47232 - DNA, 20 bp, Artificial Sequence
  Description of Artificial Sequence: Synthetic oligonucleotide
  Target: ATXN1; (-) strand; PAM type: NRG; PAM sequence: GAG
aggagaagtttgggaagaga

SEQ ID NO: 47233 - DNA, 20 bp, Artificial Sequence
  Description of Artificial Sequence: Synthetic oligonucleotide
  Target: ATXN1; (-) strand; PAM type: NRG; PAM sequence: GAG
ggaggagaagtttgggaaga

SEQ ID NO: 47234 - DNA, 20 bp, Artificial Sequence
  Description of Artificial Sequence: Synthetic oligonucleotide
  Target: ATXN1; (-) strand; PAM type: NRG; PAM sequence: GAG
gaggaggagaagtttgggaa

SEQ ID NO: 47235 - DNA, 20 bp, Artificial Sequence
  Description of Artificial Sequence: Synthetic oligonucleotide
  Target: ATXN1; (-) strand; PAM type: NRG; PAM sequence: AAG
aggaggaggagaagtttggg

SEQ ID NO: 47236 - DNA, 20 bp, Artificial Sequence
  Description of Artificial Sequence: Synthetic oligonucleotide
  Target: ATXN1; (-) strand; PAM type: NRG; PAM sequence: GGG
tgtaggaggaggagaagttt

SEQ ID NO: 47237 - DNA, 20 bp, Artificial Sequence
  Description of Artificial Sequence: Synthetic oligonucleotide
  Target: ATXN1; (-) strand; PAM type: NRG; PAM sequence: TGG
ttgtaggaggaggagaagtt

SEQ ID NO: 47238 - DNA, 20 bp, Artificial Sequence
  Description of Artificial Sequence: Synthetic oligonucleotide
  Target: ATXN1; (-) strand; PAM type: NRG; PAM sequence: AAG
ggggattgtaggaggaggag

SEQ ID NO: 47239 - DNA, 20 bp, Artificial Sequence
  Description of Artificial Sequence: Synthetic oligonucleotide
  Target: ATXN1; (-) strand; PAM type: NRG; PAM sequence: GAG
ctgggggattgtaggaggag

SEQ ID NO: 47240 - DNA, 20 bp, Artificial Sequence
  Description of Artificial Sequence: Synthetic oligonucleotide
  Target: ATXN1; (-) strand; PAM type: NRG; PAM sequence: AGG
aactgggggattgtaggagg

SEQ ID NO: 47241 - DNA, 20 bp, Artificial Sequence
  Description of Artificial Sequence: Synthetic oligonucleotide
  Target: ATXN1; (-) strand; PAM type: NRG; PAM sequence: GAG
caactgggggattgtaggag

SEQ ID NO: 47242 - DNA, 20 bp, Artificial Sequence
  Description of Artificial Sequence: Synthetic oligonucleotide
  Target: ATXN1; (-) strand; PAM type: NRG; PAM sequence: AGG
aacaactgggggattgtagg

SEQ ID NO: 47243 - DNA, 20 bp, Artificial Sequence
  Description of Artificial Sequence: Synthetic oligonucleotide
  Target: ATXN1; (-) strand; PAM type: NRG; PAM sequence: GAG
aaacaactgggggattgtag

SEQ ID NO: 47244 - DNA, 20 bp, Artificial Sequence
  Description of Artificial Sequence: Synthetic oligonucleotide
  Target: ATXN1; (-) strand; PAM type: NRG; PAM sequence: AGG
taaaacaactgggggattgt

SEQ ID NO: 47245 - DNA, 20 bp, Artificial Sequence
  Description of Artificial Sequence: Synthetic oligonucleotide
  Target: ATXN1; (-) strand; PAM type: NRG; PAM sequence: TAG
ttaaaacaactgggggattg

SEQ ID NO: 47246 - DNA, 20 bp, Artificial Sequence
  Description of Artificial Sequence: Synthetic oligonucleotide
  Target: ATXN1; (-) strand; PAM type: NRG; PAM sequence: GGG
tctgacattaaaacaactgg

SEQ ID NO: 47247 - DNA, 20 bp, Artificial Sequence
  Description of Artificial Sequence: Synthetic oligonucleotide
  Target: ATXN1; (-) strand; PAM type: NRG; PAM sequence: GGG
atctgacattaaaacaactg

SEQ ID NO: 47248 - DNA, 20 bp, Artificial Sequence
  Description of Artificial Sequence: Synthetic oligonucleotide
  Target: ATXN1; (-) strand; PAM type: NRG; PAM sequence: GGG
catctgacattaaaacaact

SEQ ID NO: 47249 - DNA, 20 bp, Artificial Sequence
  Description of Artificial Sequence: Synthetic oligonucleotide
  Target: ATXN1; (-) strand; PAM type: NRG; PAM sequence: TGG
gcatctgacattaaaacaac

SEQ ID NO: 47250 - DNA, 20 bp, Artificial Sequence
  Description of Artificial Sequence: Synthetic oligonucleotide
  Target: ATXN1; (-) strand; PAM type: NRG; PAM sequence: CAG
ttcccataatgagttcaagc

SEQ ID NO: 47251 - DNA, 20 bp, Artificial Sequence
  Description of Artificial Sequence: Synthetic oligonucleotide
  Target: ATXN1; (-) strand; PAM type: NRG; PAM sequence: AAG
atgattcccataatgagttc

SEQ ID NO: 47252 - DNA, 20 bp, Artificial Sequence
  Description of Artificial Sequence: Synthetic oligonucleotide
  Target: ATXN1; (-) strand; PAM type: NRG; PAM sequence: GAG
aatgtaatgattcccataat

SEQ ID NO: 47253 - DNA, 20 bp, Artificial Sequence
  Description of Artificial Sequence: Synthetic oligonucleotide
  Target: ATXN1; (-) strand; PAM type: NRG; PAM sequence: AGG
tcagtcaaggctggcctcac

SEQ ID NO: 47254 - DNA, 20 bp, Artificial Sequence
  Description of Artificial Sequence: Synthetic oligonucleotide
  Target: ATXN1; (-) strand; PAM type: NRG; PAM sequence: CAG
ctcagtcaaggctggcctca

SEQ ID NO: 47255 - DNA, 20 bp, Artificial Sequence
  Description of Artificial Sequence: Synthetic oligonucleotide
  Target: ATXN1; (-) strand; PAM type: NRG; PAM sequence: TGG
agaagaccctcagtcaaggc

SEQ ID NO: 47256 - DNA, 20 bp, Artificial Sequence
  Description of Artificial Sequence: Synthetic oligonucleotide
  Target: ATXN1; (-) strand; PAM type: NRG; PAM sequence: AGG
aatcagaagaccctcagtca

SEQ ID NO: 47257 - DNA, 20 bp, Artificial Sequence
  Description of Artificial Sequence: Synthetic oligonucleotide
  Target: ATXN1; (-) strand; PAM type: NRG; PAM sequence: AAG
gaatcagaagaccctcagtc

SEQ ID NO: 47258 - DNA, 20 bp, Artificial Sequence
  Description of Artificial Sequence: Synthetic oligonucleotide
  Target: ATXN1; (-) strand; PAM type: NRG; PAM sequence: CAG
atttagaatcagaagaccct

SEQ ID NO: 47259 - DNA, 20 bp, Artificial Sequence
  Description of Artificial Sequence: Synthetic oligonucleotide
  Target: ATXN1; (-) strand; PAM type: NRG; PAM sequence: AAG
cattgaccatttagaatcag

SEQ ID NO: 47260 - DNA, 20 bp, Artificial Sequence
  Description of Artificial Sequence: Synthetic oligonucleotide
  Target: ATXN1; (-) strand; PAM type: NRG; PAM sequence: CAG
aaacattgaccatttagaat

SEQ ID NO: 47261 - DNA, 20 bp, Artificial Sequence
  Description of Artificial Sequence: Synthetic oligonucleotide
  Target: ATXN1; (-) strand; PAM type: NRG; PAM sequence: TAG
ctacagaaacattgaccatt

SEQ ID NO: 47262 - DNA, 20 bp, Artificial Sequence
  Description of Artificial Sequence: Synthetic oligonucleotide
  Target: ATXN1; (-) strand; PAM type: NRG; PAM sequence: CAG
gagaatgattcctgacacta

SEQ ID NO: 47263 - DNA, 20 bp, Artificial Sequence
  Description of Artificial Sequence: Synthetic oligonucleotide
  Target: ATXN1; (-) strand; PAM type: NRG; PAM sequence: GAG
aagaaggtgaagcattttca

SEQ ID NO: 47264 - DNA, 20 bp, Artificial Sequence
  Description of Artificial Sequence: Synthetic oligonucleotide
  Target: ATXN1; (-) strand; PAM type: NRG; PAM sequence: CAG
tcaagaaggtgaagcatttt

SEQ ID NO: 47265 - DNA, 20 bp, Artificial Sequence
  Description of Artificial Sequence: Synthetic oligonucleotide
  Target: ATXN1; (-) strand; PAM type: NRG; PAM sequence: AAG
cccacagcctcaagaaggtg

SEQ ID NO: 47266 - DNA, 20 bp, Artificial Sequence
  Description of Artificial Sequence: Synthetic oligonucleotide
  Target: ATXN1; (-) strand; PAM type: NRG; PAM sequence: AGG
acatgcccacagcctcaaga

SEQ ID NO: 47267 - DNA, 20 bp, Artificial Sequence
  Description of Artificial Sequence: Synthetic oligonucleotide
  Target: ATXN1; (-) strand; PAM type: NRG; PAM sequence: AAG
cacatgcccacagcctcaag

SEQ ID NO: 47268 - DNA, 20 bp, Artificial Sequence
  Description of Artificial Sequence: Synthetic oligonucleotide
  Target: ATXN1; (-) strand; PAM type: NRG; PAM sequence: AAG
ggccacatgcccacagcctc

SEQ ID NO: 47269 - DNA, 20 bp, Artificial Sequence
  Description of Artificial Sequence: Synthetic oligonucleotide
  Target: ATXN1; (-) strand; PAM type: NRG; PAM sequence: CAG
ttcatatggccacatgccca

SEQ ID NO: 47270 - DNA, 20 bp, Artificial Sequence
  Description of Artificial Sequence: Synthetic oligonucleotide
  Target: ATXN1; (-) strand; PAM type: NRG; PAM sequence: TGG
tcacacaacatgttttcata

SEQ ID NO: 47271 - DNA, 20 bp, Artificial Sequence
  Description of Artificial Sequence: Synthetic oligonucleotide
  Target: ATXN1; (-) strand; PAM type: NRG; PAM sequence: CAG
gaggagtcccccaatttcac

SEQ ID NO: 47272 - DNA, 20 bp, Artificial Sequence
  Description of Artificial Sequence: Synthetic oligonucleotide
  Target: ATXN1; (-) strand; PAM type: NRG; PAM sequence: GAG
ctcctagttcgctggatgag

SEQ ID NO: 47273 - DNA, 20 bp, Artificial Sequence
  Description of Artificial Sequence: Synthetic oligonucleotide
  Target: ATXN1; (-) strand; PAM type: NRG; PAM sequence: AGG
acctcctagttcgctggatg

SEQ ID NO: 47274 - DNA, 20 bp, Artificial Sequence
  Description of Artificial Sequence: Synthetic oligonucleotide
  Target: ATXN1; (-) strand; PAM type: NRG; PAM sequence: GAG
aacctcctagttcgctggat

SEQ ID NO: 47275 - DNA, 20 bp, Artificial Sequence
  Description of Artificial Sequence: Synthetic oligonucleotide
  Target: ATXN1; (-) strand; PAM type: NRG; PAM sequence: TGG
cacagaacctcctagttcgc

SEQ ID NO: 47276 - DNA, 20 bp, Artificial Sequence
  Description of Artificial Sequence: Synthetic oligonucleotide
  Target: ATXN1; (-) strand; PAM type: NRG; PAM sequence: TAG
aaggaacacacagaacctcc

SEQ ID NO: 47277 - DNA, 20 bp, Artificial Sequence
  Description of Artificial Sequence: Synthetic oligonucleotide
  Target: ATXN1; (-) strand; PAM type: NRG; PAM sequence: CAG
aattcaggtgaaggaacaca

SEQ ID NO: 47278 - DNA, 20 bp, Artificial Sequence
  Description of Artificial Sequence: Synthetic oligonucleotide
  Target: ATXN1; (-) strand; PAM type: NRG; PAM sequence: AGG
agacccagcaattcaggtga

SEQ ID NO: 47279 - DNA, 20 bp, Artificial Sequence
  Description of Artificial Sequence: Synthetic oligonucleotide
  Target: ATXN1; (-) strand; PAM type: NRG; PAM sequence: AAG
cagacccagcaattcaggtg

SEQ ID NO: 47280 - DNA, 20 bp, Artificial Sequence
  Description of Artificial Sequence: Synthetic oligonucleotide
  Target: ATXN1; (-) strand; PAM type: NRG; PAM sequence: AGG
cacgtcagacccagcaattc

SEQ ID NO: 47281 - DNA, 20 bp, Artificial Sequence
  Description of Artificial Sequence: Synthetic oligonucleotide
  Target: ATXN1; (-) strand; PAM type: NRG; PAM sequence: CAG
acacgtcagacccagcaatt

SEQ ID NO: 47282 - DNA, 20 bp, Artificial Sequence
  Description of Artificial Sequence: Synthetic oligonucleotide
  Target: ATXN1; (-) strand; PAM type: NRG; PAM sequence: CAG
ggccatccacacgtcagacc

SEQ ID NO: 47283 - DNA, 20 bp, Artificial Sequence
  Description of Artificial Sequence: Synthetic oligonucleotide
  Target: ATXN1; (-) strand; PAM type: NRG; PAM sequence: CAG
aacaaaggccatccacacgt

SEQ ID NO: 47284 - DNA, 20 bp, Artificial Sequence
  Description of Artificial Sequence: Synthetic oligonucleotide
  Target: ATXN1; (-) strand; PAM type: NRG; PAM sequence: AGG
ctcacccagcaagggaacaa

SEQ ID NO: 47285 - DNA, 20 bp, Artificial Sequence
  Description of Artificial Sequence: Synthetic oligonucleotide
  Target: ATXN1; (-) strand; PAM type: NRG; PAM sequence: AAG
gctcacccagcaagggaaca

SEQ ID NO: 47286 - DNA, 20 bp, Artificial Sequence
  Description of Artificial Sequence: Synthetic oligonucleotide
  Target: ATXN1; (-) strand; PAM type: NRG; PAM sequence: GGG
tgacccggctcacccagcaa

SEQ ID NO: 47287 - DNA, 20 bp, Artificial Sequence
  Description of Artificial Sequence: Synthetic oligonucleotide
  Target: ATXN1; (-) strand; PAM type: NRG; PAM sequence: AGG
ctgacccggctcacccagca

SEQ ID NO: 47288 - DNA, 20 bp, Artificial Sequence
  Description of Artificial Sequence: Synthetic oligonucleotide
  Target: ATXN1; (-) strand; PAM type: NRG; PAM sequence: AAG
gctgacccggctcacccagc

SEQ ID NO: 47289 - DNA, 20 bp, Artificial Sequence
  Description of Artificial Sequence: Synthetic oligonucleotide
  Target: ATXN1; (-) strand; PAM type: NRG; PAM sequence: CAG
cagggctgacccggctcacc

SEQ ID NO: 47290 - DNA, 20 bp, Artificial Sequence
  Description of Artificial Sequence: Synthetic oligonucleotide
  Target: ATXN1; (-) strand; PAM type: NRG; PAM sequence: CGG
aagacacagcagggctgacc

SEQ ID NO: 47291 - DNA, 20 bp, Artificial Sequence
  Description of Artificial Sequence: Synthetic oligonucleotide
  Target: ATXN1; (-) strand; PAM type: NRG; PAM sequence: GGG
agttatgacaagacacagca

SEQ ID NO: 47292 - DNA, 20 bp, Artificial Sequence
  Description of Artificial Sequence: Synthetic oligonucleotide
  Target: ATXN1; (-) strand; PAM type: NRG; PAM sequence: AGG
cagttatgacaagacacagc

SEQ ID NO: 47293 - DNA, 20 bp, Artificial Sequence
  Description of Artificial Sequence: Synthetic oligonucleotide
  Target: ATXN1; (-) strand; PAM type: NRG; PAM sequence: CAG
acagttatgacaagacacag

SEQ ID NO: 47294 - DNA, 20 bp, Artificial Sequence
  Description of Artificial Sequence: Synthetic oligonucleotide
  Target: ATXN1; (-) strand; PAM type: NRG; PAM sequence: CAG
tctacagttatgacaagaca

SEQ ID NO: 47295 - DNA, 20 bp, Artificial Sequence
  Description of Artificial Sequence: Synthetic oligonucleotide
  Target: ATXN1; (-) strand; PAM type: NRG; PAM sequence: AAG
ggaatgtctacagttatgac

SEQ ID NO: 47296 - DNA, 20 bp, Artificial Sequence
  Description of Artificial Sequence: Synthetic oligonucleotide
  Target: ATXN1; (-) strand; PAM type: NRG; PAM sequence: CAG
caccagttacggaatgtcta

SEQ ID NO: 47297 - DNA, 20 bp, Artificial Sequence
  Description of Artificial Sequence: Synthetic oligonucleotide
  Target: ATXN1; (-) strand; PAM type: NRG; PAM sequence: CGG
agttacatgaacaccagtta

SEQ ID NO: 47298 - DNA, 20 bp, Artificial Sequence
  Description of Artificial Sequence: Synthetic oligonucleotide
  Target: ATXN1; (-) strand; PAM type: NRG; PAM sequence: CAG
tccagcagttacatgaacac

SEQ ID NO: 47299 - DNA, 20 bp, Artificial Sequence
  Description of Artificial Sequence: Synthetic oligonucleotide
  Target: ATXN1; (-) strand; PAM type: NRG; PAM sequence: CAG
tggtttgaagcaagctccag

SEQ ID NO: 47300 - DNA, 20 bp, Artificial Sequence
  Description of Artificial Sequence: Synthetic oligonucleotide
  Target: ATXN1; (-) strand; PAM type: NRG; PAM sequence: CAG
ccttggtttgaagcaagctc

SEQ ID NO: 47301 - DNA, 20 bp, Artificial Sequence
  Description of Artificial Sequence: Synthetic oligonucleotide
  Target: ATXN1; (-) strand; PAM type: NRG; PAM sequence: AAG
tttctgccttggtttgaagc

SEQ ID NO: 47302 - DNA, 20 bp, Artificial Sequence
  Description of Artificial Sequence: Synthetic oligonucleotide
  Target: ATXN1; (-) strand; PAM type: NRG; PAM sequence: AAG
cgggtttctgccttggtttg

SEQ ID NO: 47303 - DNA, 20 bp, Artificial Sequence
  Description of Artificial Sequence: Synthetic oligonucleotide
  Target: ATXN1; (-) strand; PAM type: NRG; PAM sequence: TGG
atcgtcacgggtttctgcct

SEQ ID NO: 47304 - DNA, 20 bp, Artificial Sequence
  Description of Artificial Sequence: Synthetic oligonucleotide
  Target: ATXN1; (-) strand; PAM type: NRG; PAM sequence: GGG
agaatggtctccatcgtcac

SEQ ID NO: 47305 - DNA, 20 bp, Artificial Sequence
  Description of Artificial Sequence: Synthetic oligonucleotide
  Target: ATXN1; (-) strand; PAM type: NRG; PAM sequence: CGG
aagaatggtctccatcgtca

SEQ ID NO: 47306 - DNA, 20 bp, Artificial Sequence
  Description of Artificial Sequence: Synthetic oligonucleotide
  Target: ATXN1; (-) strand; PAM type: NRG; PAM sequence: TGG
atgtgaggggaaggcaagaa

SEQ ID NO: 47307 - DNA, 20 bp, Artificial Sequence
  Description of Artificial Sequence: Synthetic oligonucleotide
  Target: ATXN1; (-) strand; PAM type: NRG; PAM sequence: AAG
ggttaatgtgaggggaaggc

SEQ ID NO: 47308 - DNA, 20 bp, Artificial Sequence
  Description of Artificial Sequence: Synthetic oligonucleotide
  Target: ATXN1; (-) strand; PAM type: NRG; PAM sequence: AGG
aactggttaatgtgagggga

SEQ ID NO: 47309 - DNA, 20 bp, Artificial Sequence
  Description of Artificial Sequence: Synthetic oligonucleotide
  Target: ATXN1; (-) strand; PAM type: NRG; PAM sequence: AAG
gaactggttaatgtgagggg

SEQ ID NO: 47310 - DNA, 20 bp, Artificial Sequence
  Description of Artificial Sequence: Synthetic oligonucleotide
  Target: ATXN1; (-) strand; PAM type: NRG; PAM sequence: GGG
cacgaactggttaatgtgag

SEQ ID NO: 47311 - DNA, 20 bp, Artificial Sequence
  Description of Artificial Sequence: Synthetic oligonucleotide
  Target: ATXN1; (-) strand; PAM type: NRG; PAM sequence: GGG
tcacgaactggttaatgtga

SEQ ID NO: 47312 - DNA, 20 bp, Artificial Sequence
  Description of Artificial Sequence: Synthetic oligonucleotide
  Target: ATXN1; (-) strand; PAM type: NRG; PAM sequence: AGG
gtcacgaactggttaatgtg

SEQ ID NO: 47313 - DNA, 20 bp, Artificial Sequence
  Description of Artificial Sequence: Synthetic oligonucleotide
  Target: ATXN1; (-) strand; PAM type: NRG; PAM sequence: GAG
agtcacgaactggttaatgt

SEQ ID NO: 47314 - DNA, 20 bp, Artificial Sequence
  Description of Artificial Sequence: Synthetic oligonucleotide
  Target: ATXN1; (-) strand; PAM type: NRG; PAM sequence: TGG
gtttctccatagtcacgaac

SEQ ID NO: 47315 - DNA, 20 bp, Artificial Sequence
  Description of Artificial Sequence: Synthetic oligonucleotide
  Target: ATXN1; (-) strand; PAM type: NRG; PAM sequence: TAG
ctacttgccctgtttctcca

SEQ ID NO: 47316 - DNA, 20 bp, Artificial Sequence
  Description of Artificial Sequence: Synthetic oligonucleotide
  Target: ATXN1; (-) strand; PAM type: NRG; PAM sequence: GAG
catccgtccagtcagatcaa

SEQ ID NO: 47317 - DNA, 20 bp, Artificial Sequence
  Description of Artificial Sequence: Synthetic oligonucleotide
  Target: ATXN1; (-) strand; PAM type: NRG; PAM sequence: AAG
gccatccgtccagtcagatc

SEQ ID NO: 47318 - DNA, 20 bp, Artificial Sequence
  Description of Artificial Sequence: Synthetic oligonucleotide
  Target: ATXN1; (-) strand; PAM type: NRG; PAM sequence: CAG
tccaaagccatccgtccagt

SEQ ID NO: 47319 - DNA, 20 bp, Artificial Sequence
  Description of Artificial Sequence: Synthetic oligonucleotide
  Target: ATXN1; (-) strand; PAM type: NRG; PAM sequence: CAG
ggtctccaaagccatccgtc

SEQ ID NO: 47320 - DNA, 20 bp, Artificial Sequence
  Description of Artificial Sequence: Synthetic oligonucleotide
  Target: ATXN1; (-) strand; PAM type: NRG; PAM sequence: AAG
tcttcagagcctggtctcca

SEQ ID NO: 47321 - DNA, 20 bp, Artificial Sequence
  Description of Artificial Sequence: Synthetic oligonucleotide
  Target: ATXN1; (-) strand; PAM type: NRG; PAM sequence: TGG
acaagcatctcttcagagcc

SEQ ID NO: 47322 - DNA, 20 bp, Artificial Sequence
  Description of Artificial Sequence: Synthetic oligonucleotide
  Target: ATXN1; (-) strand; PAM type: NRG; PAM sequence: GAG
tttttacaagcatctcttca

SEQ ID NO: 47323 - DNA, 20 bp, Artificial Sequence
  Description of Artificial Sequence: Synthetic oligonucleotide
  Target: ATXN1; (-) strand; PAM type: NRG; PAM sequence: CAG
gatttttacaagcatctctt

SEQ ID NO: 47324 - DNA, 20 bp, Artificial Sequence
  Description of Artificial Sequence: Synthetic oligonucleotide
  Target: ATXN1; (-) strand; PAM type: NRG; PAM sequence: AAG
gttaagctccagatttttac

SEQ ID NO: 47325 - DNA, 20 bp, Artificial Sequence
  Description of Artificial Sequence: Synthetic oligonucleotide
  Target: ATXN1; (-) strand; PAM type: NRG; PAM sequence: CAG
aagcttcttgtgttaagctc

SEQ ID NO: 47326 - DNA, 20 bp, Artificial Sequence
  Description of Artificial Sequence: Synthetic oligonucleotide
  Target: ATXN1; (-) strand; PAM type: NRG; PAM sequence: AAG
tgttttaagcttcttgtgtt

SEQ ID NO: 47327 - DNA, 20 bp, Artificial Sequence
  Description of Artificial Sequence: Synthetic oligonucleotide
  Target: ATXN1; (-) strand; PAM type: NRG; PAM sequence: AAG
ttaaaggagcttcttgtttt

SEQ ID NO: 47328 - DNA, 20 bp, Artificial Sequence
  Description of Artificial Sequence: Synthetic oligonucleotide
  Target: ATXN1; (-) strand; PAM type: NRG; PAM sequence: GAG
tgaagctccaacacttaaag

SEQ ID NO: 47329 - DNA, 20 bp, Artificial Sequence
  Description of Artificial Sequence: Synthetic oligonucleotide
  Target: ATXN1; (-) strand; PAM type: NRG; PAM sequence: AGG
tctgaagctccaacacttaa

SEQ ID NO: 47330 - DNA, 20 bp, Artificial Sequence
  Description of Artificial Sequence: Synthetic oligonucleotide
  Target: ATXN1; (-) strand; PAM type: NRG; PAM sequence: AAG
ctctgaagctccaacactta

SEQ ID NO: 47331 - DNA, 20 bp, Artificial Sequence
  Description of Artificial Sequence: Synthetic oligonucleotide
  Target: ATXN1; (-) strand; PAM type: NRG; PAM sequence: AAG
taacgtggctcctttctctg

SEQ ID NO: 47332 - DNA, 20 bp, Artificial Sequence
  Description of Artificial Sequence: Synthetic oligonucleotide
  Target: ATXN1; (-) strand; PAM type: NRG; PAM sequence: TGG
ctgctctgaaatgggtaacg

SEQ ID NO: 47333 - DNA, 20 bp, Artificial Sequence
  Description of Artificial Sequence: Synthetic oligonucleotide
  Target: ATXN1; (-) strand; PAM type: NRG; PAM sequence: GGG
gaatctccctgctctgaaat

SEQ ID NO: 47334 - DNA, 20 bp, Artificial Sequence
  Description of Artificial Sequence: Synthetic oligonucleotide
  Target: ATXN1; (-) strand; PAM type: NRG; PAM sequence: TGG
ggaatctccctgctctgaaa

SEQ ID NO: 47335 - DNA, 20 bp, Artificial Sequence
  Description of Artificial Sequence: Synthetic oligonucleotide
  Target: ATXN1; (-) strand; PAM type: NRG; PAM sequence: TGG
cgacacccaggtgacttctc

SEQ ID NO: 47336 - DNA, 20 bp, Artificial Sequence
  Description of Artificial Sequence: Synthetic oligonucleotide
  Target: ATXN1; (-) strand; PAM type: NRG; PAM sequence: AGG
gtgctcagaagccgacaccc

SEQ ID NO: 47337 - DNA, 20 bp, Artificial Sequence
  Description of Artificial Sequence: Synthetic oligonucleotide
  Target: ATXN1; (-) strand; PAM type: NRG; PAM sequence: CAG
agtgctcagaagccgacacc

SEQ ID NO: 47338 - DNA, 20 bp, Artificial Sequence
  Description of Artificial Sequence: Synthetic oligonucleotide
  Target: ATXN1; (-) strand; PAM type: NRG; PAM sequence: AAG
cgtgagaagacagtgctcag

SEQ ID NO: 47339 - DNA, 20 bp, Artificial Sequence
  Description of Artificial Sequence: Synthetic oligonucleotide
  Target: ATXN1; (-) strand; PAM type: NRG; PAM sequence: CAG
gagcgtgagaagacagtgct

SEQ ID NO: 47340 - DNA, 20 bp, Artificial Sequence
  Description of Artificial Sequence: Synthetic oligonucleotide
  Target: ATXN1; (-) strand; PAM type: NRG; PAM sequence: CAG
ggagtgtgagcgtgagaaga

SEQ ID NO: 47341 - DNA, 20 bp, Artificial Sequence
  Description of Artificial Sequence: Synthetic oligonucleotide
  Target: ATXN1; (-) strand; PAM type: NRG; PAM sequence: AAG
aggaggagtgtgagcgtgag

SEQ ID NO: 47342 - DNA, 20 bp, Artificial Sequence
  Description of Artificial Sequence: Synthetic oligonucleotide
  Target: ATXN1; (-) strand; PAM type: NRG; PAM sequence: GAG
aacaggaggagtgtgagcgt

SEQ ID NO: 47343 - DNA, 20 bp, Artificial Sequence
  Description of Artificial Sequence: Synthetic oligonucleotide
  Target: ATXN1; (-) strand; PAM type: NRG; PAM sequence: GAG
gccaggaacaggaggagtgt

SEQ ID NO: 47344 - DNA, 20 bp, Artificial Sequence
  Description of Artificial Sequence: Synthetic oligonucleotide
  Target: ATXN1; (-) strand; PAM type: NRG; PAM sequence: GAG
gtgggggccaggaacaggag

SEQ ID NO: 47345 - DNA, 20 bp, Artificial Sequence
  Description of Artificial Sequence: Synthetic oligonucleotide
  Target: ATXN1; (-) strand; PAM type: NRG; PAM sequence: AGG
gggtgggggccaggaacagg

SEQ ID NO: 47346 - DNA, 20 bp, Artificial Sequence
  Description of Artificial Sequence: Synthetic oligonucleotide
  Target: ATXN1; (-) strand; PAM type: NRG; PAM sequence: GAG
agggtgggggccaggaacag

SEQ ID NO: 47347 - DNA, 20 bp, Artificial Sequence
  Description of Artificial Sequence: Synthetic oligonucleotide
  Target: ATXN1; (-) strand; PAM type: NRG; PAM sequence: AGG
ggagggtgggggccaggaac

SEQ ID NO: 47348 - DNA, 20 bp, Artificial Sequence
  Description of Artificial Sequence: Synthetic oligonucleotide
  Target: ATXN1; (-) strand; PAM type: NRG; PAM sequence: CAG
gggagggtgggggccaggaa

SEQ ID NO: 47349 - DNA, 20 bp, Artificial Sequence
  Description of Artificial Sequence: Synthetic oligonucleotide
  Target: ATXN1; (-) strand; PAM type: NRG; PAM sequence: AGG
agagcgggagggtgggggcc

SEQ ID NO: 47350 - DNA, 20 bp, Artificial Sequence
  Description of Artificial Sequence: Synthetic oligonucleotide
  Target: ATXN1; (-) strand; PAM type: NRG; PAM sequence: CAG
gagagcgggagggtgggggc

SEQ ID NO: 47351 - DNA, 20 bp, Artificial Sequence
  Description of Artificial Sequence: Synthetic oligonucleotide
  Target: ATXN1; (-) strand; PAM type: NRG; PAM sequence: GGG
tgctgagagcgggagggtgg

SEQ ID NO: 47352 - DNA, 20 bp, Artificial Sequence
  Description of Artificial Sequence: Synthetic oligonucleotide
  Target: ATXN1; (-) strand; PAM type: NRG; PAM sequence: GGG
ctgctgagagcgggagggtg

SEQ ID NO: 47353 - DNA, 20 bp, Artificial Sequence
  Description of Artificial Sequence: Synthetic oligonucleotide
  Target: ATXN1; (-) strand; PAM type: NRG; PAM sequence: GGG
actgctgagagcgggagggt

SEQ ID NO: 47354 - DNA, 20 bp, Artificial Sequence
  Description of Artificial Sequence: Synthetic oligonucleotide
  Target: ATXN1; (-) strand; PAM type: NRG; PAM sequence: TGG
aactgctgagagcgggaggg

SEQ ID NO: 47355 - DNA, 20 bp, Artificial Sequence
  Description of Artificial Sequence: Synthetic oligonucleotide
  Target: ATXN1; (-) strand; PAM type: NRG; PAM sequence: GGG
ggtaactgctgagagcggga

SEQ ID NO: 47356 - DNA, 20 bp, Artificial Sequence
  Description of Artificial Sequence: Synthetic oligonucleotide
  Target: ATXN1; (-) strand; PAM type: NRG; PAM sequence: AGG
gggtaactgctgagagcggg

SEQ ID NO: 47357 - DNA, 20 bp, Artificial Sequence
  Description of Artificial Sequence: Synthetic oligonucleotide
  Target: ATXN1; (-) strand; PAM type: NRG; PAM sequence: GAG
ggggtaactgctgagagcgg

SEQ ID NO: 47358 - DNA, 20 bp, Artificial Sequence
  Description of Artificial Sequence: Synthetic oligonucleotide
  Target: ATXN1; (-) strand; PAM type: NRG; PAM sequence: GGG
tgggggtaactgctgagagc

SEQ ID NO: 47359 - DNA, 20 bp, Artificial Sequence
  Description of Artificial Sequence: Synthetic oligonucleotide
  Target: ATXN1; (-) strand; PAM type: NRG; PAM sequence: CGG
atgggggtaactgctgagag

SEQ ID NO: 47360 - DNA, 20 bp, Artificial Sequence
  Description of Artificial Sequence: Synthetic oligonucleotide
  Target: ATXN1; (-) strand; PAM type: NRG; PAM sequence: GAG
ataatgggggtaactgctga

SEQ ID NO: 47361 - DNA, 20 bp, Artificial Sequence
  Description of Artificial Sequence: Synthetic oligonucleotide
  Target: ATXN1; (-) strand; PAM type: NRG; PAM sequence: GAG
tgataatgggggtaactgct

SEQ ID NO: 47362 - DNA, 20 bp, Artificial Sequence
  Description of Artificial Sequence: Synthetic oligonucleotide
  Target: ATXN1; (-) strand; PAM type: NRG; PAM sequence: GGG
agtgatgatggtgataatgg

SEQ ID NO: 47363 - DNA, 20 bp, Artificial Sequence
  Description of Artificial Sequence: Synthetic oligonucleotide
  Target: ATXN1; (-) strand; PAM type: NRG; PAM sequence: GGG
aagtgatgatggtgataatg

SEQ ID NO: 47364 - DNA, 20 bp, Artificial Sequence
  Description of Artificial Sequence: Synthetic oligonucleotide
  Target: ATXN1; (-) strand; PAM type: NRG; PAM sequence: GGG
gaagtgatgatggtgataat

SEQ ID NO: 47365 - DNA, 20 bp, Artificial Sequence
  Description of Artificial Sequence: Synthetic oligonucleotide
  Target: ATXN1; (-) strand; PAM type: NRG; PAM sequence: TGG
cgaagtgatgatggtgataa

SEQ ID NO: 47366 - DNA, 20 bp, Artificial Sequence
  Description of Artificial Sequence: Synthetic oligonucleotide
  Target: ATXN1; (-) strand; PAM type: NRG; PAM sequence: TGG
gggcgggagcgaagtgatga

SEQ ID NO: 47367 - DNA, 20 bp, Artificial Sequence
  Description of Artificial Sequence: Synthetic oligonucleotide
  Target: ATXN1; (-) strand; PAM type: NRG; PAM sequence: AAG
agagggaccgggcgggagcg

SEQ ID NO: 47368 - DNA, 20 bp, Artificial Sequence
  Description of Artificial Sequence: Synthetic oligonucleotide
  Target: ATXN1; (-) strand; PAM type: NRG; PAM sequence: GAG
acaggagagggaccgggcgg

SEQ ID NO: 47369 - DNA, 20 bp, Artificial Sequence
  Description of Artificial Sequence: Synthetic oligonucleotide
  Target: ATXN1; (-) strand; PAM type: NRG; PAM sequence: GGG
tgacaggagagggaccgggc

SEQ ID NO: 47370 - DNA, 20 bp, Artificial Sequence
  Description of Artificial Sequence: Synthetic oligonucleotide
  Target: ATXN1; (-) strand; PAM type: NRG; PAM sequence: CGG
atgacaggagagggaccggg

SEQ ID NO: 47371 - DNA, 20 bp, Artificial Sequence
  Description of Artificial Sequence: Synthetic oligonucleotide
  Target: ATXN1; (-) strand; PAM type: NRG; PAM sequence: GGG
gtgatgacaggagagggacc

SEQ ID NO: 47372 - DNA, 20 bp, Artificial Sequence
  Description of Artificial Sequence: Synthetic oligonucleotide
  Target: ATXN1; (-) strand; PAM type: NRG; PAM sequence: CGG
ggtgatgacaggagagggac

SEQ ID NO: 47373 - DNA, 20 bp, Artificial Sequence
  Description of Artificial Sequence: Synthetic oligonucleotide
  Target: ATXN1; (-) strand; PAM type: NRG; PAM sequence: GGG
gcgggggtgatgacaggaga

SEQ ID NO: 47374 - DNA, 20 bp, Artificial Sequence
  Description of Artificial Sequence: Synthetic oligonucleotide
  Target: ATXN1; (-) strand; PAM type: NRG; PAM sequence: AGG
agcgggggtgatgacaggag

SEQ ID NO: 47375 - DNA, 20 bp, Artificial Sequence
  Description of Artificial Sequence: Synthetic oligonucleotide
  Target: ATXN1; (-) strand; PAM type: NRG; PAM sequence: GAG
gagcgggggtgatgacagga

SEQ ID NO: 47376 - DNA, 20 bp, Artificial Sequence
  Description of Artificial Sequence: Synthetic oligonucleotide
  Target: ATXN1; (-) strand; PAM type: NRG; PAM sequence: GAG
cggagcgggggtgatgacag

SEQ ID NO: 47377 - DNA, 20 bp, Artificial Sequence
  Description of Artificial Sequence: Synthetic oligonucleotide
  Target: ATXN1; (-) strand; PAM type: NRG; PAM sequence: AGG
tccggagcgggggtgatgac

SEQ ID NO: 47378 - DNA, 20 bp, Artificial Sequence
  Description of Artificial Sequence: Synthetic oligonucleotide
  Target: ATXN1; (-) strand; PAM type: NRG; PAM sequence: CAG
ctccggagcgggggtgatga

SEQ ID NO: 47379 - DNA, 20 bp, Artificial Sequence
  Description of Artificial Sequence: Synthetic oligonucleotide
  Target: ATXN1; (-) strand; PAM type: NRG; PAM sequence: GGG
tttctttcactccggagcgg

SEQ ID NO: 47380 - DNA, 20 bp, Artificial Sequence
  Description of Artificial Sequence: Synthetic oligonucleotide
  Target: ATXN1; (-) strand; PAM type: NRG; PAM sequence: GGG
ctttctttcactccggagcg

SEQ ID NO: 47381 - DNA, 20 bp, Artificial Sequence
  Description of Artificial Sequence: Synthetic oligonucleotide
  Target: ATXN1; (-) strand; PAM type: NRG; PAM sequence: GGG
cctttctttcactccggagc

SEQ ID NO: 47382 - DNA, 20 bp, Artificial Sequence
  Description of Artificial Sequence: Synthetic oligonucleotide
  Target: ATXN1; (-) strand; PAM type: NRG; PAM sequence: CGG
tcctttctttcactccggag

SEQ ID NO: 47383 - DNA, 20 bp, Artificial Sequence
  Description of Artificial Sequence: Synthetic oligonucleotide
  Target: ATXN1; (-) strand; PAM type: NRG; PAM sequence: GAG
gtctcctttctttcactccg

SEQ ID NO: 47384 - DNA, 20 bp, Artificial Sequence
  Description of Artificial Sequence: Synthetic oligonucleotide
  Target: ATXN1; (-) strand; PAM type: NRG; PAM sequence: CGG
gtgtctcctttctttcactc

SEQ ID NO: 47385 - DNA, 20 bp, Artificial Sequence
  Description of Artificial Sequence: Synthetic oligonucleotide
  Target: ATXN1; (-) strand; PAM type: NRG; PAM sequence: AGG
tggtgggaagagccgtggta

SEQ ID NO: 47386 - DNA, 20 bp, Artificial Sequence
  Description of Artificial Sequence: Synthetic oligonucleotide
  Target: ATXN1; (-) strand; PAM type: NRG; PAM sequence: AAG
ctggtgggaagagccgtggt

SEQ ID NO: 47387 - DNA, 20 bp, Artificial Sequence
  Description of Artificial Sequence: Synthetic oligonucleotide
  Target: ATXN1; (-) strand; PAM type: NRG; PAM sequence: TGG
gctgctggtgggaagagccg

SEQ ID NO: 47388 - DNA, 20 bp, Artificial Sequence
  Description of Artificial Sequence: Synthetic oligonucleotide
  Target: ATXN1; (-) strand; PAM type: NRG; PAM sequence: GAG
cctggtgctgctggtgggaa

SEQ ID NO: 47389 - DNA, 20 bp, Artificial Sequence
  Description of Artificial Sequence: Synthetic oligonucleotide
  Target: ATXN1; (-) strand; PAM type: NRG; PAM sequence: AAG
ttcctggtgctgctggtggg

SEQ ID NO: 47390 - DNA, 20 bp, Artificial Sequence
  Description of Artificial Sequence: Synthetic oligonucleotide
  Target: ATXN1; (-) strand; PAM type: NRG; PAM sequence: GGG
agcttcctggtgctgctggt

SEQ ID NO: 47391 - DNA, 20 bp, Artificial Sequence
  Description of Artificial Sequence: Synthetic oligonucleotide
  Target: ATXN1; (-) strand; PAM type: NRG; PAM sequence: TGG
cagcttcctggtgctgctgg

SEQ ID NO: 47392 - DNA, 20 bp, Artificial Sequence
  Description of Artificial Sequence: Synthetic oligonucleotide
  Target: ATXN1; (-) strand; PAM type: NRG; PAM sequence: TGG
tagcagcttcctggtgctgc

SEQ ID NO: 47393 - DNA, 20 bp, Artificial Sequence
  Description of Artificial Sequence: Synthetic oligonucleotide
  Target: ATXN1; (-) strand; PAM type: NRG; PAM sequence: TGG
aaatggcagtagcagcttcc

SEQ ID NO: 47394 - DNA, 20 bp, Artificial Sequence
  Description of Artificial Sequence: Synthetic oligonucleotide
  Target: ATXN1; (-) strand; PAM type: NRG; PAM sequence: CAG
ttaaatagaaatggcagtag

SEQ ID NO: 47395 - DNA, 20 bp, Artificial Sequence
  Description of Artificial Sequence: Synthetic oligonucleotide
  Target: ATXN1; (-) strand; PAM type: NRG; PAM sequence: TAG
catttaaatagaaatggcag

SEQ ID NO: 47396 - DNA, 20 bp, Artificial Sequence
  Description of Artificial Sequence: Synthetic oligonucleotide
  Target: ATXN1; (-) strand; PAM type: NRG; PAM sequence: CAG
atccatttaaatagaaatgg

SEQ ID NO: 47397 - DNA, 20 bp, Artificial Sequence
  Description of Artificial Sequence: Synthetic oligonucleotide
  Target: ATXN1; (-) strand; PAM type: NRG; PAM sequence: TGG
cctatccatttaaatagaaa

SEQ ID NO: 47398 - DNA, 20 bp, Artificial Sequence
  Description of Artificial Sequence: Synthetic oligonucleotide
  Target: ATXN1; (-) strand; PAM type: NRG; PAM sequence: TAG
aacatccctatccatttaaa

SEQ ID NO: 47399 - DNA, 20 bp, Artificial Sequence
  Description of Artificial Sequence: Synthetic oligonucleotide
  Target: ATXN1; (-) strand; PAM type: NRG; PAM sequence: AAG
cttaaacttacaggctccga

SEQ ID NO: 47400 - DNA, 20 bp, Artificial Sequence
  Description of Artificial Sequence: Synthetic oligonucleotide
  Target: ATXN1; (-) strand; PAM type: NRG; PAM sequence: AGG
atctgaacacttaaacttac

SEQ ID NO: 47401 - DNA, 20 bp, Artificial Sequence
  Description of Artificial Sequence: Synthetic oligonucleotide
  Target: ATXN1; (-) strand; PAM type: NRG; PAM sequence: CAG
gatctgaacacttaaactta

SEQ ID NO: 47402 - DNA, 20 bp, Artificial Sequence
  Description of Artificial Sequence: Synthetic oligonucleotide
  Target: ATXN1; (-) strand; PAM type: NRG; PAM sequence: AAG
tgttcacattatattctgca

SEQ ID NO: 47403 - DNA, 20 bp, Artificial Sequence
  Description of Artificial Sequence: Synthetic oligonucleotide
  Target: ATXN1; (-) strand; PAM type: NRG; PAM sequence: AAG
tttacagtacaagcaagagc

SEQ ID NO: 47404 - DNA, 20 bp, Artificial Sequence
  Description of Artificial Sequence: Synthetic oligonucleotide
  Target: ATXN1; (-) strand; PAM type: NRG; PAM sequence: GAG
accttttacagtacaagcaa

SEQ ID NO: 47405 - DNA, 20 bp, Artificial Sequence
  Description of Artificial Sequence: Synthetic oligonucleotide
  Target: ATXN1; (-) strand; PAM type: NRG; PAM sequence: AAG
gaaccttttacagtacaagc

SEQ ID NO: 47406 - DNA, 20 bp, Artificial Sequence
  Description of Artificial Sequence: Synthetic oligonucleotide
  Target: ATXN1; (-) strand; PAM type: NRG; PAM sequence: AAG
tagagaaccttttacagtac

SEQ ID NO: 47407 - DNA, 20 bp, Artificial Sequence
  Description of Artificial Sequence: Synthetic oligonucleotide
  Target: ATXN1; (-) strand; PAM type: NRG; PAM sequence: CAG
tatgaatagagaacctttta

SEQ ID NO: 47408 - DNA, 20 bp, Artificial Sequence
  Description of Artificial Sequence: Synthetic oligonucleotide
  Target: ATXN1; (-) strand; PAM type: NRG; PAM sequence: GAG
atatcacatctatatgaata

SEQ ID NO: 47409 - DNA, 20 bp, Artificial Sequence
  Description of Artificial Sequence: Synthetic oligonucleotide
  Target: ATXN1; (-) strand; PAM type: NRG; PAM sequence: TAG
gaatatcacatctatatgaa

SEQ ID NO: 47410 - DNA, 20 bp, Artificial Sequence
  Description of Artificial Sequence: Synthetic oligonucleotide
  Target: ATXN1; (-) strand; PAM type: NRG; PAM sequence: TAG
acatgagtgggtgggagatt

SEQ ID NO: 47411 - DNA, 20 bp, Artificial Sequence
  Description of Artificial Sequence: Synthetic oligonucleotide
  Target: ATXN1; (-) strand; PAM type: NRG; PAM sequence: GAG
tttgcgacatgagtgggtgg

SEQ ID NO: 47412 - DNA, 20 bp, Artificial Sequence
  Description of Artificial Sequence: Synthetic oligonucleotide
  Target: ATXN1; (-) strand; PAM type: NRG; PAM sequence: GGG
ggtttgcgacatgagtgggt

SEQ ID NO: 47413 - DNA, 20 bp, Artificial Sequence
  Description of Artificial Sequence: Synthetic oligonucleotide
  Target: ATXN1; (-) strand; PAM type: NRG; PAM sequence: TGG
aggtttgcgacatgagtggg

SEQ ID NO: 47414 - DNA, 20 bp, Artificial Sequence
  Description of Artificial Sequence: Synthetic oligonucleotide
  Target: ATXN1; (-) strand; PAM type: NRG; PAM sequence: GGG
taaaggtttgcgacatgagt

SEQ ID NO: 47415 - DNA, 20 bp, Artificial Sequence
  Description of Artificial Sequence: Synthetic oligonucleotide
  Target: ATXN1; (-) strand; PAM type: NRG; PAM sequence: TGG
ataaaggtttgcgacatgag

SEQ ID NO: 47416 - DNA, 20 bp, Artificial Sequence
  Description of Artificial Sequence: Synthetic oligonucleotide
  Target: ATXN1; (-) strand; PAM type: NRG; PAM sequence: GAG
tccataaaggtttgcgacat

SEQ ID NO: 47417 - DNA, 20 bp, Artificial Sequence
  Description of Artificial Sequence: Synthetic oligonucleotide
  Target: ATXN1; (-) strand; PAM type: NRG; PAM sequence: AGG
atgtagtaggcactccataa

SEQ ID NO: 47418 - DNA, 20 bp, Artificial Sequence
  Description of Artificial Sequence: Synthetic oligonucleotide
  Target: ATXN1; (-) strand; PAM type: NRG; PAM sequence: AAG
tatgtagtaggcactccata

SEQ ID NO: 47419 - DNA, 20 bp, Artificial Sequence
  Description of Artificial Sequence: Synthetic oligonucleotide
  Target: ATXN1; (-) strand; PAM type: NRG; PAM sequence: AGG
gctcatcactaatatgtagt

SEQ ID NO: 47420 - DNA, 20 bp, Artificial Sequence
  Description of Artificial Sequence: Synthetic oligonucleotide
  Target: ATXN1; (-) strand; PAM type: NRG; PAM sequence: TAG
tgctcatcactaatatgtag

SEQ ID NO: 47421 - DNA, 20 bp, Artificial Sequence
  Description of Artificial Sequence: Synthetic oligonucleotide
  Target: ATXN1; (-) strand; PAM type: NRG; PAM sequence: TAG
tactgctcatcactaatatg

SEQ ID NO: 47422 - DNA, 20 bp, Artificial Sequence
  Description of Artificial Sequence: Synthetic oligonucleotide
  Target: ATXN1; (-) strand; PAM type: NRG; PAM sequence: TAG
tgaaagtgctttgtaggtat

SEQ ID NO: 47423 - DNA, 20 bp, Artificial Sequence
  Description of Artificial Sequence: Synthetic oligonucleotide
  Target: ATXN1; (-) strand; PAM type: NRG; PAM sequence: AGG
gcagactgaaagtgctttgt

SEQ ID NO: 47424 - DNA, 20 bp, Artificial Sequence
  Description of Artificial Sequence: Synthetic oligonucleotide
  Target: ATXN1; (-) strand; PAM type: NRG; PAM sequence: TAG
agcagactgaaagtgctttg

SEQ ID NO: 47425 - DNA, 20 bp, Artificial Sequence
  Description of Artificial Sequence: Synthetic oligonucleotide
  Target: ATXN1; (-) strand; PAM type: NRG; PAM sequence: AAG
gcaaagccctagcagactga

SEQ ID NO: 47426 - DNA, 20 bp, Artificial Sequence
  Description of Artificial Sequence: Synthetic oligonucleotide
  Target: ATXN1; (-) strand; PAM type: NRG; PAM sequence: CAG
ggctccatgcaaagccctag

SEQ ID NO: 47427 - DNA, 20 bp, Artificial Sequence
  Description of Artificial Sequence: Synthetic oligonucleotide
  Target: ATXN1; (-) strand; PAM type: NRG; PAM sequence: TAG
agcggctccatgcaaagccc

SEQ ID NO: 47428 - DNA, 20 bp, Artificial Sequence
  Description of Artificial Sequence: Synthetic oligonucleotide
  Target: ATXN1; (-) strand; PAM type: NRG; PAM sequence: AAG
taaatgagcggctccatgca

SEQ ID NO: 47429 - DNA, 20 bp, Artificial Sequence
  Description of Artificial Sequence: Synthetic oligonucleotide
  Target: ATXN1; (-) strand; PAM type: NRG; PAM sequence: CGG
agagtgcttacttaaatgag

SEQ ID NO: 47430 - DNA, 20 bp, Artificial Sequence
  Description of Artificial Sequence: Synthetic oligonucleotide
  Target: ATXN1; (-) strand; PAM type: NRG; PAM sequence: GAG
agaagagtgcttacttaaat

SEQ ID NO: 47431 - DNA, 20 bp, Artificial Sequence
  Description of Artificial Sequence: Synthetic oligonucleotide
  Target: ATXN1; (-) strand; PAM type: NRG; PAM sequence: GAG
tggtatcatggcaactagaa

SEQ ID NO: 47432 - DNA, 20 bp, Artificial Sequence
  Description of Artificial Sequence: Synthetic oligonucleotide
  Target: ATXN1; (-) strand; PAM type: NRG; PAM sequence: AAG
gatggtatcatggcaactag

SEQ ID NO: 47433 - DNA, 20 bp, Artificial Sequence
  Description of Artificial Sequence: Synthetic oligonucleotide
  Target: ATXN1; (-) strand; PAM type: NRG; PAM sequence: TAG
ttagatggtatcatggcaac

SEQ ID NO: 47434 - DNA, 20 bp, Artificial Sequence
  Description of Artificial Sequence: Synthetic oligonucleotide
  Target: ATXN1; (-) strand; PAM type: NRG; PAM sequence: TGG
catttaattagatggtatca

SEQ ID NO: 47435 - DNA, 20 bp, Artificial Sequence
  Description of Artificial Sequence: Synthetic oligonucleotide
  Target: ATXN1; (-) strand; PAM type: NRG; PAM sequence: TGG
aagcacctcatttaattaga

SEQ ID NO: 47436 - DNA, 20 bp, Artificial Sequence
  Description of Artificial Sequence: Synthetic oligonucleotide
  Target: ATXN1; (-) strand; PAM type: NRG; PAM sequence: TAG
tgtgaagcacctcatttaat

SEQ ID NO: 47437 - DNA, 20 bp, Artificial Sequence
  Description of Artificial Sequence: Synthetic oligonucleotide
  Target: ATXN1; (-) strand; PAM type: NRG; PAM sequence: AAG
gctgtatatttgtgtctgtg

SEQ ID NO: 47438 - DNA, 20 bp, Artificial Sequence
  Description of Artificial Sequence: Synthetic oligonucleotide
  Target: ATXN1; (-) strand; PAM type: NRG; PAM sequence: TAG
ataaaggaacagcatacata

SEQ ID NO: 47439 - DNA, 20 bp, Artificial Sequence
  Description of Artificial Sequence: Synthetic oligonucleotide
  Target: ATXN1; (-) strand; PAM type: NRG; PAM sequence: CAG
aagattccgttataaaggaa

SEQ ID NO: 47440 - DNA, 20 bp, Artificial Sequence
  Description of Artificial Sequence: Synthetic oligonucleotide
  Target: ATXN1; (-) strand; PAM type: NRG; PAM sequence: AGG
tggggaagattccgttataa

SEQ ID NO: 47441 - DNA, 20 bp, Artificial Sequence
  Description of Artificial Sequence: Synthetic oligonucleotide
  Target: ATXN1; (-) strand; PAM type: NRG; PAM sequence: AAG
atggggaagattccgttata

SEQ ID NO: 47442 - DNA, 20 bp, Artificial Sequence
  Description of Artificial Sequence: Synthetic oligonucleotide
  Target: ATXN1; (-) strand; PAM type: NRG; PAM sequence: AAG
gggtagggatggcaatgggg

SEQ ID NO: 47443 - DNA, 20 bp, Artificial Sequence
  Description of Artificial Sequence: Synthetic oligonucleotide
  Target: ATXN1; (-) strand; PAM type: NRG; PAM sequence: GGG
gcagggtagggatggcaatg

SEQ ID NO: 47444 - DNA, 20 bp, Artificial Sequence
  Description of Artificial Sequence: Synthetic oligonucleotide
  Target: ATXN1; (-) strand; PAM type: NRG; PAM sequence: GGG
ggcagggtagggatggcaat

SEQ ID NO: 47445 - DNA, 20 bp, Artificial Sequence
  Description of Artificial Sequence: Synthetic oligonucleotide
  Target: ATXN1; (-) strand; PAM type: NRG; PAM sequence: TGG
aggcagggtagggatggcaa

SEQ ID NO: 47446 - DNA, 20 bp, Artificial Sequence
  Description of Artificial Sequence: Synthetic oligonucleotide
  Target: ATXN1; (-) strand; PAM type: NRG; PAM sequence: TGG
aaaagtaggcagggtaggga

SEQ ID NO: 47447 - DNA, 20 bp, Artificial Sequence
  Description of Artificial Sequence: Synthetic oligonucleotide
  Target: ATXN1; (-) strand; PAM type: NRG; PAM sequence: GGG
tgagaaaagtaggcagggta

SEQ ID NO: 47448 - DNA, 20 bp, Artificial Sequence
  Description of Artificial Sequence: Synthetic oligonucleotide
  Target: ATXN1; (-) strand; PAM type: NRG; PAM sequence: AGG
ctgagaaaagtaggcagggt

SEQ ID NO: 47449 - DNA, 20 bp, Artificial Sequence
  Description of Artificial Sequence: Synthetic oligonucleotide
  Target: ATXN1; (-) strand; PAM type: NRG; PAM sequence: TAG
tctgagaaaagtaggcaggg

SEQ ID NO: 47450 - DNA, 20 bp, Artificial Sequence
  Description of Artificial Sequence: Synthetic oligonucleotide
  Target: ATXN1; (-) strand; PAM type: NRG; PAM sequence: GGG
ggatctgagaaaagtaggca

SEQ ID NO: 47451 - DNA, 20 bp, Artificial Sequence
  Description of Artificial Sequence: Synthetic oligonucleotide
  Target: ATXN1; (-) strand; PAM type: NRG; PAM sequence: AGG
gggatctgagaaaagtaggc

SEQ ID NO: 47452 - DNA, 20 bp, Artificial Sequence
  Description of Artificial Sequence: Synthetic oligonucleotide
  Target: ATXN1; (-) strand; PAM type: NRG; PAM sequence: CAG
agggatctgagaaaagtagg

SEQ ID NO: 47453 - DNA, 20 bp, Artificial Sequence
  Description of Artificial Sequence: Synthetic oligonucleotide
  Target: ATXN1; (-) strand; PAM type: NRG; PAM sequence: AGG
ataagggatctgagaaaagt

SEQ ID NO: 47454 - DNA, 20 bp, Artificial Sequence
  Description of Artificial Sequence: Synthetic oligonucleotide
  Target: ATXN1; (-) strand; PAM type: NRG; PAM sequence: TAG
gataagggatctgagaaaag

SEQ ID NO: 47455 - DNA, 20 bp, Artificial Sequence
  Description of Artificial Sequence: Synthetic oligonucleotide
  Target: ATXN1; (-) strand; PAM type: NRG; PAM sequence: AAG
catgataagggatctgagaa

SEQ ID NO: 47456 - DNA, 20 bp, Artificial Sequence
  Description of Artificial Sequence: Synthetic oligonucleotide
  Target: ATXN1; (-) strand; PAM type: NRG; PAM sequence: GAG
aataacatgataagggatct

SEQ ID NO: 47457 - DNA, 20 bp, Artificial Sequence
  Description of Artificial Sequence: Synthetic oligonucleotide
  Target: ATXN1; (-) strand; PAM type: NRG; PAM sequence: GGG
ggggtgaaataacatgataa

SEQ ID NO: 47458 - DNA, 20 bp, Artificial Sequence
  Description of Artificial Sequence: Synthetic oligonucleotide
  Target: ATXN1; (-) strand; PAM type: NRG; PAM sequence: AGG
tggggtgaaataacatgata

SEQ ID NO: 47459 - DNA, 20 bp, Artificial Sequence
  Description of Artificial Sequence: Synthetic oligonucleotide
  Target: ATXN1; (-) strand; PAM type: NRG; PAM sequence: AAG
ttggggtgaaataacatgat

SEQ ID NO: 47460 - DNA, 20 bp, Artificial Sequence
  Description of Artificial Sequence: Synthetic oligonucleotide
  Target: ATXN1; (-) strand; PAM type: NRG; PAM sequence: GGG
tttccagaaaaagtctgttg

SEQ ID NO: 47461 - DNA, 20 bp, Artificial Sequence
  Description of Artificial Sequence: Synthetic oligonucleotide
  Target: ATXN1; (-) strand; PAM type: NRG; PAM sequence: GGG
ttttccagaaaaagtctgtt

SEQ ID NO: 47462 - DNA, 20 bp, Artificial Sequence
  Description of Artificial Sequence: Synthetic oligonucleotide
  Target: ATXN1; (-) strand; PAM type: NRG; PAM sequence: TGG
tttttccagaaaaagtctgt

SEQ ID NO: 47463 - DNA, 20 bp, Artificial Sequence
  Description of Artificial Sequence: Synthetic oligonucleotide
  Target: ATXN1; (-) strand; PAM type: NRG; PAM sequence: AAG
agcaatcatttttccagaaa

SEQ ID NO: 47464 - DNA, 20 bp, Artificial Sequence
  Description of Artificial Sequence: Synthetic oligonucleotide
  Target: ATXN1; (-) strand; PAM type: NRG; PAM sequence: CAG
gtagtaagcaatcatttttc

SEQ ID NO: 47465 - DNA, 20 bp, Artificial Sequence
  Description of Artificial Sequence: Synthetic oligonucleotide
  Target: ATXN1; (-) strand; PAM type: NRG; PAM sequence: AAG
acagccaactgacatgtagt

SEQ ID NO: 47466 - DNA, 20 bp, Artificial Sequence
  Description of Artificial Sequence: Synthetic oligonucleotide
  Target: ATXN1; (-) strand; PAM type: NRG; PAM sequence: TAG
gtgaacagccaactgacatg

SEQ ID NO: 47467 - DNA, 20 bp, Artificial Sequence
  Description of Artificial Sequence: Synthetic oligonucleotide
  Target: ATXN1; (-) strand; PAM type: NRG; PAM sequence: CAG
tgtatttctgaaactgtgaa

SEQ ID NO: 47468 - DNA, 20 bp, Artificial Sequence
  Description of Artificial Sequence: Synthetic oligonucleotide
  Target: ATXN1; (-) strand; PAM type: NRG; PAM sequence: AAG
gttgatagatgctgttttcc

SEQ ID NO: 47469 - DNA, 20 bp, Artificial Sequence
  Description of Artificial Sequence: Synthetic oligonucleotide
  Target: ATXN1; (-) strand; PAM type: NRG; PAM sequence: TAG
agcttagatctagaagttga

SEQ ID NO: 47470 - DNA, 20 bp, Artificial Sequence
  Description of Artificial Sequence: Synthetic oligonucleotide
  Target: ATXN1; (-) strand; PAM type: NRG; PAM sequence: AAG
ctcagagagcttagatctag

SEQ ID NO: 47471 - DNA, 20 bp, Artificial Sequence
  Description of Artificial Sequence: Synthetic oligonucleotide
  Target: ATXN1; (-) strand; PAM type: NRG; PAM sequence: TAG
gctctcagagagcttagatc

SEQ ID NO: 47472 - DNA, 20 bp, Artificial Sequence
  Description of Artificial Sequence: Synthetic oligonucleotide
  Target: ATXN1; (-) strand; PAM type: NRG; PAM sequence: TAG
gttcttgctctcagagagct

SEQ ID NO: 47473 - DNA, 20 bp, Artificial Sequence
  Description of Artificial Sequence: Synthetic oligonucleotide
  Target: ATXN1; (-) strand; PAM type: NRG; PAM sequence: GAG
acatagttcttgctctcaga

SEQ ID NO: 47474 - DNA, 20 bp, Artificial Sequence
  Description of Artificial Sequence: Synthetic oligonucleotide
  Target: ATXN1; (-) strand; PAM type: NRG; PAM sequence: GAG
aaacatagttcttgctctca

SEQ ID NO: 47475 - DNA, 20 bp, Artificial Sequence
  Description of Artificial Sequence: Synthetic oligonucleotide
  Target: ATXN1; (-) strand; PAM type: NRG; PAM sequence: CAG
aaaaacatagttcttgctct

SEQ ID NO: 47476 - DNA, 20 bp, Artificial Sequence
  Description of Artificial Sequence: Synthetic oligonucleotide
  Target: ATXN1; (-) strand; PAM type: NRG; PAM sequence: TAG
aggatggagaagaaaaaaca

SEQ ID NO: 47477 - DNA, 20 bp, Artificial Sequence
  Description of Artificial Sequence: Synthetic oligonucleotide
  Target: ATXN1; (-) strand; PAM type: NRG; PAM sequence: AAG
gccacggccttaggatggag

SEQ ID NO: 47478 - DNA, 20 bp, Artificial Sequence
  Description of Artificial Sequence: Synthetic oligonucleotide
  Target: ATXN1; (-) strand; PAM type: NRG; PAM sequence: GAG
agtgccacggccttaggatg

SEQ ID NO: 47479 - DNA, 20 bp, Artificial Sequence
  Description of Artificial Sequence: Synthetic oligonucleotide
  Target: ATXN1; (-) strand; PAM type: NRG; PAM sequence: TGG
acagtgccacggccttagga

SEQ ID NO: 47480 - DNA, 20 bp, Artificial Sequence
  Description of Artificial Sequence: Synthetic oligonucleotide
  Target: ATXN1; (-) strand; PAM type: NRG; PAM sequence: AGG
aggcacagtgccacggcctt

SEQ ID NO: 47481 - DNA, 20 bp, Artificial Sequence
  Description of Artificial Sequence: Synthetic oligonucleotide
  Target: ATXN1; (-) strand; PAM type: NRG; PAM sequence: TAG
caggcacagtgccacggcct

SEQ ID NO: 47482 - DNA, 20 bp, Artificial Sequence
  Description of Artificial Sequence: Synthetic oligonucleotide
  Target: ATXN1; (-) strand; PAM type: NRG; PAM sequence: CGG
atgtatcaggcacagtgcca

SEQ ID NO: 47483 - DNA, 20 bp, Artificial Sequence
  Description of Artificial Sequence: Synthetic oligonucleotide
  Target: ATXN1; (-) strand; PAM type: NRG; PAM sequence: CAG
tatcaaatatgtatcaggca

SEQ ID NO: 47484 - DNA, 20 bp, Artificial Sequence
  Description of Artificial Sequence: Synthetic oligonucleotide
  Target: ATXN1; (-) strand; PAM type: NRG; PAM sequence: AGG
gcacctatcaaatatgtatc

SEQ ID NO: 47485 - DNA, 20 bp, Artificial Sequence
  Description of Artificial Sequence: Synthetic oligonucleotide
  Target: ATXN1; (-) strand; PAM type: NRG; PAM sequence: CAG
tgcacctatcaaatatgtat

SEQ ID NO: 47486 - DNA, 20 bp, Artificial Sequence
  Description of Artificial Sequence: Synthetic oligonucleotide
  Target: ATXN1; (-) strand; PAM type: NRG; PAM sequence: TAG
taatttatgtaacacatact

SEQ ID NO: 47487 - DNA, 20 bp, Artificial Sequence
  Description of Artificial Sequence: Synthetic oligonucleotide
  Target: ATXN1; (-) strand; PAM type: NRG; PAM sequence: TGG
tattagcatatggcacatca

SEQ ID NO: 47488 - DNA, 20 bp, Artificial Sequence
  Description of Artificial Sequence: Synthetic oligonucleotide
  Target: ATXN1; (-) strand; PAM type: NRG; PAM sequence: TGG
ctagacaggatattagcata

SEQ ID NO: 47489 - DNA, 20 bp, Artificial Sequence
  Description of Artificial Sequence: Synthetic oligonucleotide
  Target: ATXN1; (-) strand; PAM type: NRG; PAM sequence: TAG
gttattactagacaggatat

SEQ ID NO: 47490 - DNA, 20 bp, Artificial Sequence
  Description of Artificial Sequence: Synthetic oligonucleotide
  Target: ATXN1; (-) strand; PAM type: NRG; PAM sequence: AGG
ctcagcagttattactagac

SEQ ID NO: 47491 - DNA, 20 bp, Artificial Sequence
  Description of Artificial Sequence: Synthetic oligonucleotide
  Target: ATXN1; (-) strand; PAM type: NRG; PAM sequence: CAG
cctcagcagttattactaga

SEQ ID NO: 47492 - DNA, 20 bp, Artificial Sequence
  Description of Artificial Sequence: Synthetic oligonucleotide
  Target: ATXN1; (-) strand; PAM type: NRG; PAM sequence: TAG
aagtcctcagcagttattac

SEQ ID NO: 47493 - DNA, 20 bp, Artificial Sequence
  Description of Artificial Sequence: Synthetic oligonucleotide
  Target: ATXN1; (-) strand; PAM type: NRG; PAM sequence: CAG
aaatattctgaagtcctcag

SEQ ID NO: 47494 - DNA, 20 bp, Artificial Sequence
  Description of Artificial Sequence: Synthetic oligonucleotide
  Target: ATXN1; (-) strand; PAM type: NRG; PAM sequence: CAG
agcaaatattctgaagtcct

SEQ ID NO: 47495 - DNA, 20 bp, Artificial Sequence
  Description of Artificial Sequence: Synthetic oligonucleotide
  Target: ATXN1; (-) strand; PAM type: NRG; PAM sequence: AAG
cctggtcagcaaatattctg

SEQ ID NO: 47496 - DNA, 20 bp, Artificial Sequence
  Description of Artificial Sequence: Synthetic oligonucleotide
  Target: ATXN1; (-) strand; PAM type: NRG; PAM sequence: CAG
agacaccaggacaacctggt

SEQ ID NO: 47497 - DNA, 20 bp, Artificial Sequence
  Description of Artificial Sequence: Synthetic oligonucleotide
  Target: ATXN1; (-) strand; PAM type: NRG; PAM sequence: TGG
tatcagacaccaggacaacc

SEQ ID NO: 47498 - DNA, 20 bp, Artificial Sequence
  Description of Artificial Sequence: Synthetic oligonucleotide
  Target: ATXN1; (-) strand; PAM type: NRG; PAM sequence: AGG
tcagtggagtatcagacacc

SEQ ID NO: 47499 - DNA, 20 bp, Artificial Sequence
  Description of Artificial Sequence: Synthetic oligonucleotide
  Target: ATXN1; (-) strand; PAM type: NRG; PAM sequence: CAG
ttcagtggagtatcagacac

SEQ ID NO: 47500 - DNA, 20 bp, Artificial Sequence
  Description of Artificial Sequence: Synthetic oligonucleotide
  Target: ATXN1; (-) strand; PAM type: NRG; PAM sequence: CAG
tttgtccttcagtggagtat

SEQ ID NO: 47501 - DNA, 20 bp, Artificial Sequence
  Description of Artificial Sequence: Synthetic oligonucleotide
  Target: ATXN1; (-) strand; PAM type: NRG; PAM sequence: GAG
ttttgttttgtccttcagtg

SEQ ID NO: 47502 - DNA, 20 bp, Artificial Sequence
  Description of Artificial Sequence: Synthetic oligonucleotide
  Target: ATXN1; (-) strand; PAM type: NRG; PAM sequence: TGG
aattttgttttgtccttcag

SEQ ID NO: 47503 - DNA, 20 bp, Artificial Sequence
  Description of Artificial Sequence: Synthetic oligonucleotide
  Target: ATXN1; (-) strand; PAM type: NRG; PAM sequence: CAG
atcaattttgttttgtcctt

SEQ ID NO: 47504 - DNA, 20 bp, Artificial Sequence
  Description of Artificial Sequence: Synthetic oligonucleotide
  Target: ATXN1; (-) strand; PAM type: NRG; PAM sequence: TGG
cacactttatttactcttag

SEQ ID NO: 47505 - DNA, 20 bp, Artificial Sequence
  Description of Artificial Sequence: Synthetic oligonucleotide
  Target: ATXN1; (-) strand; PAM type: NRG; PAM sequence: TAG
catcacactttatttactct

SEQ ID NO: 47506 - DNA, 20 bp, Artificial Sequence
  Description of Artificial Sequence: Synthetic oligonucleotide
  Target: ATXN1; (-) strand; PAM type: NRG; PAM sequence: TGG
aacttttcttatttatgcca

SEQ ID NO: 47507 - DNA, 20 bp, Artificial Sequence
  Description of Artificial Sequence: Synthetic oligonucleotide
  Target: ATXN1; (-) strand; PAM type: NRG; PAM sequence: GAG
acagatcaattcatgtcaaa

SEQ ID NO: 47508 - DNA, 20 bp, Artificial Sequence
  Description of Artificial Sequence: Synthetic oligonucleotide
  Target: ATXN1; (-) strand; PAM type: NRG; PAM sequence: AAG
gaacagatcaattcatgtca

SEQ ID NO: 47509 - DNA, 20 bp, Artificial Sequence
  Description of Artificial Sequence: Synthetic oligonucleotide
  Target: ATXN1; (-) strand; PAM type: NRG; PAM sequence: CAG
tttggttagattgtgctgaa

SEQ ID NO: 47510 - DNA, 20 bp, Artificial Sequence
  Description of Artificial Sequence: Synthetic oligonucleotide
  Target: ATXN1; (-) strand; PAM type: NRG; PAM sequence: TAG
actttgccttgttctttggt

SEQ ID NO: 47511 - DNA, 20 bp, Artificial Sequence
  Description of Artificial Sequence: Synthetic oligonucleotide
  Target: ATXN1; (-) strand; PAM type: NRG; PAM sequence: TGG
gaaaactttgccttgttctt

SEQ ID NO: 47512 - DNA, 20 bp, Artificial Sequence
  Description of Artificial Sequence: Synthetic oligonucleotide
  Target: ATXN1; (-) strand; PAM type: NRG; PAM sequence: AGG
ggaactcattctatgcttga

SEQ ID NO: 47513 - DNA, 20 bp, Artificial Sequence
  Description of Artificial Sequence: Synthetic oligonucleotide
  Target: ATXN1; (-) strand; PAM type: NRG; PAM sequence: AAG
gggaactcattctatgcttg

SEQ ID NO: 47514 - DNA, 20 bp, Artificial Sequence
  Description of Artificial Sequence: Synthetic oligonucleotide
  Target: ATXN1; (-) strand; PAM type: NRG; PAM sequence: GGG
tccactttataaatcccaga

SEQ ID NO: 47515 - DNA, 20 bp, Artificial Sequence
  Description of Artificial Sequence: Synthetic oligonucleotide
  Target: ATXN1; (-) strand; PAM type: NRG; PAM sequence: AGG
gtccactttataaatcccag

SEQ ID NO: 47516 - DNA, 20 bp, Artificial Sequence
  Description of Artificial Sequence: Synthetic oligonucleotide
  Target: ATXN1; (-) strand; PAM type: NRG; PAM sequence: GAG
ggtccactttataaatccca

SEQ ID NO: 47517 - DNA, 20 bp, Artificial Sequence
  Description of Artificial Sequence: Synthetic oligonucleotide
  Target: ATXN1; (-) strand; PAM type: NRG; PAM sequence: CAG
ctggtccactttataaatcc

SEQ ID NO: 47518 - DNA, 20 bp, Artificial Sequence
  Description of Artificial Sequence: Synthetic oligonucleotide
  Target: ATXN1; (-) strand; PAM type: NRG; PAM sequence: TGG
gagccatgccccctctgtac

SEQ ID NO: 47519 - DNA, 20 bp, Artificial Sequence
  Description of Artificial Sequence: Synthetic oligonucleotide
  Target: ATXN1; (-) strand; PAM type: NRG; PAM sequence: GAG
gttttaaacggtacgggtgg

SEQ ID NO: 47520 - DNA, 20 bp, Artificial Sequence
  Description of Artificial Sequence: Synthetic oligonucleotide
  Target: ATXN1; (-) strand; PAM type: NRG; PAM sequence: GGG
tagttttaaacggtacgggt

SEQ ID NO: 47521 - DNA, 20 bp, Artificial Sequence
  Description of Artificial Sequence: Synthetic oligonucleotide
  Target: ATXN1; (-) strand; PAM type: NRG; PAM sequence: TGG
ctagttttaaacggtacggg

SEQ ID NO: 47522 - DNA, 20 bp, Artificial Sequence
  Description of Artificial Sequence: Synthetic oligonucleotide
  Target: ATXN1; (-) strand; PAM type: NRG; PAM sequence: GGG
caactagttttaaacggtac

SEQ ID NO: 47523 - DNA, 20 bp, Artificial Sequence
  Description of Artificial Sequence: Synthetic oligonucleotide
  Target: ATXN1; (-) strand; PAM type: NRG; PAM sequence: CGG
tcaactagttttaaacggta

SEQ ID NO: 47524 - DNA, 20 bp, Artificial Sequence
  Description of Artificial Sequence: Synthetic oligonucleotide
  Target: ATXN1; (-) strand; PAM type: NRG; PAM sequence: CGG
aaaaatcaactagttttaaa

SEQ ID NO: 47525 - DNA, 20 bp, Artificial Sequence
  Description of Artificial Sequence: Synthetic oligonucleotide
  Target: ATXN1; (-) strand; PAM type: NRG; PAM sequence: TAG
agaatacactaaaaatcaac

SEQ ID NO: 47526 - DNA, 20 bp, Artificial Sequence
  Description of Artificial Sequence: Synthetic oligonucleotide
  Target: ATXN1; (-) strand; PAM type: NRG; PAM sequence: GAG
ggggaagataggtgaaattg

SEQ ID NO: 47527 - DNA, 20 bp, Artificial Sequence
  Description of Artificial Sequence: Synthetic oligonucleotide
  Target: ATXN1; (-) strand; PAM type: NRG; PAM sequence: TGG
agggggaagataggtgaaat

SEQ ID NO: 47528 - DNA, 20 bp, Artificial Sequence
  Description of Artificial Sequence: Synthetic oligonucleotide
  Target: ATXN1; (-) strand; PAM type: NRG; PAM sequence: AGG
attgctgagagggggaagat

SEQ ID NO: 47529 - DNA, 20 bp, Artificial Sequence
  Description of Artificial Sequence: Synthetic oligonucleotide
  Target: ATXN1; (-) strand; PAM type: NRG; PAM sequence: TAG
gattgctgagagggggaaga

SEQ ID NO: 47530 - DNA, 20 bp, Artificial Sequence
  Description of Artificial Sequence: Synthetic oligonucleotide
  Target: ATXN1; (-) strand; PAM type: NRG; PAM sequence: AAG
aatagattgctgagaggggg

SEQ ID NO: 47531 - DNA, 20 bp, Artificial Sequence
  Description of Artificial Sequence: Synthetic oligonucleotide
  Target: ATXN1; (-) strand; PAM type: NRG; PAM sequence: GGG
cgtaatagattgctgagagg

SEQ ID NO: 47532 - DNA, 20 bp, Artificial Sequence
  Description of Artificial Sequence: Synthetic oligonucleotide
  Target: ATXN1; (-) strand; PAM type: NRG; PAM sequence: GGG
ccgtaatagattgctgagag

SEQ ID NO: 47533 - DNA, 20 bp, Artificial Sequence
  Description of Artificial Sequence: Synthetic oligonucleotide
  Target: ATXN1; (-) strand; PAM type: NRG; PAM sequence: GGG
tccgtaatagattgctgaga

SEQ ID NO: 47534 - DNA, 20 bp, Artificial Sequence
  Description of Artificial Sequence: Synthetic oligonucleotide
  Target: ATXN1; (-) strand; PAM type: NRG; PAM sequence: AGG
atccgtaatagattgctgag

SEQ ID NO: 47535 - DNA, 20 bp, Artificial Sequence
  Description of Artificial Sequence: Synthetic oligonucleotide
  Target: ATXN1; (-) strand; PAM type: NRG; PAM sequence: GAG
aatccgtaatagattgctga

SEQ ID NO: 47536 - DNA, 20 bp, Artificial Sequence
  Description of Artificial Sequence: Synthetic oligonucleotide
  Target: ATXN1; (-) strand; PAM type: NRG; PAM sequence: GAG
caaatccgtaatagattgct

SEQ ID NO: 47537 - DNA, 20 bp, Artificial Sequence
  Description of Artificial Sequence: Synthetic oligonucleotide
  Target: ATXN1; (-) strand; PAM type: NRG; PAM sequence: TAG
tccagcaaacaaatccgtaa

SEQ ID NO: 47538 - DNA, 20 bp, Artificial Sequence
  Description of Artificial Sequence: Synthetic oligonucleotide
  Target: ATXN1; (-) strand; PAM type: NRG; PAM sequence: CAG
cctgccactccaagtcattc

SEQ ID NO: 47539 - DNA, 20 bp, Artificial Sequence
  Description of Artificial Sequence: Synthetic oligonucleotide
  Target: ATXN1; (-) strand; PAM type: NRG; PAM sequence: AAG
ctgaccccacctgccactcc

SEQ ID NO: 47540 - DNA, 20 bp, Artificial Sequence
  Description of Artificial Sequence: Synthetic oligonucleotide
  Target: ATXN1; (-) strand; PAM type: NRG; PAM sequence: GGG
aatcatcttaccctttactg

SEQ ID NO: 47541 - DNA, 20 bp, Artificial Sequence
  Description of Artificial Sequence: Synthetic oligonucleotide
  Target: ATXN1; (-) strand; PAM type: NRG; PAM sequence: GGG
caatcatcttaccctttact

SEQ ID NO: 47542 - DNA, 20 bp, Artificial Sequence
  Description of Artificial Sequence: Synthetic oligonucleotide
  Target: ATXN1; (-) strand; PAM type: NRG; PAM sequence: TGG
tcaatcatcttaccctttac

SEQ ID NO: 47543 - DNA, 20 bp, Artificial Sequence
  Description of Artificial Sequence: Synthetic oligonucleotide
  Target: ATXN1; (-) strand; PAM type: NRG; PAM sequence: CAG
taactctggccccatctcag

SEQ ID NO: 47544 - DNA, 20 bp, Artificial Sequence
  Description of Artificial Sequence: Synthetic oligonucleotide
  Target: ATXN1; (-) strand; PAM type: NRG; PAM sequence: CAG
aggtaactctggccccatct

SEQ ID NO: 47545 - DNA, 20 bp, Artificial Sequence
  Description of Artificial Sequence: Synthetic oligonucleotide
  Target: ATXN1; (-) strand; PAM type: NRG; PAM sequence: TGG
caatatttatcaggtaactc

SEQ ID NO: 47546 - DNA, 20 bp, Artificial Sequence
  Description of Artificial Sequence: Synthetic oligonucleotide
  Target: ATXN1; (-) strand; PAM type: NRG; PAM sequence: AGG
gcatggccccaatatttatc

SEQ ID NO: 47547 - DNA, 20 bp, Artificial Sequence
  Description of Artificial Sequence: Synthetic oligonucleotide
  Target: ATXN1; (-) strand; PAM type: NRG; PAM sequence: CAG
ggcatggccccaatatttat

SEQ ID NO: 47548 - DNA, 20 bp, Artificial Sequence
  Description of Artificial Sequence: Synthetic oligonucleotide
  Target: ATXN1; (-) strand; PAM type: NRG; PAM sequence: TGG
aaagatttcacctagtggca

SEQ ID NO: 47549 - DNA, 20 bp, Artificial Sequence
  Description of Artificial Sequence: Synthetic oligonucleotide
  Target: ATXN1; (-) strand; PAM type: NRG; PAM sequence: TGG
aacgaaaagatttcacctag

SEQ ID NO: 47550 - DNA, 20 bp, Artificial Sequence
  Description of Artificial Sequence: Synthetic oligonucleotide
  Target: ATXN1; (-) strand; PAM type: NRG; PAM sequence: TAG
cttaacgaaaagatttcacc

SEQ ID NO: 47551 - DNA, 20 bp, Artificial Sequence
  Description of Artificial Sequence: Synthetic oligonucleotide
  Target: ATXN1; (-) strand; PAM type: NRG; PAM sequence: AAG
ttttagagtcacttaacgaa

SEQ ID NO: 47552 - DNA, 20 bp, Artificial Sequence
  Description of Artificial Sequence: Synthetic oligonucleotide
  Target: ATXN1; (-) strand; PAM type: NRG; PAM sequence: GAG
taggttgggattttatttta

SEQ ID NO: 47553 - DNA, 20 bp, Artificial Sequence
  Description of Artificial Sequence: Synthetic oligonucleotide
  Target: ATXN1; (-) strand; PAM type: NRG; PAM sequence: TAG
tttaggttgggattttattt

SEQ ID NO: 47554 - DNA, 20 bp, Artificial Sequence
  Description of Artificial Sequence: Synthetic oligonucleotide
  Target: ATXN1; (-) strand; PAM type: NRG; PAM sequence: GGG
tgactcagcaattttaggtt

SEQ ID NO: 47555 - DNA, 20 bp, Artificial Sequence
  Description of Artificial Sequence: Synthetic oligonucleotide
  Target: ATXN1; (-) strand; PAM type: NRG; PAM sequence: TGG
ctgactcagcaattttaggt

SEQ ID NO: 47556 - DNA, 20 bp, Artificial Sequence
  Description of Artificial Sequence: Synthetic oligonucleotide
  Target: ATXN1; (-) strand; PAM type: NRG; PAM sequence: AGG
cccactgactcagcaatttt

SEQ ID NO: 47557 - DNA, 20 bp, Artificial Sequence
  Description of Artificial Sequence: Synthetic oligonucleotide
  Target: ATXN1; (-) strand; PAM type: NRG; PAM sequence: TAG
tcccactgactcagcaattt

SEQ ID NO: 47558 - DNA, 20 bp, Artificial Sequence
  Description of Artificial Sequence: Synthetic oligonucleotide
  Target: ATXN1; (-) strand; PAM type: NRG; PAM sequence: CAG
ctgagaaattcccactgact

SEQ ID NO: 47559 - DNA, 20 bp, Artificial Sequence
  Description of Artificial Sequence: Synthetic oligonucleotide
  Target: ATXN1; (-) strand; PAM type: NRG; PAM sequence: GAG
cagcggaacatggattccct

SEQ ID NO: 47560 - DNA, 20 bp, Artificial Sequence
  Description of Artificial Sequence: Synthetic oligonucleotide
  Target: ATXN1; (-) strand; PAM type: NRG; PAM sequence: TGG
tttctagagccagcggaaca

SEQ ID NO: 47561 - DNA, 20 bp, Artificial Sequence
  Description of Artificial Sequence: Synthetic oligonucleotide
  Target: ATXN1; (-) strand; PAM type: NRG; PAM sequence: CGG
aaaatcatttctagagccag

SEQ ID NO: 47562 - DNA, 20 bp, Artificial Sequence
  Description of Artificial Sequence: Synthetic oligonucleotide
  Target: ATXN1; (-) strand; PAM type: NRG; PAM sequence: CAG
atcaaaatcatttctagagc

SEQ ID NO: 47563 - DNA, 20 bp, Artificial Sequence
  Description of Artificial Sequence: Synthetic oligonucleotide
  Target: ATXN1; (-) strand; PAM type: NRG; PAM sequence: GAG
cataatcaaaatcatttcta

SEQ ID NO: 47564 - DNA, 20 bp, Artificial Sequence
  Description of Artificial Sequence: Synthetic oligonucleotide
  Target: ATXN1; (-) strand; PAM type: NRG; PAM sequence: TAG
ctcataatcaaaatcatttc

SEQ ID NO: 47565 - DNA, 20 bp, Artificial Sequence
  Description of Artificial Sequence: Synthetic oligonucleotide
  Target: ATXN1; (-) strand; PAM type: NRG; PAM sequence: CAG
tgaacatggtaaataaaagc

SEQ ID NO: 47566 - DNA, 20 bp, Artificial Sequence
  Description of Artificial Sequence: Synthetic oligonucleotide
  Target: ATXN1; (-) strand; PAM type: NRG; PAM sequence: AAG
gttctgaacatggtaaataa

SEQ ID NO: 47567 - DNA, 20 bp, Artificial Sequence
  Description of Artificial Sequence: Synthetic oligonucleotide
  Target: ATXN1; (-) strand; PAM type: NRG; PAM sequence: TGG
acactttcaagttctgaaca

SEQ ID NO: 47568 - DNA, 20 bp, Artificial Sequence
  Description of Artificial Sequence: Synthetic oligonucleotide
  Target: ATXN1; (-) strand; PAM type: NRG; PAM sequence: AAG
ttaatgaactggacactttc

SEQ ID NO: 47569 - DNA, 20 bp, Artificial Sequence
  Description of Artificial Sequence: Synthetic oligonucleotide
  Target: ATXN1; (-) strand; PAM type: NRG; PAM sequence: TGG
agctcttgaacttaatgaac

SEQ ID NO: 47570 - DNA, 20 bp, Artificial Sequence
  Description of Artificial Sequence: Synthetic oligonucleotide
  Target: ATXN1; (-) strand; PAM type: NRG; PAM sequence: CAG
ggtctacctttaagcgactc

SEQ ID NO: 47571 - DNA, 20 bp, Artificial Sequence
  Description of Artificial Sequence: Synthetic oligonucleotide
  Target: ATXN1; (-) strand; PAM type: NRG; PAM sequence: AAG
atcattcagggtctaccttt

SEQ ID NO: 47572 - DNA, 20 bp, Artificial Sequence
  Description of Artificial Sequence: Synthetic oligonucleotide
  Target: ATXN1; (-) strand; PAM type: NRG; PAM sequence: GGG
ggtccttaaggcatcattca

SEQ ID NO: 47573 - DNA, 20 bp, Artificial Sequence
  Description of Artificial Sequence: Synthetic oligonucleotide
  Target: ATXN1; (-) strand; PAM type: NRG; PAM sequence: AGG
gggtccttaaggcatcattc

SEQ ID NO: 47574 - DNA, 20 bp, Artificial Sequence
  Description of Artificial Sequence: Synthetic oligonucleotide
  Target: ATXN1; (-) strand; PAM type: NRG; PAM sequence: CAG
ggggtccttaaggcatcatt

SEQ ID NO: 47575 - DNA, 20 bp, Artificial Sequence
  Description of Artificial Sequence: Synthetic oligonucleotide
  Target: ATXN1; (-) strand; PAM type: NRG; PAM sequence: AGG
aatacagtggggggtcctta

SEQ ID NO: 47576 - DNA, 20 bp, Artificial Sequence
  Description of Artificial Sequence: Synthetic oligonucleotide
  Target: ATXN1; (-) strand; PAM type: NRG; PAM sequence: AAG
aaatacagtggggggtcctt

SEQ ID NO: 47577 - DNA, 20 bp, Artificial Sequence
  Description of Artificial Sequence: Synthetic oligonucleotide
  Target: ATXN1; (-) strand; PAM type: NRG; PAM sequence: GGG
tgtaatgaaaatacagtggg

SEQ ID NO: 47578 - DNA, 20 bp, Artificial Sequence
  Description of Artificial Sequence: Synthetic oligonucleotide
  Target: ATXN1; (-) strand; PAM type: NRG; PAM sequence: GGG
gtgtaatgaaaatacagtgg

SEQ ID NO: 47579 - DNA, 20 bp, Artificial Sequence
  Description of Artificial Sequence: Synthetic oligonucleotide
  Target: ATXN1; (-) strand; PAM type: NRG; PAM sequence: GGG
agtgtaatgaaaatacagtg

SEQ ID NO: 47580 - DNA, 20 bp, Artificial Sequence
  Description of Artificial Sequence: Synthetic oligonucleotide
  Target: ATXN1; (-) strand; PAM type: NRG; PAM sequence: GGG
tagtgtaatgaaaatacagt

SEQ ID NO: 47581 - DNA, 20 bp, Artificial Sequence
  Description of Artificial Sequence: Synthetic oligonucleotide
  Target: ATXN1; (-) strand; PAM type: NRG; PAM sequence: TGG
ttagtgtaatgaaaatacag

SEQ ID NO: 47582 - DNA, 20 bp, Artificial Sequence
  Description of Artificial Sequence: Synthetic oligonucleotide
  Target: ATXN1; (-) strand; PAM type: NRG; PAM sequence: CAG
ggtttagtgtaatgaaaata

SEQ ID NO: 47583 - DNA, 20 bp, Artificial Sequence
  Description of Artificial Sequence: Synthetic oligonucleotide
  Target: ATXN1; (-) strand; PAM type: NRG; PAM sequence: TAG
gctgcctaagtgccatggtt

SEQ ID NO: 47584 - DNA, 20 bp, Artificial Sequence
  Description of Artificial Sequence: Synthetic oligonucleotide
  Target: ATXN1; (-) strand; PAM type: NRG; PAM sequence: TGG
tactggctgcctaagtgcca

SEQ ID NO: 47585 - DNA, 20 bp, Artificial Sequence
  Description of Artificial Sequence: Synthetic oligonucleotide
  Target: ATXN1; (-) strand; PAM type: NRG; PAM sequence: AAG
tccagctttactggctgcct

SEQ ID NO: 47586 - DNA, 20 bp, Artificial Sequence
  Description of Artificial Sequence: Synthetic oligonucleotide
  Target: ATXN1; (-) strand; PAM type: NRG; PAM sequence: TGG
agttctgactccagctttac

SEQ ID NO: 47587 - DNA, 20 bp, Artificial Sequence
  Description of Artificial Sequence: Synthetic oligonucleotide
  Target: ATXN1; (-) strand; PAM type: NRG; PAM sequence: CAG
ctgaatcagagttctgactc

SEQ ID NO: 47588 - DNA, 20 bp, Artificial Sequence
  Description of Artificial Sequence: Synthetic oligonucleotide
  Target: ATXN1; (-) strand; PAM type: NRG; PAM sequence: GAG
aaatgaggtgctctgaatca

SEQ ID NO: 47589 - DNA, 20 bp, Artificial Sequence
  Description of Artificial Sequence: Synthetic oligonucleotide
  Target: ATXN1; (-) strand; PAM type: NRG; PAM sequence: CAG
gtaaatgaggtgctctgaat

SEQ ID NO: 47590 - DNA, 20 bp, Artificial Sequence
  Description of Artificial Sequence: Synthetic oligonucleotide
  Target: ATXN1; (-) strand; PAM type: NRG; PAM sequence: AGG
ggaattattttctgtaaatg

SEQ ID NO: 47591 - DNA, 20 bp, Artificial Sequence
  Description of Artificial Sequence: Synthetic oligonucleotide
  Target: ATXN1; (-) strand; PAM type: NRG; PAM sequence: GAG
gggaattattttctgtaaat

SEQ ID NO: 47592 - DNA, 20 bp, Artificial Sequence
  Description of Artificial Sequence: Synthetic oligonucleotide
  Target: ATXN1; (-) strand; PAM type: NRG; PAM sequence: GGG
aattcaggcaattcagtttg

SEQ ID NO: 47593 - DNA, 20 bp, Artificial Sequence
  Description of Artificial Sequence: Synthetic oligonucleotide
  Target: ATXN1; (-) strand; PAM type: NRG; PAM sequence: GGG
aaattcaggcaattcagttt

SEQ ID NO: 47594 - DNA, 20 bp, Artificial Sequence
  Description of Artificial Sequence: Synthetic oligonucleotide
  Target: ATXN1; (-) strand; PAM type: NRG; PAM sequence: TGG
caaattcaggcaattcagtt

SEQ ID NO: 47595 - DNA, 20 bp, Artificial Sequence
  Description of Artificial Sequence: Synthetic oligonucleotide
  Target: ATXN1; (-) strand; PAM type: NRG; PAM sequence: CAG
ttagtcaaattcaggcaatt

SEQ ID NO: 47596 - DNA, 20 bp, Artificial Sequence
  Description of Artificial Sequence: Synthetic oligonucleotide
  Target: ATXN1; (-) strand; PAM type: NRG; PAM sequence: AGG
ccctatacttagtcaaattc

SEQ ID NO: 47597 - DNA, 20 bp, Artificial Sequence
  Description of Artificial Sequence: Synthetic oligonucleotide
  Target: ATXN1; (-) strand; PAM type: NRG; PAM sequence: CAG
gccctatacttagtcaaatt

SEQ ID NO: 47598 - DNA, 20 bp, Artificial Sequence
  Description of Artificial Sequence: Synthetic oligonucleotide
  Target: ATXN1; (-) strand; PAM type: NRG; PAM sequence: TAG
ttaaaatggtgccctatact

SEQ ID NO: 47599 - DNA, 20 bp, Artificial Sequence
  Description of Artificial Sequence: Synthetic oligonucleotide
  Target: ATXN1; (-) strand; PAM type: NRG; PAM sequence: TGG
gcatgaagccatttttaaaa

SEQ ID NO: 47600 - DNA, 20 bp, Artificial Sequence
  Description of Artificial Sequence: Synthetic oligonucleotide
  Target: ATXN1; (-) strand; PAM type: NRG; PAM sequence: AAG
aaatctagaacctcagcatg

SEQ ID NO: 47601 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaatctagaacct

SEQ ID NO: 47602 - DNA, 20 bp, Artificial Sequence
  Description of Artificial Sequence: Synthetic oligonucleotide
  Target: ATXN1; (-) strand; PAM type: NRG; PAM sequence: TAG
atctccaaaaaaaaaaaatc

SEQ ID NO: 47603 - DNA, 20 bp, Artificial Sequence
  Description of Artificial Sequence: Synthetic oligonucleotide
  Target: ATXN1; (-) strand; PAM type: NRG; PAM sequence: GAG
ctccagcctggcgacagaac

SEQ ID NO: 47604 - DNA, 20 bp, Artificial Sequence
  Description of Artificial Sequence: Synthetic oligonucleotide
  Target: ATXN1; (-) strand; PAM type: NRG; PAM sequence: CAG
actgcactccagcctggcga

SEQ ID NO: 47605 - DNA, 20 bp, Artificial Sequence
  Description of Artificial Sequence: Synthetic oligonucleotide
  Target: ATXN1; (-) strand; PAM type: NRG; PAM sequence: TGG
cgcgccactgcactccagcc

SEQ ID NO: 47606 - DNA, 20 bp, Artificial Sequence
  Description of Artificial Sequence: Synthetic oligonucleotide
  Target: ATXN1; (-) strand; PAM type: NRG; PAM sequence: CAG
gagatcgcgccactgcactc

SEQ ID NO: 47607 - DNA, 20 bp, Artificial Sequence
  Description of Artificial Sequence: Synthetic oligonucleotide
  Target: ATXN1; (-) strand; PAM type: NRG; PAM sequence: GAG
ggcggagcttgcagtgagct

SEQ ID NO: 47608 - DNA, 20 bp, Artificial Sequence
  Description of Artificial Sequence: Synthetic oligonucleotide
  Target: ATXN1; (-) strand; PAM type: NRG; PAM sequence: GAG
gtggaggcggagcttgcagt

SEQ ID NO: 47609 - DNA, 20 bp, Artificial Sequence
  Description of Artificial Sequence: Synthetic oligonucleotide
  Target: ATXN1; (-) strand; PAM type: NRG; PAM sequence: CAG
gaacgtggaggcggagcttg

SEQ ID NO: 47610 - DNA, 20 bp, Artificial Sequence
  Description of Artificial Sequence: Synthetic oligonucleotide
  Target: ATXN1; (-) strand; PAM type: NRG; PAM sequence: GAG
atggtgtgaacgtggaggcg

SEQ ID NO: 47611 - DNA, 20 bp, Artificial Sequence
  Description of Artificial Sequence: Synthetic oligonucleotide
  Target: ATXN1; (-) strand; PAM type: NRG; PAM sequence: CGG
gaatggtgtgaacgtggagg

SEQ ID NO: 47612 - DNA, 20 bp, Artificial Sequence
  Description of Artificial Sequence: Synthetic oligonucleotide
  Target: ATXN1; (-) strand; PAM type: NRG; PAM sequence: AGG
ggagaatggtgtgaacgtgg

SEQ ID NO: 47613 - DNA, 20 bp, Artificial Sequence
  Description of Artificial Sequence: Synthetic oligonucleotide
  Target: ATXN1; (-) strand; PAM type: NRG; PAM sequence: GAG
aggagaatggtgtgaacgtg

SEQ ID NO: 47614 - DNA, 20 bp, Artificial Sequence
  Description of Artificial Sequence: Synthetic oligonucleotide
  Target: ATXN1; (-) strand; PAM type: NRG; PAM sequence: TGG
gcaggagaatggtgtgaacg

SEQ ID NO: 47615 - DNA, 20 bp, Artificial Sequence
  Description of Artificial Sequence: Synthetic oligonucleotide
  Target: ATXN1; (-) strand; PAM type: NRG; PAM sequence: TGG
gggaggctgaggcaggagaa

SEQ ID NO: 47616 - DNA, 20 bp, Artificial Sequence
  Description of Artificial Sequence: Synthetic oligonucleotide
  Target: ATXN1; (-) strand; PAM type: NRG; PAM sequence: GAG
tactcgggaggctgaggcag

SEQ ID NO: 47617 - DNA, 20 bp, Artificial Sequence
  Description of Artificial Sequence: Synthetic oligonucleotide
  Target: ATXN1; (-) strand; PAM type: NRG; PAM sequence: AGG
gatactcgggaggctgaggc

SEQ ID NO: 47618 - DNA, 20 bp, Artificial Sequence
  Description of Artificial Sequence: Synthetic oligonucleotide
  Target: ATXN1; (-) strand; PAM type: NRG; PAM sequence: CAG
agatactcgggaggctgagg

SEQ ID NO: 47619 - DNA, 20 bp, Artificial Sequence
  Description of Artificial Sequence: Synthetic oligonucleotide
  Target: ATXN1; (-) strand; PAM type: NRG; PAM sequence: AGG
cccagatactcgggaggctg

SEQ ID NO: 47620 - DNA, 20 bp, Artificial Sequence
  Description of Artificial Sequence: Synthetic oligonucleotide
  Target: ATXN1; (-) strand; PAM type: NRG; PAM sequence: GAG
tcccagatactcgggaggct

SEQ ID NO: 47621 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagatactcggg

SEQ ID NO: 47622 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagatactcgg

SEQ ID NO: 47623 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcccagatactc

SEQ ID NO: 47624 - DNA, 20 bp, Artificial Sequence
  Description of Artificial Sequence: Synthetic oligonucleotide
  Target: ATXN1; (-) strand; PAM type: NRG; PAM sequence: CGG
tgcctgtagtcccagatact

SEQ ID NO: 47625 - DNA, 20 bp, Artificial Sequence
  Description of Artificial Sequence: Synthetic oligonucleotide
  Target: ATXN1; (-) strand; PAM type: NRG; PAM sequence: CAG
gtggcgggtgcctgtagtcc

SEQ ID NO: 47626 - DNA, 20 bp, Artificial Sequence
  Description of Artificial Sequence: Synthetic oligonucleotide
  Target: ATXN1; (-) strand; PAM type: NRG; PAM sequence: TAG
ggcgtggtggcgggtgcctg

SEQ ID NO: 47627 - DNA, 20 bp, Artificial Sequence
  Description of Artificial Sequence: Synthetic oligonucleotide
  Target: ATXN1; (-) strand; PAM type: NRG; PAM sequence: GGG
aattagccaggcgtggtggc

SEQ ID NO: 47628 - DNA, 20 bp, Artificial Sequence
  Description of Artificial Sequence: Synthetic oligonucleotide
  Target: ATXN1; (-) strand; PAM type: NRG; PAM sequence: CGG
aaattagccaggcgtggtgg

SEQ ID NO: 47629 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggcgtgg

SEQ ID NO: 47630 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaattagccaggcg

SEQ ID NO: 47631 - DNA, 20 bp, Artificial Sequence
  Description of Artificial Sequence: Synthetic oligonucleotide
  Target: ATXN1; (-) strand; PAM type: NRG; PAM sequence: AGG
aaaaatacaaaaaattagcc

SEQ ID NO: 47632 - DNA, 20 bp, Artificial Sequence
  Description of Artificial Sequence: Synthetic oligonucleotide
  Target: ATXN1; (-) strand; PAM type: NRG; PAM sequence: CAG
taaaaatacaaaaaattagc

SEQ ID NO: 47633 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatacaaaaaat

SEQ ID NO: 47634 - DNA, 20 bp, Artificial Sequence
  Description of Artificial Sequence: Synthetic oligonucleotide
  Target: ATXN1; (-) strand; PAM type: NRG; PAM sequence: CAG
cgagaccatcctggctaaca

SEQ ID NO: 47635 - DNA, 20 bp, Artificial Sequence
  Description of Artificial Sequence: Synthetic oligonucleotide
  Target: ATXN1; (-) strand; PAM type: NRG; PAM sequence: TGG
tcaggagatcgagaccatcc

SEQ ID NO: 47636 - DNA, 20 bp, Artificial Sequence
  Description of Artificial Sequence: Synthetic oligonucleotide
  Target: ATXN1; (-) strand; PAM type: NRG; PAM sequence: GAG
gatcacgaggtcaggagatc

SEQ ID NO: 47637 - DNA, 20 bp, Artificial Sequence
  Description of Artificial Sequence: Synthetic oligonucleotide
  Target: ATXN1; (-) strand; PAM type: NRG; PAM sequence: GAG
cgggcagatcacgaggtcag

SEQ ID NO: 47638 - DNA, 20 bp, Artificial Sequence
  Description of Artificial Sequence: Synthetic oligonucleotide
  Target: ATXN1; (-) strand; PAM type: NRG; PAM sequence: AGG
ggcgggcagatcacgaggtc

SEQ ID NO: 47639 - DNA, 20 bp, Artificial Sequence
  Description of Artificial Sequence: Synthetic oligonucleotide
  Target: ATXN1; (-) strand; PAM type: NRG; PAM sequence: CAG
aggcgggcagatcacgaggt

SEQ ID NO: 47640 - DNA, 20 bp, Artificial Sequence
  Description of Artificial Sequence: Synthetic oligonucleotide
  Target: ATXN1; (-) strand; PAM type: NRG; PAM sequence: AGG
gctgaggcgggcagatcacg

SEQ ID NO: 47641 - DNA, 20 bp, Artificial Sequence
  Description of Artificial Sequence: Synthetic oligonucleotide
  Target: ATXN1; (-) strand; PAM type: NRG; PAM sequence: GAG
ggctgaggcgggcagatcac

SEQ ID NO: 47642 - DNA, 20 bp, Artificial Sequence
  Description of Artificial Sequence: Synthetic oligonucleotide
  Target: ATXN1; (-) strand; PAM type: NRG; PAM sequence: CAG
cattgggaggctgaggcggg

SEQ ID NO: 47643 - DNA, 20 bp, Artificial Sequence
  Description of Artificial Sequence: Synthetic oligonucleotide
  Target: ATXN1; (-) strand; PAM type: NRG; PAM sequence: GGG
gcacattgggaggctgaggc

SEQ ID NO: 47644 - DNA, 20 bp, Artificial Sequence
  Description of Artificial Sequence: Synthetic oligonucleotide
  Target: ATXN1; (-) strand; PAM type: NRG; PAM sequence: CGG
agcacattgggaggctgagg

SEQ ID NO: 47645 - DNA, 20 bp, Artificial Sequence
  Description of Artificial Sequence: Synthetic oligonucleotide
  Target: ATXN1; (-) strand; PAM type: NRG; PAM sequence: AGG
cccagcacattgggaggctg

SEQ ID NO: 47646 - DNA, 20 bp, Artificial Sequence
  Description of Artificial Sequence: Synthetic oligonucleotide
  Target: ATXN1; (-) strand; PAM type: NRG; PAM sequence: GAG
tcccagcacattgggaggct

SEQ ID NO: 47647 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcacattggg

SEQ ID NO: 47648 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcacattgg

SEQ ID NO: 47649 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacatt

SEQ ID NO: 47650 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagcacat

SEQ ID NO: 47651 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctgtaatcc

SEQ ID NO: 47652 - DNA, 20 bp, Artificial Sequence
  Description of Artificial Sequence: Synthetic oligonucleotide
  Target: ATXN1; (-) strand; PAM type: NRG; PAM sequence: TGG
ctagaactggctgggtgcgg

SEQ ID NO: 47653 - DNA, 20 bp, Artificial Sequence
  Description of Artificial Sequence: Synthetic oligonucleotide
  Target: ATXN1; (-) strand; PAM type: NRG; PAM sequence: CGG
tatctagaactggctgggtg

SEQ ID NO: 47654 - DNA, 20 bp, Artificial Sequence
  Description of Artificial Sequence: Synthetic oligonucleotide
  Target: ATXN1; (-) strand; PAM type: NRG; PAM sequence: GGG
caaaatatctagaactggct

SEQ ID NO: 47655 - DNA, 20 bp, Artificial Sequence
  Description of Artificial Sequence: Synthetic oligonucleotide
  Target: ATXN1; (-) strand; PAM type: NRG; PAM sequence: TGG
tcaaaatatctagaactggc

SEQ ID NO: 47656 - DNA, 20 bp, Artificial Sequence
  Description of Artificial Sequence: Synthetic oligonucleotide
  Target: ATXN1; (-) strand; PAM type: NRG; PAM sequence: TGG
cacctcaaaatatctagaac

SEQ ID NO: 47657 - DNA, 20 bp, Artificial Sequence
  Description of Artificial Sequence: Synthetic oligonucleotide
  Target: ATXN1; (-) strand; PAM type: NRG; PAM sequence: TAG
tcttaccacctcaaaatatc

SEQ ID NO: 47658 - DNA, 20 bp, Artificial Sequence
  Description of Artificial Sequence: Synthetic oligonucleotide
  Target: ATXN1; (-) strand; PAM type: NRG; PAM sequence: GGG
caagtatccttgagcagtag

SEQ ID NO: 47659 - DNA, 20 bp, Artificial Sequence
  Description of Artificial Sequence: Synthetic oligonucleotide
  Target: ATXN1; (-) strand; PAM type: NRG; PAM sequence: GGG
acaagtatccttgagcagta

SEQ ID NO: 47660 - DNA, 20 bp, Artificial Sequence
  Description of Artificial Sequence: Synthetic oligonucleotide
  Target: ATXN1; (-) strand; PAM type: NRG; PAM sequence: AGG
aacaagtatccttgagcagt

SEQ ID NO: 47661 - DNA, 20 bp, Artificial Sequence
  Description of Artificial Sequence: Synthetic oligonucleotide
  Target: ATXN1; (-) strand; PAM type: NRG; PAM sequence: TAG
aaacaagtatccttgagcag

SEQ ID NO: 47662 - DNA, 20 bp, Artificial Sequence
  Description of Artificial Sequence: Synthetic oligonucleotide
  Target: ATXN1; (-) strand; PAM type: NRG; PAM sequence: CAG
gagaaacaagtatccttgag

SEQ ID NO: 47663 - DNA, 20 bp, Artificial Sequence
  Description of Artificial Sequence: Synthetic oligonucleotide
  Target: ATXN1; (-) strand; PAM type: NRG; PAM sequence: GAG
catgagaaacaagtatcctt

SEQ ID NO: 47664 - DNA, 20 bp, Artificial Sequence
  Description of Artificial Sequence: Synthetic oligonucleotide
  Target: ATXN1; (-) strand; PAM type: NRG; PAM sequence: AAG
gtccctggcacatgagaaac

SEQ ID NO: 47665 - DNA, 20 bp, Artificial Sequence
  Description of Artificial Sequence: Synthetic oligonucleotide
  Target: ATXN1; (-) strand; PAM type: NRG; PAM sequence: GAG
tgcctgggtccctggcacat

SEQ ID NO: 47666 - DNA, 20 bp, Artificial Sequence
  Description of Artificial Sequence: Synthetic oligonucleotide
  Target: ATXN1; (-) strand; PAM type: NRG; PAM sequence: TGG
gggctcaatgcctgggtccc

SEQ ID NO: 47667 - DNA, 20 bp, Artificial Sequence
  Description of Artificial Sequence: Synthetic oligonucleotide
  Target: ATXN1; (-) strand; PAM type: NRG; PAM sequence: GGG
ttctattgggctcaatgcct

SEQ ID NO: 47668 - DNA, 20 bp, Artificial Sequence
  Description of Artificial Sequence: Synthetic oligonucleotide
  Target: ATXN1; (-) strand; PAM type: NRG; PAM sequence: TGG
tttctattgggctcaatgcc

SEQ ID NO: 47669 - DNA, 20 bp, Artificial Sequence
  Description of Artificial Sequence: Synthetic oligonucleotide
  Target: ATXN1; (-) strand; PAM type: NRG; PAM sequence: GGG
tatttctatggctttctatt

SEQ ID NO: 47670 - DNA, 20 bp, Artificial Sequence
  Description of Artificial Sequence: Synthetic oligonucleotide
  Target: ATXN1; (-) strand; PAM type: NRG; PAM sequence: TGG
ttatttctatggctttctat

SEQ ID NO: 47671 - DNA, 20 bp, Artificial Sequence
  Description of Artificial Sequence: Synthetic oligonucleotide
  Target: ATXN1; (-) strand; PAM type: NRG; PAM sequence: TGG
cacatccaggcttatttcta

SEQ ID NO: 47672 - DNA, 20 bp, Artificial Sequence
  Description of Artificial Sequence: Synthetic oligonucleotide
  Target: ATXN1; (-) strand; PAM type: NRG; PAM sequence: AGG
tcatgaatagcatcacatcc

SEQ ID NO: 47673 - DNA, 20 bp, Artificial Sequence
  Description of Artificial Sequence: Synthetic oligonucleotide
  Target: ATXN1; (-) strand; PAM type: NRG; PAM sequence: CAG
ttcatgaatagcatcacatc

SEQ ID NO: 47674 - DNA, 20 bp, Artificial Sequence
  Description of Artificial Sequence: Synthetic oligonucleotide
  Target: ATXN1; (-) strand; PAM type: NRG; PAM sequence: TAG
gagactgtgacattcatgaa

SEQ ID NO: 47675 - DNA, 20 bp, Artificial Sequence
  Description of Artificial Sequence: Synthetic oligonucleotide
  Target: ATXN1; (-) strand; PAM type: NRG; PAM sequence: GAG
ttaataaaatggggtttaag

SEQ ID NO: 47676 - DNA, 20 bp, Artificial Sequence
  Description of Artificial Sequence: Synthetic oligonucleotide
  Target: ATXN1; (-) strand; PAM type: NRG; PAM sequence: AGG
gtttaataaaatggggttta

SEQ ID NO: 47677 - DNA, 20 bp, Artificial Sequence
  Description of Artificial Sequence: Synthetic oligonucleotide
  Target: ATXN1; (-) strand; PAM type: NRG; PAM sequence: AAG
agtttaataaaatggggttt

SEQ ID NO: 47678 - DNA, 20 bp, Artificial Sequence
  Description of Artificial Sequence: Synthetic oligonucleotide
  Target: ATXN1; (-) strand; PAM type: NRG; PAM sequence: GGG
ctgaacagtttaataaaatg

SEQ ID NO: 47679 - DNA, 20 bp, Artificial Sequence
  Description of Artificial Sequence: Synthetic oligonucleotide
  Target: ATXN1; (-) strand; PAM type: NRG; PAM sequence: GGG
cctgaacagtttaataaaat

SEQ ID NO: 47680 - DNA, 20 bp, Artificial Sequence
  Description of Artificial Sequence: Synthetic oligonucleotide
  Target: ATXN1; (-) strand; PAM type: NRG; PAM sequence: TGG
ccctgaacagtttaataaaa

SEQ ID NO: 47681 - DNA, 20 bp, Artificial Sequence
  Description of Artificial Sequence: Synthetic oligonucleotide
  Target: ATXN1; (-) strand; PAM type: NRG; PAM sequence: CAG
tgaacgagtggatccctgaa

SEQ ID NO: 47682 - DNA, 20 bp, Artificial Sequence
  Description of Artificial Sequence: Synthetic oligonucleotide
  Target: ATXN1; (-) strand; PAM type: NRG; PAM sequence: TGG
tgttgaataatctgaacgag

SEQ ID NO: 47683 - DNA, 20 bp, Artificial Sequence
  Description of Artificial Sequence: Synthetic oligonucleotide
  Target: ATXN1; (-) strand; PAM type: NRG; PAM sequence: GAG
aaatgttgaataatctgaac

SEQ ID NO: 47684 - DNA, 20 bp, Artificial Sequence
  Description of Artificial Sequence: Synthetic oligonucleotide
  Target: ATXN1; (-) strand; PAM type: NRG; PAM sequence: TGG
tcccaccaccatgatgtgcc

SEQ ID NO: 47685 - DNA, 20 bp, Artificial Sequence
  Description of Artificial Sequence: Synthetic oligonucleotide
  Target: ATXN1; (-) strand; PAM type: NRG; PAM sequence: AAG
cttgaaggagacaaggcacc

SEQ ID NO: 47686 - DNA, 20 bp, Artificial Sequence
  Description of Artificial Sequence: Synthetic oligonucleotide
  Target: ATXN1; (-) strand; PAM type: NRG; PAM sequence: AGG
gaagctccttgaaggagaca

SEQ ID NO: 47687 - DNA, 20 bp, Artificial Sequence
  Description of Artificial Sequence: Synthetic oligonucleotide
  Target: ATXN1; (-) strand; PAM type: NRG; PAM sequence: AAG
ggaagctccttgaaggagac

SEQ ID NO: 47688 - DNA, 20 bp, Artificial Sequence
  Description of Artificial Sequence: Synthetic oligonucleotide
  Target: ATXN1; (-) strand; PAM type: NRG; PAM sequence: GAG
ggactggaagctccttgaag

SEQ ID NO: 47689 - DNA, 20 bp, Artificial Sequence
  Description of Artificial Sequence: Synthetic oligonucleotide
  Target: ATXN1; (-) strand; PAM type: NRG; PAM sequence: AGG
gtggactggaagctccttga

SEQ ID NO: 47690 - DNA, 20 bp, Artificial Sequence
  Description of Artificial Sequence: Synthetic oligonucleotide
  Target: ATXN1; (-) strand; PAM type: NRG; PAM sequence: AAG
tgtggactggaagctccttg

SEQ ID NO: 47691 - DNA, 20 bp, Artificial Sequence
  Description of Artificial Sequence: Synthetic oligonucleotide
  Target: ATXN1; (-) strand; PAM type: NRG; PAM sequence: AAG
gttagccccttgtggactgg

SEQ ID NO: 47692 - DNA, 20 bp, Artificial Sequence
  Description of Artificial Sequence: Synthetic oligonucleotide
  Target: ATXN1; (-) strand; PAM type: NRG; PAM sequence: TGG
cctgttagccccttgtggac

SEQ ID NO: 47693 - DNA, 20 bp, Artificial Sequence
  Description of Artificial Sequence: Synthetic oligonucleotide
  Target: ATXN1; (-) strand; PAM type: NRG; PAM sequence: TGG
atttccctgttagccccttg

SEQ ID NO: 47694 - DNA, 20 bp, Artificial Sequence
  Description of Artificial Sequence: Synthetic oligonucleotide
  Target: ATXN1; (-) strand; PAM type: NRG; PAM sequence: TAG
gtcaccactcatttccctgt

SEQ ID NO: 47695 - DNA, 20 bp, Artificial Sequence
  Description of Artificial Sequence: Synthetic oligonucleotide
  Target: ATXN1; (-) strand; PAM type: NRG; PAM sequence: TAG
gagcaactgccttttagctg

SEQ ID NO: 47696 - DNA, 20 bp, Artificial Sequence
  Description of Artificial Sequence: Synthetic oligonucleotide
  Target: ATXN1; (-) strand; PAM type: NRG; PAM sequence: TAG
agacaggagcaactgccttt

SEQ ID NO: 47697 - DNA, 20 bp, Artificial Sequence
  Description of Artificial Sequence: Synthetic oligonucleotide
  Target: ATXN1; (-) strand; PAM type: NRG; PAM sequence: GAG
ccgccattctgggaagacag

SEQ ID NO: 47698 - DNA, 20 bp, Artificial Sequence
  Description of Artificial Sequence: Synthetic oligonucleotide
  Target: ATXN1; (-) strand; PAM type: NRG; PAM sequence: AGG
caccgccattctgggaagac

SEQ ID NO: 47699 - DNA, 20 bp, Artificial Sequence
  Description of Artificial Sequence: Synthetic oligonucleotide
  Target: ATXN1; (-) strand; PAM type: NRG; PAM sequence: CAG
tcaccgccattctgggaaga

SEQ ID NO: 47700 - DNA, 20 bp, Artificial Sequence
  Description of Artificial Sequence: Synthetic oligonucleotide
  Target: ATXN1; (-) strand; PAM type: NRG; PAM sequence: AAG
cttatcaccgccattctggg

SEQ ID NO: 47701 - DNA, 20 bp, Artificial Sequence
  Description of Artificial Sequence: Synthetic oligonucleotide
  Target: ATXN1; (-) strand; PAM type: NRG; PAM sequence: GGG
tagcttatcaccgccattct

SEQ ID NO: 47702 - DNA, 20 bp, Artificial Sequence
  Description of Artificial Sequence: Synthetic oligonucleotide
  Target: ATXN1; (-) strand; PAM type: NRG; PAM sequence: TGG
ctagcttatcaccgccattc

SEQ ID NO: 47703 - DNA, 20 bp, Artificial Sequence
  Description of Artificial Sequence: Synthetic oligonucleotide
  Target: ATXN1; (-) strand; PAM type: NRG; PAM sequence: TAG
gtctctcctgggtatacctc

SEQ ID NO: 47704 - DNA, 20 bp, Artificial Sequence
  Description of Artificial Sequence: Synthetic oligonucleotide
  Target: ATXN1; (-) strand; PAM type: NRG; PAM sequence: GGG
ttttgctggttgtctctcct

SEQ ID NO: 47705 - DNA, 20 bp, Artificial Sequence
  Description of Artificial Sequence: Synthetic oligonucleotide
  Target: ATXN1; (-) strand; PAM type: NRG; PAM sequence: TGG
cttttgctggttgtctctcc

SEQ ID NO: 47706 - DNA, 20 bp, Artificial Sequence
  Description of Artificial Sequence: Synthetic oligonucleotide
  Target: ATXN1; (-) strand; PAM type: NRG; PAM sequence: TGG
ttgaggtgtcacacttttgc

SEQ ID NO: 47707 - DNA, 20 bp, Artificial Sequence
  Description of Artificial Sequence: Synthetic oligonucleotide
  Target: ATXN1; (-) strand; PAM type: NRG; PAM sequence: AGG
gaaaacaacagtgctgattg

SEQ ID NO: 47708 - DNA, 20 bp, Artificial Sequence
  Description of Artificial Sequence: Synthetic oligonucleotide
  Target: ATXN1; (-) strand; PAM type: NRG; PAM sequence: GAG
agaaaacaacagtgctgatt

SEQ ID NO: 47709 - DNA, 20 bp, Artificial Sequence
  Description of Artificial Sequence: Synthetic oligonucleotide
  Target: ATXN1; (-) strand; PAM type: NRG; PAM sequence: CAG
aaaaaagaaaaagaaaacaa

SEQ ID NO: 47710 - DNA, 20 bp, Artificial Sequence
  Description of Artificial Sequence: Synthetic oligonucleotide
  Target: ATXN1; (-) strand; PAM type: NRG; PAM sequence: AAG
tatatatatgaaaaaagaaa

SEQ ID NO: 47711 - DNA, 20 bp, Artificial Sequence
  Description of Artificial Sequence: Synthetic oligonucleotide
  Target: ATXN1; (-) strand; PAM type: NRG; PAM sequence: AAG
aatatatatatatatgaaaa

SEQ ID NO: 47712 - DNA, 20 bp, Artificial Sequence
  Description of Artificial Sequence: Synthetic oligonucleotide
  Target: ATXN1; (-) strand; PAM type: NRG; PAM sequence: AAG
catatgtaccctagaactta

SEQ ID NO: 47713 - DNA, 20 bp, Artificial Sequence
  Description of Artificial Sequence: Synthetic oligonucleotide
  Target: ATXN1; (-) strand; PAM type: NRG; PAM sequence: TAG
cacattgtgcatatgtaccc

SEQ ID NO: 47714 - DNA, 20 bp, Artificial Sequence
  Description of Artificial Sequence: Synthetic oligonucleotide
  Target: ATXN1; (-) strand; PAM type: NRG; PAM sequence: TGG
tggaactccttgctctgcta

SEQ ID NO: 47715 - DNA, 20 bp, Artificial Sequence
  Description of Artificial Sequence: Synthetic oligonucleotide
  Target: ATXN1; (-) strand; PAM type: NRG; PAM sequence: TGG
gaaaaccggtaattctgttt

SEQ ID NO: 47716 - DNA, 20 bp, Artificial Sequence
  Description of Artificial Sequence: Synthetic oligonucleotide
  Target: ATXN1; (-) strand; PAM type: NRG; PAM sequence: CGG
aataagaaaaaaaagaaaac

SEQ ID NO: 47717 - DNA, 20 bp, Artificial Sequence
  Description of Artificial Sequence: Synthetic oligonucleotide
  Target: ATXN1; (-) strand; PAM type: NRG; PAM sequence: AAG
tttgtctcaataagaaaaaa

SEQ ID NO: 47718 - DNA, 20 bp, Artificial Sequence
  Description of Artificial Sequence: Synthetic oligonucleotide
  Target: ATXN1; (-) strand; PAM type: NRG; PAM sequence: AAG
gagtgagactttgtctcaat

SEQ ID NO: 47719 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggcaacagagt

SEQ ID NO: 47720 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcaaca

SEQ ID NO: 47721 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcaa

SEQ ID NO: 47722 - DNA, 20 bp, Artificial Sequence
  Description of Artificial Sequence: Synthetic oligonucleotide
  Target: ATXN1; (-) strand; PAM type: NRG; PAM sequence: GGG
gcaccactgcactccagcct

SEQ ID NO: 47723 - DNA, 20 bp, Artificial Sequence
  Description of Artificial Sequence: Synthetic oligonucleotide
  Target: ATXN1; (-) strand; PAM type: NRG; PAM sequence: TGG
tgcaccactgcactccagcc

SEQ ID NO: 47724 - DNA, 20 bp, Artificial Sequence
  Description of Artificial Sequence: Synthetic oligonucleotide
  Target: ATXN1; (-) strand; PAM type: NRG; PAM sequence: CAG
aaggttgcaccactgcactc

SEQ ID NO: 47725 - DNA, 20 bp, Artificial Sequence
  Description of Artificial Sequence: Synthetic oligonucleotide
  Target: ATXN1; (-) strand; PAM type: NRG; PAM sequence: AGG
gcagaggttgcagtaagcca

SEQ ID NO: 47726 - DNA, 20 bp, Artificial Sequence
  Description of Artificial Sequence: Synthetic oligonucleotide
  Target: ATXN1; (-) strand; PAM type: NRG; PAM sequence: AAG
ggcagaggttgcagtaagcc

SEQ ID NO: 47727 - DNA, 20 bp, Artificial Sequence
  Description of Artificial Sequence: Synthetic oligonucleotide
  Target: ATXN1; (-) strand; PAM type: NRG; PAM sequence: AAG
tgggaggcagaggttgcagt

SEQ ID NO: 47728 - DNA, 20 bp, Artificial Sequence
  Description of Artificial Sequence: Synthetic oligonucleotide
  Target: ATXN1; (-) strand; PAM type: NRG; PAM sequence: CAG
aacttgggaggcagaggttg

SEQ ID NO: 47729 - DNA, 20 bp, Artificial Sequence
  Description of Artificial Sequence: Synthetic oligonucleotide
  Target: ATXN1; (-) strand; PAM type: NRG; PAM sequence: AGG
cacttgaacttgggaggcag

SEQ ID NO: 47730 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacttgggaggca

SEQ ID NO: 47731 - DNA, 20 bp, Artificial Sequence
  Description of Artificial Sequence: Synthetic oligonucleotide
  Target: ATXN1; (-) strand; PAM type: NRG; PAM sequence: CAG
aatcacttgaacttgggagg

SEQ ID NO: 47732 - DNA, 20 bp, Artificial Sequence
  Description of Artificial Sequence: Synthetic oligonucleotide
  Target: ATXN1; (-) strand; PAM type: NRG; PAM sequence: AGG
aagaatcacttgaacttggg

SEQ ID NO: 47733 - DNA, 20 bp, Artificial Sequence
  Description of Artificial Sequence: Synthetic oligonucleotide
  Target: ATXN1; (-) strand; PAM type: NRG; PAM sequence: GAG
gaagaatcacttgaacttgg

SEQ ID NO: 47734 - DNA, 20 bp, Artificial Sequence
  Description of Artificial Sequence: Synthetic oligonucleotide
  Target: ATXN1; (-) strand; PAM type: NRG; PAM sequence: GGG
cagaagaatcacttgaactt

SEQ ID NO: 47735 - DNA, 20 bp, Artificial Sequence
  Description of Artificial Sequence: Synthetic oligonucleotide
  Target: ATXN1; (-) strand; PAM type: NRG; PAM sequence: TGG
gcagaagaatcacttgaact

SEQ ID NO: 47736 - DNA, 20 bp, Artificial Sequence
  Description of Artificial Sequence: Synthetic oligonucleotide
  Target: ATXN1; (-) strand; PAM type: NRG; PAM sequence: AAG
tactcaggaggctgaggcag

SEQ ID NO: 47737 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgagg

SEQ ID NO: 47738 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 47739 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 47740 - DNA, 20 bp, Artificial Sequence
  Description of Artificial Sequence: Synthetic oligonucleotide
  Target: ATXN1; (-) strand; PAM type: NRG; PAM sequence: AGG
tgcagtcccagctactcagg

SEQ ID NO: 47741 - DNA, 20 bp, Artificial Sequence
  Description of Artificial Sequence: Synthetic oligonucleotide
  Target: ATXN1; (-) strand; PAM type: NRG; PAM sequence: GAG
ctgcagtcccagctactcag

SEQ ID NO: 47742 - DNA, 20 bp, Artificial Sequence
  Description of Artificial Sequence: Synthetic oligonucleotide
  Target: ATXN1; (-) strand; PAM type: NRG; PAM sequence: AGG
gcctgcagtcccagctactc

SEQ ID NO: 47743 - DNA, 20 bp, Artificial Sequence
  Description of Artificial Sequence: Synthetic oligonucleotide
  Target: ATXN1; (-) strand; PAM type: NRG; PAM sequence: CAG
tgcctgcagtcccagctact

SEQ ID NO: 47744 - DNA, 20 bp, Artificial Sequence
  Description of Artificial Sequence: Synthetic oligonucleotide
  Target: ATXN1; (-) strand; PAM type: NRG; PAM sequence: CAG
gtgatgcgtgcctgcagtcc

SEQ ID NO: 47745 - DNA, 20 bp, Artificial Sequence
  Description of Artificial Sequence: Synthetic oligonucleotide
  Target: ATXN1; (-) strand; PAM type: NRG; PAM sequence: CAG
ggcgtggtgatgcgtgcctg

SEQ ID NO: 47746 - DNA, 20 bp, Artificial Sequence
  Description of Artificial Sequence: Synthetic oligonucleotide
  Target: ATXN1; (-) strand; PAM type: NRG; PAM sequence: TGG
tacaaaaagttaggcaggcg

SEQ ID NO: 47747 - DNA, 20 bp, Artificial Sequence
  Description of Artificial Sequence: Synthetic oligonucleotide
  Target: ATXN1; (-) strand; PAM type: NRG; PAM sequence: AGG
aaaaatacaaaaagttaggc

SEQ ID NO: 47748 - DNA, 20 bp, Artificial Sequence
  Description of Artificial Sequence: Synthetic oligonucleotide
  Target: ATXN1; (-) strand; PAM type: NRG; PAM sequence: CAG
taaaaatacaaaaagttagg

SEQ ID NO: 47749 - DNA, 20 bp, Artificial Sequence
  Description of Artificial Sequence: Synthetic oligonucleotide
  Target: ATXN1; (-) strand; PAM type: NRG; PAM sequence: AGG
tactaaaaatacaaaaagtt

SEQ ID NO: 47750 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatacaaaaagt

SEQ ID NO: 47751 - DNA, 20 bp, Artificial Sequence
  Description of Artificial Sequence: Synthetic oligonucleotide
  Target: ATXN1; (-) strand; PAM type: NRG; PAM sequence: AAG
atctctactaaaaatacaaa

SEQ ID NO: 47752 - DNA, 20 bp, Artificial Sequence
  Description of Artificial Sequence: Synthetic oligonucleotide
  Target: ATXN1; (-) strand; PAM type: NRG; PAM sequence: TGG
cgagaccagcctggccaaca

SEQ ID NO: 47753 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgagaccagcc

SEQ ID NO: 47754 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagttcgagac

SEQ ID NO: 47755 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttc

SEQ ID NO: 47756 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggtcag

SEQ ID NO: 47757 - DNA, 20 bp, Artificial Sequence
  Description of Artificial Sequence: Synthetic oligonucleotide
  Target: ATXN1; (-) strand; PAM type: NRG; PAM sequence: AGG
tgggtggatcacctgaggtc

SEQ ID NO: 47758 - DNA, 20 bp, Artificial Sequence
  Description of Artificial Sequence: Synthetic oligonucleotide
  Target: ATXN1; (-) strand; PAM type: NRG; PAM sequence: CAG
gtgggtggatcacctgaggt

SEQ ID NO: 47759 - DNA, 20 bp, Artificial Sequence
  Description of Artificial Sequence: Synthetic oligonucleotide
  Target: ATXN1; (-) strand; PAM type: NRG; PAM sequence: AGG
caatgtgggtggatcacctg

SEQ ID NO: 47760 - DNA, 20 bp, Artificial Sequence
  Description of Artificial Sequence: Synthetic oligonucleotide
  Target: ATXN1; (-) strand; PAM type: NRG; PAM sequence: GAG
ccaatgtgggtggatcacct

SEQ ID NO: 47761 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccaatgtggg

SEQ ID NO: 47762 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccaatgt

SEQ ID NO: 47763 - DNA, 20 bp, Artificial Sequence
  Description of Artificial Sequence: Synthetic oligonucleotide
  Target: ATXN1; (-) strand; PAM type: NRG; PAM sequence: TGG
agcactttgggaggccaatg

SEQ ID NO: 47764 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 47765 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 47766 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 47767 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagcactt

SEQ ID NO: 47768 - DNA, 20 bp, Artificial Sequence
  Description of Artificial Sequence: Synthetic oligonucleotide
  Target: ATXN1; (-) strand; PAM type: NRG; PAM sequence: CAG
tggctcaatgcctgtaatcc

SEQ ID NO: 47769 - DNA, 20 bp, Artificial Sequence
  Description of Artificial Sequence: Synthetic oligonucleotide
  Target: ATXN1; (-) strand; PAM type: NRG; PAM sequence: TGG
aataattcggccaggcgcag

SEQ ID NO: 47770 - DNA, 20 bp, Artificial Sequence
  Description of Artificial Sequence: Synthetic oligonucleotide
  Target: ATXN1; (-) strand; PAM type: NRG; PAM sequence: CAG
accaataattcggccaggcg

SEQ ID NO: 47771 - DNA, 20 bp, Artificial Sequence
  Description of Artificial Sequence: Synthetic oligonucleotide
  Target: ATXN1; (-) strand; PAM type: NRG; PAM sequence: AGG
tgaaaaccaataattcggcc

SEQ ID NO: 47772 - DNA, 20 bp, Artificial Sequence
  Description of Artificial Sequence: Synthetic oligonucleotide
  Target: ATXN1; (-) strand; PAM type: NRG; PAM sequence: CAG
ttgaaaaccaataattcggc

SEQ ID NO: 47773 - DNA, 20 bp, Artificial Sequence
  Description of Artificial Sequence: Synthetic oligonucleotide
  Target: ATXN1; (-) strand; PAM type: NRG; PAM sequence: CGG
cactttgaaaaccaataatt

SEQ ID NO: 47774 - DNA, 20 bp, Artificial Sequence
  Description of Artificial Sequence: Synthetic oligonucleotide
  Target: ATXN1; (-) strand; PAM type: NRG; PAM sequence: AAG
acagtatgaagaagaggaag

SEQ ID NO: 47775 - DNA, 20 bp, Artificial Sequence
  Description of Artificial Sequence: Synthetic oligonucleotide
  Target: ATXN1; (-) strand; PAM type: NRG; PAM sequence: AAG
cttacagtatgaagaagagg

SEQ ID NO: 47776 - DNA, 20 bp, Artificial Sequence
  Description of Artificial Sequence: Synthetic oligonucleotide
  Target: ATXN1; (-) strand; PAM type: NRG; PAM sequence: AGG
gttcttacagtatgaagaag

SEQ ID NO: 47777 - DNA, 20 bp, Artificial Sequence
  Description of Artificial Sequence: Synthetic oligonucleotide
  Target: ATXN1; (-) strand; PAM type: NRG; PAM sequence: GAG
tgttcttacagtatgaagaa

SEQ ID NO: 47778 - DNA, 20 bp, Artificial Sequence
  Description of Artificial Sequence: Synthetic oligonucleotide
  Target: ATXN1; (-) strand; PAM type: NRG; PAM sequence: AAG
aatgttcttacagtatgaag

SEQ ID NO: 47779 - DNA, 20 bp, Artificial Sequence
  Description of Artificial Sequence: Synthetic oligonucleotide
  Target: ATXN1; (-) strand; PAM type: NRG; PAM sequence: AAG
ttgaatgttcttacagtatg

SEQ ID NO: 47780 - DNA, 20 bp, Artificial Sequence
  Description of Artificial Sequence: Synthetic oligonucleotide
  Target: ATXN1; (-) strand; PAM type: NRG; PAM sequence: CAG
atgtcatttgaatgttctta

SEQ ID NO: 47781 - DNA, 20 bp, Artificial Sequence
  Description of Artificial Sequence: Synthetic oligonucleotide
  Target: ATXN1; (-) strand; PAM type: NRG; PAM sequence: AAG
ggctaaagccaaggggtgtt

SEQ ID NO: 47782 - DNA, 20 bp, Artificial Sequence
  Description of Artificial Sequence: Synthetic oligonucleotide
  Target: ATXN1; (-) strand; PAM type: NRG; PAM sequence: GGG
cacatctggctaaagccaag

SEQ ID NO: 47783 - DNA, 20 bp, Artificial Sequence
  Description of Artificial Sequence: Synthetic oligonucleotide
  Target: ATXN1; (-) strand; PAM type: NRG; PAM sequence: GGG
acacatctggctaaagccaa

SEQ ID NO: 47784 - DNA, 20 bp, Artificial Sequence
  Description of Artificial Sequence: Synthetic oligonucleotide
  Target: ATXN1; (-) strand; PAM type: NRG; PAM sequence: AGG
gacacatctggctaaagcca

SEQ ID NO: 47785 - DNA, 20 bp, Artificial Sequence
  Description of Artificial Sequence: Synthetic oligonucleotide
  Target: ATXN1; (-) strand; PAM type: NRG; PAM sequence: AAG
ggacacatctggctaaagcc

SEQ ID NO: 47786 - DNA, 20 bp, Artificial Sequence
  Description of Artificial Sequence: Synthetic oligonucleotide
  Target: ATXN1; (-) strand; PAM type: NRG; PAM sequence: AAG
tccatggacacatctggcta

SEQ ID NO: 47787 - DNA, 20 bp, Artificial Sequence
  Description of Artificial Sequence: Synthetic oligonucleotide
  Target: ATXN1; (-) strand; PAM type: NRG; PAM sequence: TGG
tttttttccatggacacatc

SEQ ID NO: 47788 - DNA, 20 bp, Artificial Sequence
  Description of Artificial Sequence: Synthetic oligonucleotide
  Target: ATXN1; (-) strand; PAM type: NRG; PAM sequence: TGG
ggttatgtcatttttttcca

SEQ ID NO: 47789 - DNA, 20 bp, Artificial Sequence
  Description of Artificial Sequence: Synthetic oligonucleotide
  Target: ATXN1; (-) strand; PAM type: NRG; PAM sequence: TGG
gtttctagagattttctatt

SEQ ID NO: 47790 - DNA, 20 bp, Artificial Sequence
  Description of Artificial Sequence: Synthetic oligonucleotide
  Target: ATXN1; (-) strand; PAM type: NRG; PAM sequence: GAG
aaagtaaaataatgtttcta

SEQ ID NO: 47791 - DNA, 20 bp, Artificial Sequence
  Description of Artificial Sequence: Synthetic oligonucleotide
  Target: ATXN1; (-) strand; PAM type: NRG; PAM sequence: TAG
gaaaagtaaaataatgtttc

SEQ ID NO: 47792 - DNA, 20 bp, Artificial Sequence
  Description of Artificial Sequence: Synthetic oligonucleotide
  Target: ATXN1; (-) strand; PAM type: NRG; PAM sequence: AAG
agaactgacaaacagatgaa

SEQ ID NO: 47793 - DNA, 20 bp, Artificial Sequence
  Description of Artificial Sequence: Synthetic oligonucleotide
  Target: ATXN1; (-) strand; PAM type: NRG; PAM sequence: CAG
cattgactagaactgacaaa

SEQ ID NO: 47794 - DNA, 20 bp, Artificial Sequence
  Description of Artificial Sequence: Synthetic oligonucleotide
  Target: ATXN1; (-) strand; PAM type: NRG; PAM sequence: TAG
agtctatgctttacattgac

SEQ ID NO: 47795 - DNA, 20 bp, Artificial Sequence
  Description of Artificial Sequence: Synthetic oligonucleotide
  Target: ATXN1; (-) strand; PAM type: NRG; PAM sequence: TAG
ctgaatgcaccctttgactg

SEQ ID NO: 47796 - DNA, 20 bp, Artificial Sequence
  Description of Artificial Sequence: Synthetic oligonucleotide
  Target: ATXN1; (-) strand; PAM type: NRG; PAM sequence: GGG
cactgcttgtaaacagtttt

SEQ ID NO: 47797 - DNA, 20 bp, Artificial Sequence
  Description of Artificial Sequence: Synthetic oligonucleotide
  Target: ATXN1; (-) strand; PAM type: NRG; PAM sequence: TGG
acactgcttgtaaacagttt

SEQ ID NO: 47798 - DNA, 20 bp, Artificial Sequence
  Description of Artificial Sequence: Synthetic oligonucleotide
  Target: ATXN1; (-) strand; PAM type: NRG; PAM sequence: CAG
ccctaaacactgcttgtaaa

SEQ ID NO: 47799 - DNA, 20 bp, Artificial Sequence
  Description of Artificial Sequence: Synthetic oligonucleotide
  Target: ATXN1; (-) strand; PAM type: NRG; PAM sequence: CAG
acaggttgtttgggtccagg

SEQ ID NO: 47800 - DNA, 20 bp, Artificial Sequence
  Description of Artificial Sequence: Synthetic oligonucleotide
  Target: ATXN1; (-) strand; PAM type: NRG; PAM sequence: AGG
attacaggttgtttgggtcc

SEQ ID NO: 47801 - DNA, 20 bp, Artificial Sequence
  Description of Artificial Sequence: Synthetic oligonucleotide
  Target: ATXN1; (-) strand; PAM type: NRG; PAM sequence: CAG
cattacaggttgtttgggtc

SEQ ID NO: 47802 - DNA, 20 bp, Artificial Sequence
  Description of Artificial Sequence: Synthetic oligonucleotide
  Target: ATXN1; (-) strand; PAM type: NRG; PAM sequence: GGG
gaggtcattacaggttgttt

SEQ ID NO: 47803 - DNA, 20 bp, Artificial Sequence
  Description of Artificial Sequence: Synthetic oligonucleotide
  Target: ATXN1; (-) strand; PAM type: NRG; PAM sequence: TGG
tgaggtcattacaggttgtt

SEQ ID NO: 47804 - DNA, 20 bp, Artificial Sequence
  Description of Artificial Sequence: Synthetic oligonucleotide
  Target: ATXN1; (-) strand; PAM type: NRG; PAM sequence: AGG
tttaaaaatgaggtcattac

SEQ ID NO: 47805 - DNA, 20 bp, Artificial Sequence
  Description of Artificial Sequence: Synthetic oligonucleotide
  Target: ATXN1; (-) strand; PAM type: NRG; PAM sequence: CAG
ttttaaaaatgaggtcatta

SEQ ID NO: 47806 - DNA, 20 bp, Artificial Sequence
  Description of Artificial Sequence: Synthetic oligonucleotide
  Target: ATXN1; (-) strand; PAM type: NRG; PAM sequence: AGG
aaggtaattttttaaaaatg

SEQ ID NO: 47807 - DNA, 20 bp, Artificial Sequence
  Description of Artificial Sequence: Synthetic oligonucleotide
  Target: ATXN1; (-) strand; PAM type: NRG; PAM sequence: GAG
aaaggtaattttttaaaaat

SEQ ID NO: 47808 - DNA, 20 bp, Artificial Sequence
  Description of Artificial Sequence: Synthetic oligonucleotide
  Target: ATXN1; (-) strand; PAM type: NRG; PAM sequence: AGG
ttctacagctgggaaggaaa

SEQ ID NO: 47809 - DNA, 20 bp, Artificial Sequence
  Description of Artificial Sequence: Synthetic oligonucleotide
  Target: ATXN1; (-) strand; PAM type: NRG; PAM sequence: AAG
tttctacagctgggaaggaa

SEQ ID NO: 47810 - DNA, 20 bp, Artificial Sequence
  Description of Artificial Sequence: Synthetic oligonucleotide
  Target: ATXN1; (-) strand; PAM type: NRG; PAM sequence: AGG
ggaagtttctacagctggga

SEQ ID NO: 47811 - DNA, 20 bp, Artificial Sequence
  Description of Artificial Sequence: Synthetic oligonucleotide
  Target: ATXN1; (-) strand; PAM type: NRG; PAM sequence: AAG
aggaagtttctacagctggg

SEQ ID NO: 47812 - DNA, 20 bp, Artificial Sequence
  Description of Artificial Sequence: Synthetic oligonucleotide
  Target: ATXN1; (-) strand; PAM type: NRG; PAM sequence: GGG
agcaggaagtttctacagct

SEQ ID NO: 47813 - DNA, 20 bp, Artificial Sequence
  Description of Artificial Sequence: Synthetic oligonucleotide
  Target: ATXN1; (-) strand; PAM type: NRG; PAM sequence: TGG
cagcaggaagtttctacagc

SEQ ID NO: 47814 - DNA, 20 bp, Artificial Sequence
  Description of Artificial Sequence: Synthetic oligonucleotide
  Target: ATXN1; (-) strand; PAM type: NRG; PAM sequence: CAG
agagcagcaggaagtttcta

SEQ ID NO: 47815 - DNA, 20 bp, Artificial Sequence
  Description of Artificial Sequence: Synthetic oligonucleotide
  Target: ATXN1; (-) strand; PAM type: NRG; PAM sequence: AAG
aaatgtggaagagcagcagg

SEQ ID NO: 47816 - DNA, 20 bp, Artificial Sequence
  Description of Artificial Sequence: Synthetic oligonucleotide
  Target: ATXN1; (-) strand; PAM type: NRG; PAM sequence: AGG
tataaatgtggaagagcagc

SEQ ID NO: 47817 - DNA, 20 bp, Artificial Sequence
  Description of Artificial Sequence: Synthetic oligonucleotide
  Target: ATXN1; (-) strand; PAM type: NRG; PAM sequence: CAG
atataaatgtggaagagcag

SEQ ID NO: 47818 - DNA, 20 bp, Artificial Sequence
  Description of Artificial Sequence: Synthetic oligonucleotide
  Target: ATXN1; (-) strand; PAM type: NRG; PAM sequence: CAG
tctatataaatgtggaagag

SEQ ID NO: 47819 - DNA, 20 bp, Artificial Sequence
  Description of Artificial Sequence: Synthetic oligonucleotide
  Target: ATXN1; (-) strand; PAM type: NRG; PAM sequence: GAG
aattctatataaatgtggaa

SEQ ID NO: 47820 - DNA, 20 bp, Artificial Sequence
  Description of Artificial Sequence: Synthetic oligonucleotide
  Target: ATXN1; (-) strand; PAM type: NRG; PAM sequence: AAG
gtaattctatataaatgtgg

SEQ ID NO: 47821 - DNA, 20 bp, Artificial Sequence
  Description of Artificial Sequence: Synthetic oligonucleotide
  Target: ATXN1; (-) strand; PAM type: NRG; PAM sequence: TGG
caggtaattctatataaatg

SEQ ID NO: 47822 - DNA, 20 bp, Artificial Sequence
  Description of Artificial Sequence: Synthetic oligonucleotide
  Target: ATXN1; (-) strand; PAM type: NRG; PAM sequence: AGG
taatatatagatgtagacac

SEQ ID NO: 47823 - DNA, 20 bp, Artificial Sequence
  Description of Artificial Sequence: Synthetic oligonucleotide
  Target: ATXN1; (-) strand; PAM type: NRG; PAM sequence: CAG
ttaatatatagatgtagaca

SEQ ID NO: 47824 - DNA, 20 bp, Artificial Sequence
  Description of Artificial Sequence: Synthetic oligonucleotide
  Target: ATXN1; (-) strand; PAM type: NRG; PAM sequence: TAG
aaatgattaatatatagatg

SEQ ID NO: 47825 - DNA, 20 bp, Artificial Sequence
  Description of Artificial Sequence: Synthetic oligonucleotide
  Target: ATXN1; (-) strand; PAM type: NRG; PAM sequence: TAG
aagtggaaatgattaatata

SEQ ID NO: 47826 - DNA, 20 bp, Artificial Sequence
  Description of Artificial Sequence: Synthetic oligonucleotide
  Target: ATXN1; (-) strand; PAM type: NRG; PAM sequence: TGG
attacaggcaggcatgtaag

SEQ ID NO: 47827 - DNA, 20 bp, Artificial Sequence
  Description of Artificial Sequence: Synthetic oligonucleotide
  Target: ATXN1; (-) strand; PAM type: NRG; PAM sequence: AAG
cccattacaggcaggcatgt

SEQ ID NO: 47828 - DNA, 20 bp, Artificial Sequence
  Description of Artificial Sequence: Synthetic oligonucleotide
  Target: ATXN1; (-) strand; PAM type: NRG; PAM sequence: AGG
tgaatagacccattacaggc

SEQ ID NO: 47829 - DNA, 20 bp, Artificial Sequence
  Description of Artificial Sequence: Synthetic oligonucleotide
  Target: ATXN1; (-) strand; PAM type: NRG; PAM sequence: CAG
ctgaatagacccattacagg

SEQ ID NO: 47830 - DNA, 20 bp, Artificial Sequence
  Description of Artificial Sequence: Synthetic oligonucleotide
  Target: ATXN1; (-) strand; PAM type: NRG; PAM sequence: AGG
actctgaatagacccattac

SEQ ID NO: 47831 - DNA, 20 bp, Artificial Sequence
  Description of Artificial Sequence: Synthetic oligonucleotide
  Target: ATXN1; (-) strand; PAM type: NRG; PAM sequence: CAG
gactctgaatagacccatta

SEQ ID NO: 47832 - DNA, 20 bp, Artificial Sequence
  Description of Artificial Sequence: Synthetic oligonucleotide
  Target: ATXN1; (-) strand; PAM type: NRG; PAM sequence: TAG
tagatatataggactctgaa

SEQ ID NO: 47833 - DNA, 20 bp, Artificial Sequence
  Description of Artificial Sequence: Synthetic oligonucleotide
  Target: ATXN1; (-) strand; PAM type: NRG; PAM sequence: AGG
agacggctatatagatatat

SEQ ID NO: 47834 - DNA, 20 bp, Artificial Sequence
  Description of Artificial Sequence: Synthetic oligonucleotide
  Target: ATXN1; (-) strand; PAM type: NRG; PAM sequence: TAG
tagacggctatatagatata

SEQ ID NO: 47835 - DNA, 20 bp, Artificial Sequence
  Description of Artificial Sequence: Synthetic oligonucleotide
  Target: ATXN1; (-) strand; PAM type: NRG; PAM sequence: TAG
tagatagatagacggctata

SEQ ID NO: 47836 - DNA, 20 bp, Artificial Sequence
  Description of Artificial Sequence: Synthetic oligonucleotide
  Target: ATXN1; (-) strand; PAM type: NRG; PAM sequence: CGG
atggggattagatagataga

SEQ ID NO: 47837 - DNA, 20 bp, Artificial Sequence
  Description of Artificial Sequence: Synthetic oligonucleotide
  Target: ATXN1; (-) strand; PAM type: NRG; PAM sequence: TAG
agatatggggattagataga

SEQ ID NO: 47838 - DNA, 20 bp, Artificial Sequence
  Description of Artificial Sequence: Synthetic oligonucleotide
  Target: ATXN1; (-) strand; PAM type: NRG; PAM sequence: TAG
tagtagatatggggattaga

SEQ ID NO: 47839 - DNA, 20 bp, Artificial Sequence
  Description of Artificial Sequence: Synthetic oligonucleotide
  Target: ATXN1; (-) strand; PAM type: NRG; PAM sequence: TAG
acaatagtagatatggggat

SEQ ID NO: 47840 - DNA, 20 bp, Artificial Sequence
  Description of Artificial Sequence: Synthetic oligonucleotide
  Target: ATXN1; (-) strand; PAM type: NRG; PAM sequence: GGG
attttacaatagtagatatg

SEQ ID NO: 47841 - DNA, 20 bp, Artificial Sequence
  Description of Artificial Sequence: Synthetic oligonucleotide
  Target: ATXN1; (-) strand; PAM type: NRG; PAM sequence: GGG
aattttacaatagtagatat

SEQ ID NO: 47842 - DNA, 20 bp, Artificial Sequence
  Description of Artificial Sequence: Synthetic oligonucleotide
  Target: ATXN1; (-) strand; PAM type: NRG; PAM sequence: TGG
aaattttacaatagtagata

SEQ ID NO: 47843 - DNA, 20 bp, Artificial Sequence
  Description of Artificial Sequence: Synthetic oligonucleotide
  Target: ATXN1; (-) strand; PAM type: NRG; PAM sequence: TAG
agaaaaaaattttacaatag

SEQ ID NO: 47844 - DNA, 20 bp, Artificial Sequence
  Description of Artificial Sequence: Synthetic oligonucleotide
  Target: ATXN1; (-) strand; PAM type: NRG; PAM sequence: TAG
agcagaaaaaaattttacaa

SEQ ID NO: 47845 - DNA, 20 bp, Artificial Sequence
  Description of Artificial Sequence: Synthetic oligonucleotide
  Target: ATXN1; (-) strand; PAM type: NRG; PAM sequence: CAG
caggggaaaaaagaagtaag

SEQ ID NO: 47846 - DNA, 20 bp, Artificial Sequence
  Description of Artificial Sequence: Synthetic oligonucleotide
  Target: ATXN1; (-) strand; PAM type: NRG; PAM sequence: AAG
acacaggggaaaaaagaagt

SEQ ID NO: 47847 - DNA, 20 bp, Artificial Sequence
  Description of Artificial Sequence: Synthetic oligonucleotide
  Target: ATXN1; (-) strand; PAM type: NRG; PAM sequence: AAG
tgaaacacaggggaaaaaag

SEQ ID NO: 47848 - DNA, 20 bp, Artificial Sequence
  Description of Artificial Sequence: Synthetic oligonucleotide
  Target: ATXN1; (-) strand; PAM type: NRG; PAM sequence: AAG
agttgaaacacaggggaaaa

SEQ ID NO: 47849 - DNA, 20 bp, Artificial Sequence
  Description of Artificial Sequence: Synthetic oligonucleotide
  Target: ATXN1; (-) strand; PAM type: NRG; PAM sequence: GGG
cagaatgagttgaaacacag

SEQ ID NO: 47850 - DNA, 20 bp, Artificial Sequence
  Description of Artificial Sequence: Synthetic oligonucleotide
  Target: ATXN1; (-) strand; PAM type: NRG; PAM sequence: GGG
tcagaatgagttgaaacaca

SEQ ID NO: 47851 - DNA, 20 bp, Artificial Sequence
  Description of Artificial Sequence: Synthetic oligonucleotide
  Target: ATXN1; (-) strand; PAM type: NRG; PAM sequence: AGG
atcagaatgagttgaaacac

SEQ ID NO: 47852 - DNA, 20 bp, Artificial Sequence
  Description of Artificial Sequence: Synthetic oligonucleotide
  Target: ATXN1; (-) strand; PAM type: NRG; PAM sequence: CAG
gatcagaatgagttgaaaca

SEQ ID NO: 47853 - DNA, 20 bp, Artificial Sequence
  Description of Artificial Sequence: Synthetic oligonucleotide
  Target: ATXN1; (-) strand; PAM type: NRG; PAM sequence: GAG
tgctgagaagagatcagaat

SEQ ID NO: 47854 - DNA, 20 bp, Artificial Sequence
  Description of Artificial Sequence: Synthetic oligonucleotide
  Target: ATXN1; (-) strand; PAM type: NRG; PAM sequence: CAG
ctctgatgctgagaagagat

SEQ ID NO: 47855 - DNA, 20 bp, Artificial Sequence
  Description of Artificial Sequence: Synthetic oligonucleotide
  Target: ATXN1; (-) strand; PAM type: NRG; PAM sequence: GAG
ataatctctgatgctgagaa

SEQ ID NO: 47856 - DNA, 20 bp, Artificial Sequence
  Description of Artificial Sequence: Synthetic oligonucleotide
  Target: ATXN1; (-) strand; PAM type: NRG; PAM sequence: AAG
acataatctctgatgctgag

SEQ ID NO: 47857 - DNA, 20 bp, Artificial Sequence
  Description of Artificial Sequence: Synthetic oligonucleotide
  Target: ATXN1; (-) strand; PAM type: NRG; PAM sequence: GAG
taaacataatctctgatgct

SEQ ID NO: 47858 - DNA, 20 bp, Artificial Sequence
  Description of Artificial Sequence: Synthetic oligonucleotide
  Target: ATXN1; (-) strand; PAM type: NRG; PAM sequence: TAG
ctgttgggcagaccaagatt

SEQ ID NO: 47859 - DNA, 20 bp, Artificial Sequence
  Description of Artificial Sequence: Synthetic oligonucleotide
  Target: ATXN1; (-) strand; PAM type: NRG; PAM sequence: AAG
agattgctgttgggcagacc

SEQ ID NO: 47860 - DNA, 20 bp, Artificial Sequence
  Description of Artificial Sequence: Synthetic oligonucleotide
  Target: ATXN1; (-) strand; PAM type: NRG; PAM sequence: CAG
ctttaaagattgctgttggg

SEQ ID NO: 47861 - DNA, 20 bp, Artificial Sequence
  Description of Artificial Sequence: Synthetic oligonucleotide
  Target: ATXN1; (-) strand; PAM type: NRG; PAM sequence: GGG
tttctttaaagattgctgtt

SEQ ID NO: 47862 - DNA, 20 bp, Artificial Sequence
  Description of Artificial Sequence: Synthetic oligonucleotide
  Target: ATXN1; (-) strand; PAM type: NRG; PAM sequence: TGG
gtttctttaaagattgctgt

SEQ ID NO: 47863 - DNA, 20 bp, Artificial Sequence
  Description of Artificial Sequence: Synthetic oligonucleotide
  Target: ATXN1; (-) strand; PAM type: NRG; PAM sequence: AAG
catccaagattgtttcttta

SEQ ID NO: 47864 - DNA, 20 bp, Artificial Sequence
  Description of Artificial Sequence: Synthetic oligonucleotide
  Target: ATXN1; (-) strand; PAM type: NRG; PAM sequence: AAG
gtaagaaaaggtaaacatcc

SEQ ID NO: 47865 - DNA, 20 bp, Artificial Sequence
  Description of Artificial Sequence: Synthetic oligonucleotide
  Target: ATXN1; (-) strand; PAM type: NRG; PAM sequence: AGG
aaagcctcataggtaagaaa

SEQ ID NO: 47866 - DNA, 20 bp, Artificial Sequence
  Description of Artificial Sequence: Synthetic oligonucleotide
  Target: ATXN1; (-) strand; PAM type: NRG; PAM sequence: AAG
caaagcctcataggtaagaa

SEQ ID NO: 47867 - DNA, 20 bp, Artificial Sequence
  Description of Artificial Sequence: Synthetic oligonucleotide
  Target: ATXN1; (-) strand; PAM type: NRG; PAM sequence: AAG
atcaccaaagcctcataggt

SEQ ID NO: 47868 - DNA, 20 bp, Artificial Sequence
  Description of Artificial Sequence: Synthetic oligonucleotide
  Target: ATXN1; (-) strand; PAM type: NRG; PAM sequence: AGG
atatatcaccaaagcctcat

SEQ ID NO: 47869 - DNA, 20 bp, Artificial Sequence
  Description of Artificial Sequence: Synthetic oligonucleotide
  Target: ATXN1; (-) strand; PAM type: NRG; PAM sequence: TAG
catatatcaccaaagcctca

SEQ ID NO: 47870 - DNA, 20 bp, Artificial Sequence
  Description of Artificial Sequence: Synthetic oligonucleotide
  Target: ATXN1; (-) strand; PAM type: NRG; PAM sequence: AAG
cccttttccatatatcacca

SEQ ID NO: 47871 - DNA, 20 bp, Artificial Sequence
  Description of Artificial Sequence: Synthetic oligonucleotide
  Target: ATXN1; (-) strand; PAM type: NRG; PAM sequence: AGG
tgtcatgaaacttgccatag

SEQ ID NO: 47872 - DNA, 20 bp, Artificial Sequence
  Description of Artificial Sequence: Synthetic oligonucleotide
  Target: ATXN1; (-) strand; PAM type: NRG; PAM sequence: GAG
ctgtcatgaaacttgccata

SEQ ID NO: 47873 - DNA, 20 bp, Artificial Sequence
  Description of Artificial Sequence: Synthetic oligonucleotide
  Target: ATXN1; (-) strand; PAM type: NRG; PAM sequence: TAG
acctgtcatgaaacttgcca

SEQ ID NO: 47874 - DNA, 20 bp, Artificial Sequence
  Description of Artificial Sequence: Synthetic oligonucleotide
  Target: ATXN1; (-) strand; PAM type: NRG; PAM sequence: CAG
ttgttgttgtttttaacaag

SEQ ID NO: 47875 - DNA, 20 bp, Artificial Sequence
  Description of Artificial Sequence: Synthetic oligonucleotide
  Target: ATXN1; (-) strand; PAM type: NRG; PAM sequence: AAG
ttattgttgttgtttttaac

SEQ ID NO: 47876 - DNA, 20 bp, Artificial Sequence
  Description of Artificial Sequence: Synthetic oligonucleotide
  Target: ATXN1; (-) strand; PAM type: NRG; PAM sequence: TAG
caggaaggtggagatagtat

SEQ ID NO: 47877 - DNA, 20 bp, Artificial Sequence
  Description of Artificial Sequence: Synthetic oligonucleotide
  Target: ATXN1; (-) strand; PAM type: NRG; PAM sequence: TAG
agtggtcaggaaggtggaga

SEQ ID NO: 47878 - DNA, 20 bp, Artificial Sequence
  Description of Artificial Sequence: Synthetic oligonucleotide
  Target: ATXN1; (-) strand; PAM type: NRG; PAM sequence: GAG
gacaagtggtcaggaaggtg

SEQ ID NO: 47879 - DNA, 20 bp, Artificial Sequence
  Description of Artificial Sequence: Synthetic oligonucleotide
  Target: ATXN1; (-) strand; PAM type: NRG; PAM sequence: TGG
aggacaagtggtcaggaagg

SEQ ID NO: 47880 - DNA, 20 bp, Artificial Sequence
  Description of Artificial Sequence: Synthetic oligonucleotide
  Target: ATXN1; (-) strand; PAM type: NRG; PAM sequence: AGG
aagaggacaagtggtcagga

SEQ ID NO: 47881 - DNA, 20 bp, Artificial Sequence
  Description of Artificial Sequence: Synthetic oligonucleotide
  Target: ATXN1; (-) strand; PAM type: NRG; PAM sequence: AAG
caagaggacaagtggtcagg

SEQ ID NO: 47882 - DNA, 20 bp, Artificial Sequence
  Description of Artificial Sequence: Synthetic oligonucleotide
  Target: ATXN1; (-) strand; PAM type: NRG; PAM sequence: AGG
ctccaagaggacaagtggtc

SEQ ID NO: 47883 - DNA, 20 bp, Artificial Sequence
  Description of Artificial Sequence: Synthetic oligonucleotide
  Target: ATXN1; (-) strand; PAM type: NRG; PAM sequence: CAG
cctccaagaggacaagtggt

SEQ ID NO: 47884 - DNA, 20 bp, Artificial Sequence
  Description of Artificial Sequence: Synthetic oligonucleotide
  Target: ATXN1; (-) strand; PAM type: NRG; PAM sequence: TGG
ctgacctccaagaggacaag

SEQ ID NO: 47885 - DNA, 20 bp, Artificial Sequence
  Description of Artificial Sequence: Synthetic oligonucleotide
  Target: ATXN1; (-) strand; PAM type: NRG; PAM sequence: AAG
tagctgacctccaagaggac

SEQ ID NO: 47886 - DNA, 20 bp, Artificial Sequence
  Description of Artificial Sequence: Synthetic oligonucleotide
  Target: ATXN1; (-) strand; PAM type: NRG; PAM sequence: AGG
gcatctagctgacctccaag

SEQ ID NO: 47887 - DNA, 20 bp, Artificial Sequence
  Description of Artificial Sequence: Synthetic oligonucleotide
  Target: ATXN1; (-) strand; PAM type: NRG; PAM sequence: GAG
agcatctagctgacctccaa

SEQ ID NO: 47888 - DNA, 20 bp, Artificial Sequence
  Description of Artificial Sequence: Synthetic oligonucleotide
  Target: ATXN1; (-) strand; PAM type: NRG; PAM sequence: AAG
ccagcatctagctgacctcc

SEQ ID NO: 47889 - DNA, 20 bp, Artificial Sequence
  Description of Artificial Sequence: Synthetic oligonucleotide
  Target: ATXN1; (-) strand; PAM type: NRG; PAM sequence: TAG
cctagggaactgccagcatc

SEQ ID NO: 47890 - DNA, 20 bp, Artificial Sequence
  Description of Artificial Sequence: Synthetic oligonucleotide
  Target: ATXN1; (-) strand; PAM type: NRG; PAM sequence: CAG
gtcatttcctagggaactgc

SEQ ID NO: 47891 - DNA, 20 bp, Artificial Sequence
  Description of Artificial Sequence: Synthetic oligonucleotide
  Target: ATXN1; (-) strand; PAM type: NRG; PAM sequence: GGG
taatataatgtcatttccta

SEQ ID NO: 47892 - DNA, 20 bp, Artificial Sequence
  Description of Artificial Sequence: Synthetic oligonucleotide
  Target: ATXN1; (-) strand; PAM type: NRG; PAM sequence: AGG
gtaatataatgtcatttcct

SEQ ID NO: 47893 - DNA, 20 bp, Artificial Sequence
  Description of Artificial Sequence: Synthetic oligonucleotide
  Target: ATXN1; (-) strand; PAM type: NRG; PAM sequence: TAG
ggtaatataatgtcatttcc

SEQ ID NO: 47894 - DNA, 20 bp, Artificial Sequence
  Description of Artificial Sequence: Synthetic oligonucleotide
  Target: ATXN1; (-) strand; PAM type: NRG; PAM sequence: GGG
ctgaattaatgtggtattct

SEQ ID NO: 47895 - DNA, 20 bp, Artificial Sequence
  Description of Artificial Sequence: Synthetic oligonucleotide
  Target: ATXN1; (-) strand; PAM type: NRG; PAM sequence: TGG
tctgaattaatgtggtattc

SEQ ID NO: 47896 - DNA, 20 bp, Artificial Sequence
  Description of Artificial Sequence: Synthetic oligonucleotide
  Target: ATXN1; (-) strand; PAM type: NRG; PAM sequence: TGG
tggcaggttctgaattaatg

SEQ ID NO: 47897 - DNA, 20 bp, Artificial Sequence
  Description of Artificial Sequence: Synthetic oligonucleotide
  Target: ATXN1; (-) strand; PAM type: NRG; PAM sequence: AGG
ccagaagttagctaggtggc

SEQ ID NO: 47898 - DNA, 20 bp, Artificial Sequence
  Description of Artificial Sequence: Synthetic oligonucleotide
  Target: ATXN1; (-) strand; PAM type: NRG; PAM sequence: CAG
gccagaagttagctaggtgg

SEQ ID NO: 47899 - DNA, 20 bp, Artificial Sequence
  Description of Artificial Sequence: Synthetic oligonucleotide
  Target: ATXN1; (-) strand; PAM type: NRG; PAM sequence: TGG
agagccagaagttagctagg

SEQ ID NO: 47900 - DNA, 20 bp, Artificial Sequence
  Description of Artificial Sequence: Synthetic oligonucleotide
  Target: ATXN1; (-) strand; PAM type: NRG; PAM sequence: AGG
gccagagccagaagttagct

SEQ ID NO: 47901 - DNA, 20 bp, Artificial Sequence
  Description of Artificial Sequence: Synthetic oligonucleotide
  Target: ATXN1; (-) strand; PAM type: NRG; PAM sequence: TAG
tgccagagccagaagttagc

SEQ ID NO: 47902 - DNA, 20 bp, Artificial Sequence
  Description of Artificial Sequence: Synthetic oligonucleotide
  Target: ATXN1; (-) strand; PAM type: NRG; PAM sequence: TAG
agggtgccagagccagaagt

SEQ ID NO: 47903 - DNA, 20 bp, Artificial Sequence
  Description of Artificial Sequence: Synthetic oligonucleotide
  Target: ATXN1; (-) strand; PAM type: NRG; PAM sequence: AAG
ggatagggtgccagagccag

SEQ ID NO: 47904 - DNA, 20 bp, Artificial Sequence
  Description of Artificial Sequence: Synthetic oligonucleotide
  Target: ATXN1; (-) strand; PAM type: NRG; PAM sequence: CAG
agcggatagggtgccagagc

SEQ ID NO: 47905 - DNA, 20 bp, Artificial Sequence
  Description of Artificial Sequence: Synthetic oligonucleotide
  Target: ATXN1; (-) strand; PAM type: NRG; PAM sequence: GAG
ggtcagcggatagggtgcca

SEQ ID NO: 47906 - DNA, 20 bp, Artificial Sequence
  Description of Artificial Sequence: Synthetic oligonucleotide
  Target: ATXN1; (-) strand; PAM type: NRG; PAM sequence: CAG
ggggtcagcggatagggtgc

SEQ ID NO: 47907 - DNA, 20 bp, Artificial Sequence
  Description of Artificial Sequence: Synthetic oligonucleotide
  Target: ATXN1; (-) strand; PAM type: NRG; PAM sequence: GGG
tgcaaaggggtcagcggata

SEQ ID NO: 47908 - DNA, 20 bp, Artificial Sequence
  Description of Artificial Sequence: Synthetic oligonucleotide
  Target: ATXN1; (-) strand; PAM type: NRG; PAM sequence: AGG
ttgcaaaggggtcagcggat

SEQ ID NO: 47909 - DNA, 20 bp, Artificial Sequence
  Description of Artificial Sequence: Synthetic oligonucleotide
  Target: ATXN1; (-) strand; PAM type: NRG; PAM sequence: TAG
gttgcaaaggggtcagcgga

SEQ ID NO: 47910 - DNA, 20 bp, Artificial Sequence
  Description of Artificial Sequence: Synthetic oligonucleotide
  Target: ATXN1; (-) strand; PAM type: NRG; PAM sequence: CGG
gattgttgcaaaggggtcag

SEQ ID NO: 47911 - DNA, 20 bp, Artificial Sequence
  Description of Artificial Sequence: Synthetic oligonucleotide
  Target: ATXN1; (-) strand; PAM type: NRG; PAM sequence: CAG
tctgattgttgcaaaggggt

SEQ ID NO: 47912 - DNA, 20 bp, Artificial Sequence
  Description of Artificial Sequence: Synthetic oligonucleotide
  Target: ATXN1; (-) strand; PAM type: NRG; PAM sequence: GGG
tgcttctgattgttgcaaag

SEQ ID NO: 47913 - DNA, 20 bp, Artificial Sequence
  Description of Artificial Sequence: Synthetic oligonucleotide
  Target: ATXN1; (-) strand; PAM type: NRG; PAM sequence: GGG
ctgcttctgattgttgcaaa

SEQ ID NO: 47914 - DNA, 20 bp, Artificial Sequence
  Description of Artificial Sequence: Synthetic oligonucleotide
  Target: ATXN1; (-) strand; PAM type: NRG; PAM sequence: AGG
cctgcttctgattgttgcaa

SEQ ID NO: 47915 - DNA, 20 bp, Artificial Sequence
  Description of Artificial Sequence: Synthetic oligonucleotide
  Target: ATXN1; (-) strand; PAM type: NRG; PAM sequence: AAG
tcctgcttctgattgttgca

SEQ ID NO: 47916 - DNA, 20 bp, Artificial Sequence
  Description of Artificial Sequence: Synthetic oligonucleotide
  Target: ATXN1; (-) strand; PAM type: NRG; PAM sequence: AGG
atcaactaacaaaatccaag

SEQ ID NO: 47917 - DNA, 20 bp, Artificial Sequence
  Description of Artificial Sequence: Synthetic oligonucleotide
  Target: ATXN1; (-) strand; PAM type: NRG; PAM sequence: GAG
gatcaactaacaaaatccaa

SEQ ID NO: 47918 - DNA, 20 bp, Artificial Sequence
  Description of Artificial Sequence: Synthetic oligonucleotide
  Target: ATXN1; (-) strand; PAM type: NRG; PAM sequence: AAG
ttgatcaactaacaaaatcc

SEQ ID NO: 47919 - DNA, 20 bp, Artificial Sequence
  Description of Artificial Sequence: Synthetic oligonucleotide
  Target: ATXN1; (-) strand; PAM type: NRG; PAM sequence: GAG
tatatagtttaagtgtctct

SEQ ID NO: 47920 - DNA, 20 bp, Artificial Sequence
  Description of Artificial Sequence: Synthetic oligonucleotide
  Target: ATXN1; (-) strand; PAM type: NRG; PAM sequence: AAG
atttcatgcatatatagttt

SEQ ID NO: 47921 - DNA, 20 bp, Artificial Sequence
  Description of Artificial Sequence: Synthetic oligonucleotide
  Target: ATXN1; (-) strand; PAM type: NRG; PAM sequence: TAG
tattttatttcatgcatata

SEQ ID NO: 47922 - DNA, 20 bp, Artificial Sequence
  Description of Artificial Sequence: Synthetic oligonucleotide
  Target: ATXN1; (-) strand; PAM type: NRG; PAM sequence: TGG
atgagccaccgtgcccagcc

SEQ ID NO: 47923 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccaccgtgcc

SEQ ID NO: 47924 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 47925 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 47926 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 47927 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 47928 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 47929 - DNA, 20 bp, Artificial Sequence
  Description of Artificial Sequence: Synthetic oligonucleotide
  Target: ATXN1; (-) strand; PAM type: NRG; PAM sequence: AAG
ccacctgcctcggcctccca

SEQ ID NO: 47930 - DNA, 20 bp, Artificial Sequence
  Description of Artificial Sequence: Synthetic oligonucleotide
  Target: ATXN1; (-) strand; PAM type: NRG; PAM sequence: CGG
ctcaagtgatccacctgcct

SEQ ID NO: 47931 - DNA, 20 bp, Artificial Sequence
  Description of Artificial Sequence: Synthetic oligonucleotide
  Target: ATXN1; (-) strand; PAM type: NRG; PAM sequence: AAG
ggtctccaacacctgacctc

SEQ ID NO: 47932 - DNA, 20 bp, Artificial Sequence
  Description of Artificial Sequence: Synthetic oligonucleotide
  Target: ATXN1; (-) strand; PAM type: NRG; PAM sequence: TGG
tttcaatatgttggctagtc

SEQ ID NO: 47933 - DNA, 20 bp, Artificial Sequence
  Description of Artificial Sequence: Synthetic oligonucleotide
  Target: ATXN1; (-) strand; PAM type: NRG; PAM sequence: TAG
aggggtttcaatatgttggc

SEQ ID NO: 47934 - DNA, 20 bp, Artificial Sequence
  Description of Artificial Sequence: Synthetic oligonucleotide
  Target: ATXN1; (-) strand; PAM type: NRG; PAM sequence: TGG
gagaaggggtttcaatatgt

SEQ ID NO: 47935 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttaatagagaag

SEQ ID NO: 47936 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttaatagagaa

SEQ ID NO: 47937 - DNA, 20 bp, Artificial Sequence
  Description of Artificial Sequence: Synthetic oligonucleotide
  Target: ATXN1; (-) strand; PAM type: NRG; PAM sequence: AGG
ttttgtatttttaatagaga

SEQ ID NO: 47938 - DNA, 20 bp, Artificial Sequence
  Description of Artificial Sequence: Synthetic oligonucleotide
  Target: ATXN1; (-) strand; PAM type: NRG; PAM sequence: AAG
tttttgtatttttaatagag

SEQ ID NO: 47939 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttaata

SEQ ID NO: 47940 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttaa

SEQ ID NO: 47941 - DNA, 20 bp, Artificial Sequence
  Description of Artificial Sequence: Synthetic oligonucleotide
  Target: ATXN1; (-) strand; PAM type: NRG; PAM sequence: CGG
caggtgcccgccatcatgcc

SEQ ID NO: 47942 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgggattac

SEQ ID NO: 47943 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggatta

SEQ ID NO: 47944 - DNA, 20 bp, Artificial Sequence
  Description of Artificial Sequence: Synthetic oligonucleotide
  Target: ATXN1; (-) strand; PAM type: NRG; PAM sequence: GGG
tctcagcctcccgagtagct

SEQ ID NO: 47945 - DNA, 20 bp, Artificial Sequence
  Description of Artificial Sequence: Synthetic oligonucleotide
  Target: ATXN1; (-) strand; PAM type: NRG; PAM sequence: TGG
gtctcagcctcccgagtagc

SEQ ID NO: 47946 - DNA, 20 bp, Artificial Sequence
  Description of Artificial Sequence: Synthetic oligonucleotide
  Target: ATXN1; (-) strand; PAM type: NRG; PAM sequence: TAG
tcctgtctcagcctcccgag

SEQ ID NO: 47947 - DNA, 20 bp, Artificial Sequence
  Description of Artificial Sequence: Synthetic oligonucleotide
  Target: ATXN1; (-) strand; PAM type: NRG; PAM sequence: GAG
ttctcctgtctcagcctccc

SEQ ID NO: 47948 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgtct

SEQ ID NO: 47949 - DNA, 20 bp, Artificial Sequence
  Description of Artificial Sequence: Synthetic oligonucleotide
  Target: ATXN1; (-) strand; PAM type: NRG; PAM sequence: AAG
aacctccacctcccgggttc

SEQ ID NO: 47950 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccacctccc

SEQ ID NO: 47951 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctccacctcc

SEQ ID NO: 47952 - DNA, 20 bp, Artificial Sequence
  Description of Artificial Sequence: Synthetic oligonucleotide
  Target: ATXN1; (-) strand; PAM type: NRG; PAM sequence: CGG
ggagtgtagtggtgtagtct

SEQ ID NO: 47953 - DNA, 20 bp, Artificial Sequence
  Description of Artificial Sequence: Synthetic oligonucleotide
  Target: ATXN1; (-) strand; PAM type: NRG; PAM sequence: TAG
caggctggagtgtagtggtg

SEQ ID NO: 47954 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgtag

SEQ ID NO: 47955 - DNA, 20 bp, Artificial Sequence
  Description of Artificial Sequence: Synthetic oligonucleotide
  Target: ATXN1; (-) strand; PAM type: NRG; PAM sequence: TAG
ctgtcacccaggctggagtg

SEQ ID NO: 47956 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcacccaggctg

SEQ ID NO: 47957 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtcacccaggc

SEQ ID NO: 47958 - DNA, 20 bp, Artificial Sequence
  Description of Artificial Sequence: Synthetic oligonucleotide
  Target: ATXN1; (-) strand; PAM type: NRG; PAM sequence: AGG
agagtctcactctgtcaccc

SEQ ID NO: 47959 - DNA, 20 bp, Artificial Sequence
  Description of Artificial Sequence: Synthetic oligonucleotide
  Target: ATXN1; (-) strand; PAM type: NRG; PAM sequence: CAG
cagagtctcactctgtcacc

SEQ ID NO: 47960 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttcagaca

SEQ ID NO: 47961 - DNA, 20 bp, Artificial Sequence
  Description of Artificial Sequence: Synthetic oligonucleotide
  Target: ATXN1; (-) strand; PAM type: NRG; PAM sequence: CAG
ctttttttttttttttcaga

SEQ ID NO: 47962 - DNA, 20 bp, Artificial Sequence
  Description of Artificial Sequence: Synthetic oligonucleotide
  Target: ATXN1; (-) strand; PAM type: NRG; PAM sequence: CAG
ttttcttttttttttttttt

SEQ ID NO: 47963 - DNA, 20 bp, Artificial Sequence
  Description of Artificial Sequence: Synthetic oligonucleotide
  Target: ATXN1; (-) strand; PAM type: NRG; PAM sequence: GGG
tgtgggttgattagaggttt

SEQ ID NO: 47964 - DNA, 20 bp, Artificial Sequence
  Description of Artificial Sequence: Synthetic oligonucleotide
  Target: ATXN1; (-) strand; PAM type: NRG; PAM sequence: TGG
atgtgggttgattagaggtt

SEQ ID NO: 47965 - DNA, 20 bp, Artificial Sequence
  Description of Artificial Sequence: Synthetic oligonucleotide
  Target: ATXN1; (-) strand; PAM type: NRG; PAM sequence: AGG
gtaacatgtgggttgattag

SEQ ID NO: 47966 - DNA, 20 bp, Artificial Sequence
  Description of Artificial Sequence: Synthetic oligonucleotide
  Target: ATXN1; (-) strand; PAM type: NRG; PAM sequence: GAG
tgtaacatgtgggttgatta

SEQ ID NO: 47967 - DNA, 20 bp, Artificial Sequence
  Description of Artificial Sequence: Synthetic oligonucleotide
  Target: ATXN1; (-) strand; PAM type: NRG; PAM sequence: TAG
catgtaacatgtgggttgat

SEQ ID NO: 47968 - DNA, 20 bp, Artificial Sequence
  Description of Artificial Sequence: Synthetic oligonucleotide
  Target: ATXN1; (-) strand; PAM type: NRG; PAM sequence: GGG
tttgtgaacatgtaacatgt

SEQ ID NO: 47969 - DNA, 20 bp, Artificial Sequence
  Description of Artificial Sequence: Synthetic oligonucleotide
  Target: ATXN1; (-) strand; PAM type: NRG; PAM sequence: TGG
ttttgtgaacatgtaacatg

SEQ ID NO: 47970 - DNA, 20 bp, Artificial Sequence
  Description of Artificial Sequence: Synthetic oligonucleotide
  Target: ATXN1; (-) strand; PAM type: NRG; PAM sequence: TGG
ttctgggtcagaacccccat

SEQ ID NO: 47971 - DNA, 20 bp, Artificial Sequence
  Description of Artificial Sequence: Synthetic oligonucleotide
  Target: ATXN1; (-) strand; PAM type: NRG; PAM sequence: CAG
aggactttaatattctgggt

SEQ ID NO: 47972 - DNA, 20 bp, Artificial Sequence
  Description of Artificial Sequence: Synthetic oligonucleotide
  Target: ATXN1; (-) strand; PAM type: NRG; PAM sequence: GGG
aaccaggactttaatattct

SEQ ID NO: 47973 - DNA, 20 bp, Artificial Sequence
  Description of Artificial Sequence: Synthetic oligonucleotide
  Target: ATXN1; (-) strand; PAM type: NRG; PAM sequence: TGG
aaaccaggactttaatattc

SEQ ID NO: 47974 - DNA, 20 bp, Artificial Sequence
  Description of Artificial Sequence: Synthetic oligonucleotide
  Target: ATXN1; (-) strand; PAM type: NRG; PAM sequence: AGG
tttcatagctcattaaaacc

SEQ ID NO: 47975 - DNA, 20 bp, Artificial Sequence
  Description of Artificial Sequence: Synthetic oligonucleotide
  Target: ATXN1; (-) strand; PAM type: NRG; PAM sequence: CAG
atttcatagctcattaaaac

SEQ ID NO: 47976 - DNA, 20 bp, Artificial Sequence
  Description of Artificial Sequence: Synthetic oligonucleotide
  Target: ATXN1; (-) strand; PAM type: NRG; PAM sequence: TAG
tttttaagttccccatttca

SEQ ID NO: 47977 - DNA, 20 bp, Artificial Sequence
  Description of Artificial Sequence: Synthetic oligonucleotide
  Target: ATXN1; (-) strand; PAM type: NRG; PAM sequence: AAG
tgcacatttgtaattttttt

SEQ ID NO: 47978 - DNA, 20 bp, Artificial Sequence
  Description of Artificial Sequence: Synthetic oligonucleotide
  Target: ATXN1; (-) strand; PAM type: NRG; PAM sequence: AGG
aaaagtcaaagaaatataaa

SEQ ID NO: 47979 - DNA, 20 bp, Artificial Sequence
  Description of Artificial Sequence: Synthetic oligonucleotide
  Target: ATXN1; (-) strand; PAM type: NRG; PAM sequence: AAG
taaaagtcaaagaaatataa

SEQ ID NO: 47980 - DNA, 20 bp, Artificial Sequence
  Description of Artificial Sequence: Synthetic oligonucleotide
  Target: ATXN1; (-) strand; PAM type: NRG; PAM sequence: AAG
gagattgttcttaaaagtca

SEQ ID NO: 47981 - DNA, 20 bp, Artificial Sequence
  Description of Artificial Sequence: Synthetic oligonucleotide
  Target: ATXN1; (-) strand; PAM type: NRG; PAM sequence: AAG
atgcatgagattgttcttaa

SEQ ID NO: 47982 - DNA, 20 bp, Artificial Sequence
  Description of Artificial Sequence: Synthetic oligonucleotide
  Target: ATXN1; (-) strand; PAM type: NRG; PAM sequence: GAG
ccagtttgggctctatgcat

SEQ ID NO: 47983 - DNA, 20 bp, Artificial Sequence
  Description of Artificial Sequence: Synthetic oligonucleotide
  Target: ATXN1; (-) strand; PAM type: NRG; PAM sequence: GGG
aagctacagatctccagttt

SEQ ID NO: 47984 - DNA, 20 bp, Artificial Sequence
  Description of Artificial Sequence: Synthetic oligonucleotide
  Target: ATXN1; (-) strand; PAM type: NRG; PAM sequence: TGG
aaagctacagatctccagtt

SEQ ID NO: 47985 - DNA, 20 bp, Artificial Sequence
  Description of Artificial Sequence: Synthetic oligonucleotide
  Target: ATXN1; (-) strand; PAM type: NRG; PAM sequence: CAG
cactaaaagctacagatctc

SEQ ID NO: 47986 - DNA, 20 bp, Artificial Sequence
  Description of Artificial Sequence: Synthetic oligonucleotide
  Target: ATXN1; (-) strand; PAM type: NRG; PAM sequence: CAG
gacaaagtcactaaaagcta

SEQ ID NO: 47987 - DNA, 20 bp, Artificial Sequence
  Description of Artificial Sequence: Synthetic oligonucleotide
  Target: ATXN1; (-) strand; PAM type: NRG; PAM sequence: AAG
ttgagagacaaagtcactaa

SEQ ID NO: 47988 - DNA, 20 bp, Artificial Sequence
  Description of Artificial Sequence: Synthetic oligonucleotide
  Target: ATXN1; (-) strand; PAM type: NRG; PAM sequence: AAG
cccagggtaattgagagaca

SEQ ID NO: 47989 - DNA, 20 bp, Artificial Sequence
  Description of Artificial Sequence: Synthetic oligonucleotide
  Target: ATXN1; (-) strand; PAM type: NRG; PAM sequence: GAG
acttcccccagggtaattga

SEQ ID NO: 47990 - DNA, 20 bp, Artificial Sequence
  Description of Artificial Sequence: Synthetic oligonucleotide
  Target: ATXN1; (-) strand; PAM type: NRG; PAM sequence: GAG
aaacttcccccagggtaatt

SEQ ID NO: 47991 - DNA, 20 bp, Artificial Sequence
  Description of Artificial Sequence: Synthetic oligonucleotide
  Target: ATXN1; (-) strand; PAM type: NRG; PAM sequence: GGG
aggggaggaaacttccccca

SEQ ID NO: 47992 - DNA, 20 bp, Artificial Sequence
  Description of Artificial Sequence: Synthetic oligonucleotide
  Target: ATXN1; (-) strand; PAM type: NRG; PAM sequence: AGG
caggggaggaaacttccccc

SEQ ID NO: 47993 - DNA, 20 bp, Artificial Sequence
  Description of Artificial Sequence: Synthetic oligonucleotide
  Target: ATXN1; (-) strand; PAM type: NRG; PAM sequence: CAG
acaggggaggaaacttcccc

SEQ ID NO: 47994 - DNA, 20 bp, Artificial Sequence
  Description of Artificial Sequence: Synthetic oligonucleotide
  Target: ATXN1; (-) strand; PAM type: NRG; PAM sequence: AGG
gacaggtcggaggacagggg

SEQ ID NO: 47995 - DNA, 20 bp, Artificial Sequence
  Description of Artificial Sequence: Synthetic oligonucleotide
  Target: ATXN1; (-) strand; PAM type: NRG; PAM sequence: GAG
agacaggtcggaggacaggg

SEQ ID NO: 47996 - DNA, 20 bp, Artificial Sequence
  Description of Artificial Sequence: Synthetic oligonucleotide
  Target: ATXN1; (-) strand; PAM type: NRG; PAM sequence: GGG
taagacaggtcggaggacag

SEQ ID NO: 47997 - DNA, 20 bp, Artificial Sequence
  Description of Artificial Sequence: Synthetic oligonucleotide
  Target: ATXN1; (-) strand; PAM type: NRG; PAM sequence: GGG
ttaagacaggtcggaggaca

SEQ ID NO: 47998 - DNA, 20 bp, Artificial Sequence
  Description of Artificial Sequence: Synthetic oligonucleotide
  Target: ATXN1; (-) strand; PAM type: NRG; PAM sequence: AGG
gttaagacaggtcggaggac

SEQ ID NO: 47999 - DNA, 20 bp, Artificial Sequence
  Description of Artificial Sequence: Synthetic oligonucleotide
  Target: ATXN1; (-) strand; PAM type: NRG; PAM sequence: CAG
tgttaagacaggtcggagga

SEQ ID NO: 48000 - DNA, 20 bp, Artificial Sequence
  Description of Artificial Sequence: Synthetic oligonucleotide
  Target: ATXN1; (-) strand; PAM type: NRG; PAM sequence: AGG
tgtctgttaagacaggtcgg

SEQ ID NO: 48001 - DNA, 20 bp, Artificial Sequence
  Description of Artificial Sequence: Synthetic oligonucleotide
  Target: ATXN1; (-) strand; PAM type: NRG; PAM sequence: GAG
gtgtctgttaagacaggtcg

SEQ ID NO: 48002 - DNA, 20 bp, Artificial Sequence
  Description of Artificial Sequence: Synthetic oligonucleotide
  Target: ATXN1; (-) strand; PAM type: NRG; PAM sequence: CGG
ctgtgtctgttaagacaggt

SEQ ID NO: 48003 - DNA, 20 bp, Artificial Sequence
  Description of Artificial Sequence: Synthetic oligonucleotide
  Target: ATXN1; (-) strand; PAM type: NRG; PAM sequence: AGG
gtgtctgtgtctgttaagac

SEQ ID NO: 48004 - DNA, 20 bp, Artificial Sequence
  Description of Artificial Sequence: Synthetic oligonucleotide
  Target: ATXN1; (-) strand; PAM type: NRG; PAM sequence: CAG
tgtgtctgtgtctgttaaga

SEQ ID NO: 48005 - DNA, 20 bp, Artificial Sequence
  Description of Artificial Sequence: Synthetic oligonucleotide
  Target: ATXN1; (-) strand; PAM type: NRG; PAM sequence: AAG
gctatgtgtctgtgtctgtt

SEQ ID NO: 48006 - DNA, 20 bp, Artificial Sequence
  Description of Artificial Sequence: Synthetic oligonucleotide
  Target: ATXN1; (-) strand; PAM type: NRG; PAM sequence: CAG
acagaggctgctaataacag

SEQ ID NO: 48007 - DNA, 20 bp, Artificial Sequence
  Description of Artificial Sequence: Synthetic oligonucleotide
  Target: ATXN1; (-) strand; PAM type: NRG; PAM sequence: CAG
ttcacagaggctgctaataa

SEQ ID NO: 48008 - DNA, 20 bp, Artificial Sequence
  Description of Artificial Sequence: Synthetic oligonucleotide
  Target: ATXN1; (-) strand; PAM type: NRG; PAM sequence: AGG
aaggttactcgggttcacag

SEQ ID NO: 48009 - DNA, 20 bp, Artificial Sequence
  Description of Artificial Sequence: Synthetic oligonucleotide
  Target: ATXN1; (-) strand; PAM type: NRG; PAM sequence: GAG
caaggttactcgggttcaca

SEQ ID NO: 48010 - DNA, 20 bp, Artificial Sequence
  Description of Artificial Sequence: Synthetic oligonucleotide
  Target: ATXN1; (-) strand; PAM type: NRG; PAM sequence: CAG
tgcaaggttactcgggttca

SEQ ID NO: 48011 - DNA, 20 bp, Artificial Sequence
  Description of Artificial Sequence: Synthetic oligonucleotide
  Target: ATXN1; (-) strand; PAM type: NRG; PAM sequence: GGG
acttgtatgcaaggttactc

SEQ ID NO: 48012 - DNA, 20 bp, Artificial Sequence
  Description of Artificial Sequence: Synthetic oligonucleotide
  Target: ATXN1; (-) strand; PAM type: NRG; PAM sequence: CGG
gacttgtatgcaaggttact

SEQ ID NO: 48013 - DNA, 20 bp, Artificial Sequence
  Description of Artificial Sequence: Synthetic oligonucleotide
  Target: ATXN1; (-) strand; PAM type: NRG; PAM sequence: AGG
ttccatgagacttgtatgca

SEQ ID NO: 48014 - DNA, 20 bp, Artificial Sequence
  Description of Artificial Sequence: Synthetic oligonucleotide
  Target: ATXN1; (-) strand; PAM type: NRG; PAM sequence: AAG
tttccatgagacttgtatgc

SEQ ID NO: 48015 - DNA, 20 bp, Artificial Sequence
  Description of Artificial Sequence: Synthetic oligonucleotide
  Target: ATXN1; (-) strand; PAM type: NRG; PAM sequence: GAG
ggcaaatgtgtgctttccat

SEQ ID NO: 48016 - DNA, 20 bp, Artificial Sequence
  Description of Artificial Sequence: Synthetic oligonucleotide
  Target: ATXN1; (-) strand; PAM type: NRG; PAM sequence: TGG
tgtcaatgattaatagcaac

SEQ ID NO: 48017 - DNA, 20 bp, Artificial Sequence
  Description of Artificial Sequence: Synthetic oligonucleotide
  Target: ATXN1; (-) strand; PAM type: NRG; PAM sequence: TAG
atcaatatgtcaatgattaa

SEQ ID NO: 48018 - DNA, 20 bp, Artificial Sequence
  Description of Artificial Sequence: Synthetic oligonucleotide
  Target: ATXN1; (-) strand; PAM type: NRG; PAM sequence: CAG
ctccccagtatcagcatacg

SEQ ID NO: 48019 - DNA, 20 bp, Artificial Sequence
  Description of Artificial Sequence: Synthetic oligonucleotide
  Target: ATXN1; (-) strand; PAM type: NRG; PAM sequence: CAG
ctctgccccctccccagtat

SEQ ID NO: 48020 - DNA, 20 bp, Artificial Sequence
  Description of Artificial Sequence: Synthetic oligonucleotide
  Target: ATXN1; (-) strand; PAM type: NRG; PAM sequence: CAG
tcccatctctgccccctccc

SEQ ID NO: 48021 - DNA, 20 bp, Artificial Sequence
  Description of Artificial Sequence: Synthetic oligonucleotide
  Target: ATXN1; (-) strand; PAM type: NRG; PAM sequence: TAG
tgaatataaacacaataact

SEQ ID NO: 48022 - DNA, 20 bp, Artificial Sequence
  Description of Artificial Sequence: Synthetic oligonucleotide
  Target: ATXN1; (-) strand; PAM type: NRG; PAM sequence: AAG
agaaacagaatcttggctgc

SEQ ID NO: 48023 - DNA, 20 bp, Artificial Sequence
  Description of Artificial Sequence: Synthetic oligonucleotide
  Target: ATXN1; (-) strand; PAM type: NRG; PAM sequence: TGG
gagagagagaaacagaatct

SEQ ID NO: 48024 - DNA, 20 bp, Artificial Sequence
  Description of Artificial Sequence: Synthetic oligonucleotide
  Target: ATXN1; (-) strand; PAM type: NRG; PAM sequence: CAG
gagagagagagagagagaaa

SEQ ID NO: 48025 - DNA, 20 bp, Artificial Sequence
  Description of Artificial Sequence: Synthetic oligonucleotide
  Target: ATXN1; (-) strand; PAM type: NRG; PAM sequence: GAG
gagagagagagagagagaga

SEQ ID NO: 48026 - DNA, 20 bp, Artificial Sequence
  Description of Artificial Sequence: Synthetic oligonucleotide
  Target: ATXN1; (-) strand; PAM type: NRG; PAM sequence: GAG
gagagagagagagagagaga

SEQ ID NO: 48027 - DNA, 20 bp, Artificial Sequence
  Description of Artificial Sequence: Synthetic oligonucleotide
  Target: ATXN1; (-) strand; PAM type: NRG; PAM sequence: GAG
gagagagagagagagagaga

SEQ ID NO: 48028 - DNA, 20 bp, Artificial Sequence
  Description of Artificial Sequence: Synthetic oligonucleotide
  Target: ATXN1; (-) strand; PAM type: NRG; PAM sequence: GAG
gagagagagagagagagaga

SEQ ID NO: 48029 - DNA, 20 bp, Artificial Sequence
  Description of Artificial Sequence: Synthetic oligonucleotide
  Target: ATXN1; (-) strand; PAM type: NRG; PAM sequence: GAG
gtgagagagagagagagaga

SEQ ID NO: 48030 - DNA, 20 bp, Artificial Sequence
  Description of Artificial Sequence: Synthetic oligonucleotide
  Target: ATXN1; (-) strand; PAM type: NRG; PAM sequence: GAG
gtgtgagagagagagagaga

SEQ ID NO: 48031 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgagagagagagaga

SEQ ID NO: 48032 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgagagagagaga

SEQ ID NO: 48033 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgagagagaga

SEQ ID NO: 48034 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtgagagaga

SEQ ID NO: 48035 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtgtgagaga

SEQ ID NO: 48036 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtgtgtgaga

SEQ ID NO: 48037 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtgtgtgtga

SEQ ID NO: 48038 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtgtgtgtgt

SEQ ID NO: 48039 - DNA, 20 bp, Artificial Sequence
  Description of Artificial Sequence: Synthetic oligonucleotide
  Target: ATXN1; (-) strand; PAM type: NRG; PAM sequence: CAG
ttgtatttccaggcataggt

SEQ ID NO: 48040 - DNA, 20 bp, Artificial Sequence
  Description of Artificial Sequence: Synthetic oligonucleotide
  Target: ATXN1; (-) strand; PAM type: NRG; PAM sequence: AGG
aggattgtatttccaggcat

SEQ ID NO: 48041 - DNA, 20 bp, Artificial Sequence
  Description of Artificial Sequence: Synthetic oligonucleotide
  Target: ATXN1; (-) strand; PAM type: NRG; PAM sequence: TAG
taggattgtatttccaggca

SEQ ID NO: 48042 - DNA, 20 bp, Artificial Sequence
  Description of Artificial Sequence: Synthetic oligonucleotide
  Target: ATXN1; (-) strand; PAM type: NRG; PAM sequence: AGG
agacttaggattgtatttcc

SEQ ID NO: 48043 - DNA, 20 bp, Artificial Sequence
  Description of Artificial Sequence: Synthetic oligonucleotide
  Target: ATXN1; (-) strand; PAM type: NRG; PAM sequence: CAG
tagacttaggattgtatttc

SEQ ID NO: 48044 - DNA, 20 bp, Artificial Sequence
  Description of Artificial Sequence: Synthetic oligonucleotide
  Target: ATXN1; (-) strand; PAM type: NRG; PAM sequence: AGG
tctcccctttatctagactt

SEQ ID NO: 48045 - DNA, 20 bp, Artificial Sequence
  Description of Artificial Sequence: Synthetic oligonucleotide
  Target: ATXN1; (-) strand; PAM type: NRG; PAM sequence: TAG
ctctcccctttatctagact

SEQ ID NO: 48046 - DNA, 20 bp, Artificial Sequence
  Description of Artificial Sequence: Synthetic oligonucleotide
  Target: ATXN1; (-) strand; PAM type: NRG; PAM sequence: TAG
cattagctctcccctttatc

SEQ ID NO: 48047 - DNA, 20 bp, Artificial Sequence
  Description of Artificial Sequence: Synthetic oligonucleotide
  Target: ATXN1; (-) strand; PAM type: NRG; PAM sequence: TAG
cttcaactgtgagccttcat

SEQ ID NO: 48048 - DNA, 20 bp, Artificial Sequence
  Description of Artificial Sequence: Synthetic oligonucleotide
  Target: ATXN1; (-) strand; PAM type: NRG; PAM sequence: GAG
aatcagacaacttcaactgt

SEQ ID NO: 48049 - DNA, 20 bp, Artificial Sequence
  Description of Artificial Sequence: Synthetic oligonucleotide
  Target: ATXN1; (-) strand; PAM type: NRG; PAM sequence: CAG
tgtgctgggtgtgtacaaat

SEQ ID NO: 48050 - DNA, 20 bp, Artificial Sequence
  Description of Artificial Sequence: Synthetic oligonucleotide
  Target: ATXN1; (-) strand; PAM type: NRG; PAM sequence: GGG
atcgagtctgaatgtgtgct

SEQ ID NO: 48051 - DNA, 20 bp, Artificial Sequence
  Description of Artificial Sequence: Synthetic oligonucleotide
  Target: ATXN1; (-) strand; PAM type: NRG; PAM sequence: TGG
aatcgagtctgaatgtgtgc

SEQ ID NO: 48052 - DNA, 20 bp, Artificial Sequence
  Description of Artificial Sequence: Synthetic oligonucleotide
  Target: ATXN1; (-) strand; PAM type: NRG; PAM sequence: GAG
aaaatttgacctatacaatc

SEQ ID NO: 48053 - DNA, 20 bp, Artificial Sequence
  Description of Artificial Sequence: Synthetic oligonucleotide
  Target: ATXN1; (-) strand; PAM type: NRG; PAM sequence: GGG
agccgtgatcgcatgtttct

SEQ ID NO: 48054 - DNA, 20 bp, Artificial Sequence
  Description of Artificial Sequence: Synthetic oligonucleotide
  Target: ATXN1; (-) strand; PAM type: NRG; PAM sequence: TGG
aagccgtgatcgcatgtttc

SEQ ID NO: 48055 - DNA, 20 bp, Artificial Sequence
  Description of Artificial Sequence: Synthetic oligonucleotide
  Target: ATXN1; (-) strand; PAM type: NRG; PAM sequence: AAG
ccacaggttttgagctcaaa

SEQ ID NO: 48056 - DNA, 20 bp, Artificial Sequence
  Description of Artificial Sequence: Synthetic oligonucleotide
  Target: ATXN1; (-) strand; PAM type: NRG; PAM sequence: GAG
aacaattatccacaggtttt

SEQ ID NO: 48057 - DNA, 20 bp, Artificial Sequence
  Description of Artificial Sequence: Synthetic oligonucleotide
  Target: ATXN1; (-) strand; PAM type: NRG; PAM sequence: AGG
ggtaagcaacaattatccac

SEQ ID NO: 48058 - DNA, 20 bp, Artificial Sequence
  Description of Artificial Sequence: Synthetic oligonucleotide
  Target: ATXN1; (-) strand; PAM type: NRG; PAM sequence: CAG
gggtaagcaacaattatcca

SEQ ID NO: 48059 - DNA, 20 bp, Artificial Sequence
  Description of Artificial Sequence: Synthetic oligonucleotide
  Target: ATXN1; (-) strand; PAM type: NRG; PAM sequence: AAG
ggaaagtgggatattggggt

SEQ ID NO: 48060 - DNA, 20 bp, Artificial Sequence
  Description of Artificial Sequence: Synthetic oligonucleotide
  Target: ATXN1; (-) strand; PAM type: NRG; PAM sequence: GGG
agaaggaaagtgggatattg

SEQ ID NO: 48061 - DNA, 20 bp, Artificial Sequence
  Description of Artificial Sequence: Synthetic oligonucleotide
  Target: ATXN1; (-) strand; PAM type: NRG; PAM sequence: GGG
aagaaggaaagtgggatatt

SEQ ID NO: 48062 - DNA, 20 bp, Artificial Sequence
  Description of Artificial Sequence: Synthetic oligonucleotide
  Target: ATXN1; (-) strand; PAM type: NRG; PAM sequence: TGG
aaagaaggaaagtgggatat

SEQ ID NO: 48063 - DNA, 20 bp, Artificial Sequence
  Description of Artificial Sequence: Synthetic oligonucleotide
  Target: ATXN1; (-) strand; PAM type: NRG; PAM sequence: GGG
ctaaggaaaagaaggaaagt

SEQ ID NO: 48064 - DNA, 20 bp, Artificial Sequence
  Description of Artificial Sequence: Synthetic oligonucleotide
  Target: ATXN1; (-) strand; PAM type: NRG; PAM sequence: TGG
tctaaggaaaagaaggaaag

SEQ ID NO: 48065 - DNA, 20 bp, Artificial Sequence
  Description of Artificial Sequence: Synthetic oligonucleotide
  Target: ATXN1; (-) strand; PAM type: NRG; PAM sequence: AAG
acttctaaggaaaagaagga

SEQ ID NO: 48066 - DNA, 20 bp, Artificial Sequence
  Description of Artificial Sequence: Synthetic oligonucleotide
  Target: ATXN1; (-) strand; PAM type: NRG; PAM sequence: AGG
ttctacttctaaggaaaaga

SEQ ID NO: 48067 - DNA, 20 bp, Artificial Sequence
  Description of Artificial Sequence: Synthetic oligonucleotide
  Target: ATXN1; (-) strand; PAM type: NRG; PAM sequence: AAG
tttctacttctaaggaaaag

SEQ ID NO: 48068 - DNA, 20 bp, Artificial Sequence
  Description of Artificial Sequence: Synthetic oligonucleotide
  Target: ATXN1; (-) strand; PAM type: NRG; PAM sequence: AAG
aggtttctacttctaaggaa

SEQ ID NO: 48069 - DNA, 20 bp, Artificial Sequence
  Description of Artificial Sequence: Synthetic oligonucleotide
  Target: ATXN1; (-) strand; PAM type: NRG; PAM sequence: AGG
aaccaaggtttctacttcta

SEQ ID NO: 48070 - DNA, 20 bp, Artificial Sequence
  Description of Artificial Sequence: Synthetic oligonucleotide
  Target: ATXN1; (-) strand; PAM type: NRG; PAM sequence: AAG
aaaccaaggtttctacttct

SEQ ID NO: 48071 - DNA, 20 bp, Artificial Sequence
  Description of Artificial Sequence: Synthetic oligonucleotide
  Target: ATXN1; (-) strand; PAM type: NRG; PAM sequence: AGG
atgtgtctacctcaaaacca

SEQ ID NO: 48072 - DNA, 20 bp, Artificial Sequence
  Description of Artificial Sequence: Synthetic oligonucleotide
  Target: ATXN1; (-) strand; PAM type: NRG; PAM sequence: AAG
aatgtgtctacctcaaaacc

SEQ ID NO: 48073 - DNA, 20 bp, Artificial Sequence
  Description of Artificial Sequence: Synthetic oligonucleotide
  Target: ATXN1; (-) strand; PAM type: NRG; PAM sequence: CAG
gatcaggtcattcagttggg

SEQ ID NO: 48074 - DNA, 20 bp, Artificial Sequence
  Description of Artificial Sequence: Synthetic oligonucleotide
  Target: ATXN1; (-) strand; PAM type: NRG; PAM sequence: GGG
gaagatcaggtcattcagtt

SEQ ID NO: 48075 - DNA, 20 bp, Artificial Sequence
  Description of Artificial Sequence: Synthetic oligonucleotide
  Target: ATXN1; (-) strand; PAM type: NRG; PAM sequence: TGG
agaagatcaggtcattcagt

SEQ ID NO: 48076 - DNA, 20 bp, Artificial Sequence
  Description of Artificial Sequence: Synthetic oligonucleotide
  Target: ATXN1; (-) strand; PAM type: NRG; PAM sequence: CAG
aagaagaagatcaggtcatt

SEQ ID NO: 48077 - DNA, 20 bp, Artificial Sequence
  Description of Artificial Sequence: Synthetic oligonucleotide
  Target: ATXN1; (-) strand; PAM type: NRG; PAM sequence: AGG
tgcaaggcaagaagaagatc

SEQ ID NO: 48078 - DNA, 20 bp, Artificial Sequence
  Description of Artificial Sequence: Synthetic oligonucleotide
  Target: ATXN1; (-) strand; PAM type: NRG; PAM sequence: CAG
ttgcaaggcaagaagaagat

SEQ ID NO: 48079 - DNA, 20 bp, Artificial Sequence
  Description of Artificial Sequence: Synthetic oligonucleotide
  Target: ATXN1; (-) strand; PAM type: NRG; PAM sequence: AAG
ccttcttgcaaggcaagaag

SEQ ID NO: 48080 - DNA, 20 bp, Artificial Sequence
  Description of Artificial Sequence: Synthetic oligonucleotide
  Target: ATXN1; (-) strand; PAM type: NRG; PAM sequence: AAG
ataccttcttgcaaggcaag

SEQ ID NO: 48081 - DNA, 20 bp, Artificial Sequence
  Description of Artificial Sequence: Synthetic oligonucleotide
  Target: ATXN1; (-) strand; PAM type: NRG; PAM sequence: AAG
ggcataccttcttgcaaggc

SEQ ID NO: 48082 - DNA, 20 bp, Artificial Sequence
  Description of Artificial Sequence: Synthetic oligonucleotide
  Target: ATXN1; (-) strand; PAM type: NRG; PAM sequence: AGG
tctaggcataccttcttgca

SEQ ID NO: 48083 - DNA, 20 bp, Artificial Sequence
  Description of Artificial Sequence: Synthetic oligonucleotide
  Target: ATXN1; (-) strand; PAM type: NRG; PAM sequence: AAG
gtctaggcataccttcttgc

SEQ ID NO: 48084 - DNA, 20 bp, Artificial Sequence
  Description of Artificial Sequence: Synthetic oligonucleotide
  Target: ATXN1; (-) strand; PAM type: NRG; PAM sequence: AGG
gcataccttcttgcaagtct

SEQ ID NO: 48085 - DNA, 20 bp, Artificial Sequence
  Description of Artificial Sequence: Synthetic oligonucleotide
  Target: ATXN1; (-) strand; PAM type: NRG; PAM sequence: TAG
ggcataccttcttgcaagtc

SEQ ID NO: 48086 - DNA, 20 bp, Artificial Sequence
  Description of Artificial Sequence: Synthetic oligonucleotide
  Target: ATXN1; (-) strand; PAM type: NRG; PAM sequence: AAG
ggctaggcataccttcttgc

SEQ ID NO: 48087 - DNA, 20 bp, Artificial Sequence
  Description of Artificial Sequence: Synthetic oligonucleotide
  Target: ATXN1; (-) strand; PAM type: NRG; PAM sequence: AGG
gcatacctagctgcaaggct

SEQ ID NO: 48088 - DNA, 20 bp, Artificial Sequence
  Description of Artificial Sequence: Synthetic oligonucleotide
  Target: ATXN1; (-) strand; PAM type: NRG; PAM sequence: TAG
ggcatacctagctgcaaggc

SEQ ID NO: 48089 - DNA, 20 bp, Artificial Sequence
  Description of Artificial Sequence: Synthetic oligonucleotide
  Target: ATXN1; (-) strand; PAM type: NRG; PAM sequence: AGG
tctaggcatacctagctgca

SEQ ID NO: 48090 - DNA, 20 bp, Artificial Sequence
  Description of Artificial Sequence: Synthetic oligonucleotide
  Target: ATXN1; (-) strand; PAM type: NRG; PAM sequence: AAG
gtctaggcatacctagctgc

SEQ ID NO: 48091 - DNA, 20 bp, Artificial Sequence
  Description of Artificial Sequence: Synthetic oligonucleotide
  Target: ATXN1; (-) strand; PAM type: NRG; PAM sequence: TAG
gaatttagtctaggcatacc

SEQ ID NO: 48092 - DNA, 20 bp, Artificial Sequence
  Description of Artificial Sequence: Synthetic oligonucleotide
  Target: ATXN1; (-) strand; PAM type: NRG; PAM sequence: AGG
tgtcaacaagaatttagtct

SEQ ID NO: 48093 - DNA, 20 bp, Artificial Sequence
  Description of Artificial Sequence: Synthetic oligonucleotide
  Target: ATXN1; (-) strand; PAM type: NRG; PAM sequence: TAG
atgtcaacaagaatttagtc

SEQ ID NO: 48094 - DNA, 20 bp, Artificial Sequence
  Description of Artificial Sequence: Synthetic oligonucleotide
  Target: ATXN1; (-) strand; PAM type: NRG; PAM sequence: TAG
acttcatgtcaacaagaatt

SEQ ID NO: 48095 - DNA, 20 bp, Artificial Sequence
  Description of Artificial Sequence: Synthetic oligonucleotide
  Target: ATXN1; (-) strand; PAM type: NRG; PAM sequence: AAG
tttgtttacttcatgtcaac

SEQ ID NO: 48096 - DNA, 20 bp, Artificial Sequence
  Description of Artificial Sequence: Synthetic oligonucleotide
  Target: ATXN1; (-) strand; PAM type: NRG; PAM sequence: AGG
tttccaaagacacttgccag

SEQ ID NO: 48097 - DNA, 20 bp, Artificial Sequence
  Description of Artificial Sequence: Synthetic oligonucleotide
  Target: ATXN1; (-) strand; PAM type: NRG; PAM sequence: GAG
ctttccaaagacacttgcca

SEQ ID NO: 48098 - DNA, 20 bp, Artificial Sequence
  Description of Artificial Sequence: Synthetic oligonucleotide
  Target: ATXN1; (-) strand; PAM type: NRG; PAM sequence: CAG
ccctttccaaagacacttgc

SEQ ID NO: 48099 - DNA, 20 bp, Artificial Sequence
  Description of Artificial Sequence: Synthetic oligonucleotide
  Target: ATXN1; (-) strand; PAM type: NRG; PAM sequence: AAG
aaggacctaccccctttcca

SEQ ID NO: 48100 - DNA, 20 bp, Artificial Sequence
  Description of Artificial Sequence: Synthetic oligonucleotide
  Target: ATXN1; (-) strand; PAM type: NRG; PAM sequence: AGG
cagaaaggaggaagagacga

SEQ ID NO: 48101 - DNA, 20 bp, Artificial Sequence
  Description of Artificial Sequence: Synthetic oligonucleotide
  Target: ATXN1; (-) strand; PAM type: NRG; PAM sequence: AAG
gcagaaaggaggaagagacg

SEQ ID NO: 48102 - DNA, 20 bp, Artificial Sequence
  Description of Artificial Sequence: Synthetic oligonucleotide
  Target: ATXN1; (-) strand; PAM type: NRG; PAM sequence: GAG
cagaaagcagaaaggaggaa

SEQ ID NO: 48103 - DNA, 20 bp, Artificial Sequence
  Description of Artificial Sequence: Synthetic oligonucleotide
  Target: ATXN1; (-) strand; PAM type: NRG; PAM sequence: AAG
tccagaaagcagaaaggagg

SEQ ID NO: 48104 - DNA, 20 bp, Artificial Sequence
  Description of Artificial Sequence: Synthetic oligonucleotide
  Target: ATXN1; (-) strand; PAM type: NRG; PAM sequence: AGG
cattccagaaagcagaaagg

SEQ ID NO: 48105 - DNA, 20 bp, Artificial Sequence
  Description of Artificial Sequence: Synthetic oligonucleotide
  Target: ATXN1; (-) strand; PAM type: NRG; PAM sequence: GAG
ccattccagaaagcagaaag

SEQ ID NO: 48106 - DNA, 20 bp, Artificial Sequence
  Description of Artificial Sequence: Synthetic oligonucleotide
  Target: ATXN1; (-) strand; PAM type: NRG; PAM sequence: AGG
taccattccagaaagcagaa

SEQ ID NO: 48107 - DNA, 20 bp, Artificial Sequence
  Description of Artificial Sequence: Synthetic oligonucleotide
  Target: ATXN1; (-) strand; PAM type: NRG; PAM sequence: AAG
ttaccattccagaaagcaga

SEQ ID NO: 48108 - DNA, 20 bp, Artificial Sequence
  Description of Artificial Sequence: Synthetic oligonucleotide
  Target: ATXN1; (-) strand; PAM type: NRG; PAM sequence: CAG
aacattaccattccagaaag

SEQ ID NO: 48109 - DNA, 20 bp, Artificial Sequence
  Description of Artificial Sequence: Synthetic oligonucleotide
  Target: ATXN1; (-) strand; PAM type: NRG; PAM sequence: AAG
tttaacattaccattccaga

SEQ ID NO: 48110 - DNA, 20 bp, Artificial Sequence
  Description of Artificial Sequence: Synthetic oligonucleotide
  Target: ATXN1; (-) strand; PAM type: NRG; PAM sequence: CAG
agcctttaacattaccattc

SEQ ID NO: 48111 - DNA, 20 bp, Artificial Sequence
  Description of Artificial Sequence: Synthetic oligonucleotide
  Target: ATXN1; (-) strand; PAM type: NRG; PAM sequence: TAG
acaagatggctgcatagctc

SEQ ID NO: 48112 - DNA, 20 bp, Artificial Sequence
  Description of Artificial Sequence: Synthetic oligonucleotide
  Target: ATXN1; (-) strand; PAM type: NRG; PAM sequence: TAG
tcacatacaagatggctgca

SEQ ID NO: 48113 - DNA, 20 bp, Artificial Sequence
  Description of Artificial Sequence: Synthetic oligonucleotide
  Target: ATXN1; (-) strand; PAM type: NRG; PAM sequence: TGG
cctatgtctcacatacaaga

SEQ ID NO: 48114 - DNA, 20 bp, Artificial Sequence
  Description of Artificial Sequence: Synthetic oligonucleotide
  Target: ATXN1; (-) strand; PAM type: NRG; PAM sequence: AAG
tcagcctatgtctcacatac

SEQ ID NO: 48115 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatgcacccgcct

SEQ ID NO: 48116 - DNA, 20 bp, Artificial Sequence
  Description of Artificial Sequence: Synthetic oligonucleotide
  Target: ATXN1; (-) strand; PAM type: NRG; PAM sequence: AAG
ggtctcgaactcctgacctc

SEQ ID NO: 48117 - DNA, 20 bp, Artificial Sequence
  Description of Artificial Sequence: Synthetic oligonucleotide
  Target: ATXN1; (-) strand; PAM type: NRG; PAM sequence: TGG
gtttcacatgttggccaagc

SEQ ID NO: 48118 - DNA, 20 bp, Artificial Sequence
  Description of Artificial Sequence: Synthetic oligonucleotide
  Target: ATXN1; (-) strand; PAM type: NRG; PAM sequence: AAG
cagggtttcacatgttggcc

SEQ ID NO: 48119 - DNA, 20 bp, Artificial Sequence
  Description of Artificial Sequence: Synthetic oligonucleotide
  Target: ATXN1; (-) strand; PAM type: NRG; PAM sequence: TGG
agagacagggtttcacatgt

SEQ ID NO: 48120 - DNA, 20 bp, Artificial Sequence
  Description of Artificial Sequence: Synthetic oligonucleotide
  Target: ATXN1; (-) strand; PAM type: NRG; PAM sequence: GGG
tgtattttttagtagagaca

SEQ ID NO: 48121 - DNA, 20 bp, Artificial Sequence
  Description of Artificial Sequence: Synthetic oligonucleotide
  Target: ATXN1; (-) strand; PAM type: NRG; PAM sequence: AGG
atgtattttttagtagagac

SEQ ID NO: 48122 - DNA, 20 bp, Artificial Sequence
  Description of Artificial Sequence: Synthetic oligonucleotide
  Target: ATXN1; (-) strand; PAM type: NRG; PAM sequence: CAG
tatgtattttttagtagaga

SEQ ID NO: 48123 - DNA, 20 bp, Artificial Sequence
  Description of Artificial Sequence: Synthetic oligonucleotide
  Target: ATXN1; (-) strand; PAM type: NRG; PAM sequence: GAG
tttttatgtattttttagta

SEQ ID NO: 48124 - DNA, 20 bp, Artificial Sequence
  Description of Artificial Sequence: Synthetic oligonucleotide
  Target: ATXN1; (-) strand; PAM type: NRG; PAM sequence: TAG
aatttttatgtattttttag

SEQ ID NO: 48125 - DNA, 20 bp, Artificial Sequence
  Description of Artificial Sequence: Synthetic oligonucleotide
  Target: ATXN1; (-) strand; PAM type: NRG; PAM sequence: TAG
gctaatttttatgtattttt

SEQ ID NO: 48126 - DNA, 20 bp, Artificial Sequence
  Description of Artificial Sequence: Synthetic oligonucleotide
  Target: ATXN1; (-) strand; PAM type: NRG; PAM sequence: TGG
caggtgcgcaccaacatgtc

SEQ ID NO: 48127 - DNA, 20 bp, Artificial Sequence
  Description of Artificial Sequence: Synthetic oligonucleotide
  Target: ATXN1; (-) strand; PAM type: NRG; PAM sequence: AGG
tcccgagtaactgggactac

SEQ ID NO: 48128 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtaactgggacta

SEQ ID NO: 48129 - DNA, 20 bp, Artificial Sequence
  Description of Artificial Sequence: Synthetic oligonucleotide
  Target: ATXN1; (-) strand; PAM type: NRG; PAM sequence: GGG
cctcaggctcccgagtaact

SEQ ID NO: 48130 - DNA, 20 bp, Artificial Sequence
  Description of Artificial Sequence: Synthetic oligonucleotide
  Target: ATXN1; (-) strand; PAM type: NRG; PAM sequence: TGG
gcctcaggctcccgagtaac

SEQ ID NO: 48131 - DNA, 20 bp, Artificial Sequence
  Description of Artificial Sequence: Synthetic oligonucleotide
  Target: ATXN1; (-) strand; PAM type: NRG; PAM sequence: GAG
ttgtcctgcctcaggctccc

SEQ ID NO: 48132 - DNA, 20 bp, Artificial Sequence
  Description of Artificial Sequence: Synthetic oligonucleotide
  Target: ATXN1; (-) strand; PAM type: NRG; PAM sequence: AGG
tcgagcaattgtcctgcctc

SEQ ID NO: 48133 - DNA, 20 bp, Artificial Sequence
  Description of Artificial Sequence: Synthetic oligonucleotide
  Target: ATXN1; (-) strand; PAM type: NRG; PAM sequence: CAG
ttcgagcaattgtcctgcct

SEQ ID NO: 48134 - DNA, 20 bp, Artificial Sequence
  Description of Artificial Sequence: Synthetic oligonucleotide
  Target: ATXN1; (-) strand; PAM type: NRG; PAM sequence: GAG
aacctcttcctcttgggttc

SEQ ID NO: 48135 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctcttcctctt

SEQ ID NO: 48136 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctcttcctct

SEQ ID NO: 48137 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcatgattt

SEQ ID NO: 48138 - DNA, 20 bp, Artificial Sequence
  Description of Artificial Sequence: Synthetic oligonucleotide
  Target: ATXN1; (-) strand; PAM type: NRG; PAM sequence: TGG
tctcccaggctggagtgcag

SEQ ID NO: 48139 - DNA, 20 bp, Artificial Sequence
  Description of Artificial Sequence: Synthetic oligonucleotide
  Target: ATXN1; (-) strand; PAM type: NRG; PAM sequence: CAG
ctgtctcccaggctggagtg

SEQ ID NO: 48140 - DNA, 20 bp, Artificial Sequence
  Description of Artificial Sequence: Synthetic oligonucleotide
  Target: ATXN1; (-) strand; PAM type: NRG; PAM sequence: GAG
ttgctctgtctcccaggctg

SEQ ID NO: 48141 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgtctcccaggc

SEQ ID NO: 48142 - DNA, 20 bp, Artificial Sequence
  Description of Artificial Sequence: Synthetic oligonucleotide
  Target: ATXN1; (-) strand; PAM type: NRG; PAM sequence: AGG
agattcttgctctgtctccc

SEQ ID NO: 48143 - DNA, 20 bp, Artificial Sequence
  Description of Artificial Sequence: Synthetic oligonucleotide
  Target: ATXN1; (-) strand; PAM type: NRG; PAM sequence: CAG
cagattcttgctctgtctcc

SEQ ID NO: 48144 - DNA, 20 bp, Artificial Sequence
  Description of Artificial Sequence: Synthetic oligonucleotide
  Target: ATXN1; (-) strand; PAM type: NRG; PAM sequence: CAG
ctttctttttttttttgaga

SEQ ID NO: 48145 - DNA, 20 bp, Artificial Sequence
  Description of Artificial Sequence: Synthetic oligonucleotide
  Target: ATXN1; (-) strand; PAM type: NRG; PAM sequence: GAG
ttttctttcttttttttttt

SEQ ID NO: 48146 - DNA, 20 bp, Artificial Sequence
  Description of Artificial Sequence: Synthetic oligonucleotide
  Target: ATXN1; (-) strand; PAM type: NRG; PAM sequence: TAG
ctttctattctgccatgctg

SEQ ID NO: 48147 - DNA, 20 bp, Artificial Sequence
  Description of Artificial Sequence: Synthetic oligonucleotide
  Target: ATXN1; (-) strand; PAM type: NRG; PAM sequence: CAG
ttatggtcactgcacaggct

SEQ ID NO: 48148 - DNA, 20 bp, Artificial Sequence
  Description of Artificial Sequence: Synthetic oligonucleotide
  Target: ATXN1; (-) strand; PAM type: NRG; PAM sequence: AGG
ggtgattatggtcactgcac

SEQ ID NO: 48149 - DNA, 20 bp, Artificial Sequence
  Description of Artificial Sequence: Synthetic oligonucleotide
  Target: ATXN1; (-) strand; PAM type: NRG; PAM sequence: CAG
gggtgattatggtcactgca

SEQ ID NO: 48150 - DNA, 20 bp, Artificial Sequence
  Description of Artificial Sequence: Synthetic oligonucleotide
  Target: ATXN1; (-) strand; PAM type: NRG; PAM sequence: TGG
taagcagtccagggtgatta

SEQ ID NO: 48151 - DNA, 20 bp, Artificial Sequence
  Description of Artificial Sequence: Synthetic oligonucleotide
  Target: ATXN1; (-) strand; PAM type: NRG; PAM sequence: GGG
tttgagaggtaagcagtcca

SEQ ID NO: 48152 - DNA, 20 bp, Artificial Sequence
  Description of Artificial Sequence: Synthetic oligonucleotide
  Target: ATXN1; (-) strand; PAM type: NRG; PAM sequence: AGG
ttttgagaggtaagcagtcc

SEQ ID NO: 48153 - DNA, 20 bp, Artificial Sequence
  Description of Artificial Sequence: Synthetic oligonucleotide
  Target: ATXN1; (-) strand; PAM type: NRG; PAM sequence: CAG
gttttgagaggtaagcagtc

SEQ ID NO: 48154 - DNA, 20 bp, Artificial Sequence
  Description of Artificial Sequence: Synthetic oligonucleotide
  Target: ATXN1; (-) strand; PAM type: NRG; PAM sequence: CAG
aagtggttttgagaggtaag

SEQ ID NO: 48155 - DNA, 20 bp, Artificial Sequence
  Description of Artificial Sequence: Synthetic oligonucleotide
  Target: ATXN1; (-) strand; PAM type: NRG; PAM sequence: AAG
taaaagtggttttgagaggt

SEQ ID NO: 48156 - DNA, 20 bp, Artificial Sequence
  Description of Artificial Sequence: Synthetic oligonucleotide
  Target: ATXN1; (-) strand; PAM type: NRG; PAM sequence: AGG
cacataaaagtggttttgag

SEQ ID NO: 48157 - DNA, 20 bp, Artificial Sequence
  Description of Artificial Sequence: Synthetic oligonucleotide
  Target: ATXN1; (-) strand; PAM type: NRG; PAM sequence: GAG
tcacataaaagtggttttga

SEQ ID NO: 48158 - DNA, 20 bp, Artificial Sequence
  Description of Artificial Sequence: Synthetic oligonucleotide
  Target: ATXN1; (-) strand; PAM type: NRG; PAM sequence: GAG
tctcacataaaagtggtttt

SEQ ID NO: 48159 - DNA, 20 bp, Artificial Sequence
  Description of Artificial Sequence: Synthetic oligonucleotide
  Target: ATXN1; (-) strand; PAM type: NRG; PAM sequence: TGG
atttttctctcacataaaag

SEQ ID NO: 48160 - DNA, 20 bp, Artificial Sequence
  Description of Artificial Sequence: Synthetic oligonucleotide
  Target: ATXN1; (-) strand; PAM type: NRG; PAM sequence: AAG
tttatttttctctcacataa

SEQ ID NO: 48161 - DNA, 20 bp, Artificial Sequence
  Description of Artificial Sequence: Synthetic oligonucleotide
  Target: ATXN1; (-) strand; PAM type: NRG; PAM sequence: TAG
aagaagtcaagccaaagaaa

SEQ ID NO: 48162 - DNA, 20 bp, Artificial Sequence
  Description of Artificial Sequence: Synthetic oligonucleotide
  Target: ATXN1; (-) strand; PAM type: NRG; PAM sequence: AAG
aagaagaagaagtcaagcca

SEQ ID NO: 48163 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaagaagaagaagtc

SEQ ID NO: 48164 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaagaagaag

SEQ ID NO: 48165 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaagaag

SEQ ID NO: 48166 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaaaag

SEQ ID NO: 48167 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaaaaa

SEQ ID NO: 48168 - DNA, 20 bp, Artificial Sequence
  Description of Artificial Sequence: Synthetic oligonucleotide
  Target: ATXN1; (-) strand; PAM type: NRG; PAM sequence: CAG
gtaacagttaggattaggtt

SEQ ID NO: 48169 - DNA, 20 bp, Artificial Sequence
  Description of Artificial Sequence: Synthetic oligonucleotide
  Target: ATXN1; (-) strand; PAM type: NRG; PAM sequence: AGG
tatttgtaacagttaggatt

SEQ ID NO: 48170 - DNA, 20 bp, Artificial Sequence
  Description of Artificial Sequence: Synthetic oligonucleotide
  Target: ATXN1; (-) strand; PAM type: NRG; PAM sequence: TAG
ctatttgtaacagttaggat

SEQ ID NO: 48171 - DNA, 20 bp, Artificial Sequence
  Description of Artificial Sequence: Synthetic oligonucleotide
  Target: ATXN1; (-) strand; PAM type: NRG; PAM sequence: AGG
aaggtctatttgtaacagtt

SEQ ID NO: 48172 - DNA, 20 bp, Artificial Sequence
  Description of Artificial Sequence: Synthetic oligonucleotide
  Target: ATXN1; (-) strand; PAM type: NRG; PAM sequence: TAG
taaggtctatttgtaacagt

SEQ ID NO: 48173 - DNA, 20 bp, Artificial Sequence
  Description of Artificial Sequence: Synthetic oligonucleotide
  Target: ATXN1; (-) strand; PAM type: NRG; PAM sequence: CAG
cctctaaggtctatttgtaa

SEQ ID NO: 48174 - DNA, 20 bp, Artificial Sequence
  Description of Artificial Sequence: Synthetic oligonucleotide
  Target: ATXN1; (-) strand; PAM type: NRG; PAM sequence: AGG
gaagtctattatgacctcta

SEQ ID NO: 48175 - DNA, 20 bp, Artificial Sequence
  Description of Artificial Sequence: Synthetic oligonucleotide
  Target: ATXN1; (-) strand; PAM type: NRG; PAM sequence: AAG
tgaagtctattatgacctct

SEQ ID NO: 48176 - DNA, 20 bp, Artificial Sequence
  Description of Artificial Sequence: Synthetic oligonucleotide
  Target: ATXN1; (-) strand; PAM type: NRG; PAM sequence: AAG
gtttcctaatctgtaaaatg

SEQ ID NO: 48177 - DNA, 20 bp, Artificial Sequence
  Description of Artificial Sequence: Synthetic oligonucleotide
  Target: ATXN1; (-) strand; PAM type: NRG; PAM sequence: TAG
caaagttgatctttaatcat

SEQ ID NO: 48178 - DNA, 20 bp, Artificial Sequence
  Description of Artificial Sequence: Synthetic oligonucleotide
  Target: ATXN1; (-) strand; PAM type: NRG; PAM sequence: AAG
cccgattgagacatttatca

SEQ ID NO: 48179 - DNA, 20 bp, Artificial Sequence
  Description of Artificial Sequence: Synthetic oligonucleotide
  Target: ATXN1; (-) strand; PAM type: NRG; PAM sequence: GAG
gccaactctgcttcccgatt

SEQ ID NO: 48180 - DNA, 20 bp, Artificial Sequence
  Description of Artificial Sequence: Synthetic oligonucleotide
  Target: ATXN1; (-) strand; PAM type: NRG; PAM sequence: AAG
agaaaaagaagattaaacag

SEQ ID NO: 48181 - DNA, 20 bp, Artificial Sequence
  Description of Artificial Sequence: Synthetic oligonucleotide
  Target: ATXN1; (-) strand; PAM type: NRG; PAM sequence: CAG
tttagaaaaagaagattaaa

SEQ ID NO: 48182 - DNA, 20 bp, Artificial Sequence
  Description of Artificial Sequence: Synthetic oligonucleotide
  Target: ATXN1; (-) strand; PAM type: NRG; PAM sequence: AAG
tcatctatctttagaaaaag

SEQ ID NO: 48183 - DNA, 20 bp, Artificial Sequence
  Description of Artificial Sequence: Synthetic oligonucleotide
  Target: ATXN1; (-) strand; PAM type: NRG; PAM sequence: AAG
tcatcatctatctttagaaa

SEQ ID NO: 48184 - DNA, 20 bp, Artificial Sequence
  Description of Artificial Sequence: Synthetic oligonucleotide
  Target: ATXN1; (-) strand; PAM type: NRG; PAM sequence: TAG
gaaccttcatcatctatctt

SEQ ID NO: 48185 - DNA, 20 bp, Artificial Sequence
  Description of Artificial Sequence: Synthetic oligonucleotide
  Target: ATXN1; (-) strand; PAM type: NRG; PAM sequence: TAG
atactgataggcatataaaa

SEQ ID NO: 48186 - DNA, 20 bp, Artificial Sequence
  Description of Artificial Sequence: Synthetic oligonucleotide
  Target: ATXN1; (-) strand; PAM type: NRG; PAM sequence: AGG
ttcatttagcagatactgat

SEQ ID NO: 48187 - DNA, 20 bp, Artificial Sequence
  Description of Artificial Sequence: Synthetic oligonucleotide
  Target: ATXN1; (-) strand; PAM type: NRG; PAM sequence: TAG
attcatttagcagatactga

SEQ ID NO: 48188 - DNA, 20 bp, Artificial Sequence
  Description of Artificial Sequence: Synthetic oligonucleotide
  Target: ATXN1; (-) strand; PAM type: NRG; PAM sequence: CAG
ataaaaccgtattcatttag

SEQ ID NO: 48189 - DNA, 20 bp, Artificial Sequence
  Description of Artificial Sequence: Synthetic oligonucleotide
  Target: ATXN1; (-) strand; PAM type: NRG; PAM sequence: TAG
aatataaaaccgtattcatt

SEQ ID NO: 48190 - DNA, 20 bp, Artificial Sequence
  Description of Artificial Sequence: Synthetic oligonucleotide
  Target: ATXN1; (-) strand; PAM type: NRG; PAM sequence: CAG
ctcagaggttcagaaattca

SEQ ID NO: 48191 - DNA, 20 bp, Artificial Sequence
  Description of Artificial Sequence: Synthetic oligonucleotide
  Target: ATXN1; (-) strand; PAM type: NRG; PAM sequence: CAG
gttggaagacctcagaggtt

SEQ ID NO: 48192 - DNA, 20 bp, Artificial Sequence
  Description of Artificial Sequence: Synthetic oligonucleotide
  Target: ATXN1; (-) strand; PAM type: NRG; PAM sequence: AGG
tgccagttggaagacctcag

SEQ ID NO: 48193 - DNA, 20 bp, Artificial Sequence
  Description of Artificial Sequence: Synthetic oligonucleotide
  Target: ATXN1; (-) strand; PAM type: NRG; PAM sequence: GAG
gtgccagttggaagacctca

SEQ ID NO: 48194 - DNA, 20 bp, Artificial Sequence
  Description of Artificial Sequence: Synthetic oligonucleotide
  Target: ATXN1; (-) strand; PAM type: NRG; PAM sequence: CAG
atgtgccagttggaagacct

SEQ ID NO: 48195 - DNA, 20 bp, Artificial Sequence
  Description of Artificial Sequence: Synthetic oligonucleotide
  Target: ATXN1; (-) strand; PAM type: NRG; PAM sequence: AAG
ggattagatgtgccagttgg

SEQ ID NO: 48196 - DNA, 20 bp, Artificial Sequence
  Description of Artificial Sequence: Synthetic oligonucleotide
  Target: ATXN1; (-) strand; PAM type: NRG; PAM sequence: TGG
ttgggattagatgtgccagt

SEQ ID NO: 48197 - DNA, 20 bp, Artificial Sequence
  Description of Artificial Sequence: Synthetic oligonucleotide
  Target: ATXN1; (-) strand; PAM type: NRG; PAM sequence: CAG
tgacttgggattagatgtgc

SEQ ID NO: 48198 - DNA, 20 bp, Artificial Sequence
  Description of Artificial Sequence: Synthetic oligonucleotide
  Target: ATXN1; (-) strand; PAM type: NRG; PAM sequence: TAG
gaatatgtgtgacttgggat

SEQ ID NO: 48199 - DNA, 20 bp, Artificial Sequence
  Description of Artificial Sequence: Synthetic oligonucleotide
  Target: ATXN1; (-) strand; PAM type: NRG; PAM sequence: GGG
tccttgaatatgtgtgactt

SEQ ID NO: 48200 - DNA, 20 bp, Artificial Sequence
  Description of Artificial Sequence: Synthetic oligonucleotide
  Target: ATXN1; (-) strand; PAM type: NRG; PAM sequence: TGG
ttccttgaatatgtgtgact

SEQ ID NO: 48201 - DNA, 20 bp, Artificial Sequence
  Description of Artificial Sequence: Synthetic oligonucleotide
  Target: ATXN1; (-) strand; PAM type: NRG; PAM sequence: TAG
tcacattttttattatttaa

SEQ ID NO: 48202 - DNA, 20 bp, Artificial Sequence
  Description of Artificial Sequence: Synthetic oligonucleotide
  Target: ATXN1; (-) strand; PAM type: NRG; PAM sequence: AAG
caggaaaagaaaattttctc

SEQ ID NO: 48203 - DNA, 20 bp, Artificial Sequence
  Description of Artificial Sequence: Synthetic oligonucleotide
  Target: ATXN1; (-) strand; PAM type: NRG; PAM sequence: AAG
tctaatgaacatagcaggaa

SEQ ID NO: 48204 - DNA, 20 bp, Artificial Sequence
  Description of Artificial Sequence: Synthetic oligonucleotide
  Target: ATXN1; (-) strand; PAM type: NRG; PAM sequence: AGG
tggaatctaatgaacatagc

SEQ ID NO: 48205 - DNA, 20 bp, Artificial Sequence
  Description of Artificial Sequence: Synthetic oligonucleotide
  Target: ATXN1; (-) strand; PAM type: NRG; PAM sequence: CAG
gtggaatctaatgaacatag

SEQ ID NO: 48206 - DNA, 20 bp, Artificial Sequence
  Description of Artificial Sequence: Synthetic oligonucleotide
  Target: ATXN1; (-) strand; PAM type: NRG; PAM sequence: TAG
catgtggaatctaatgaaca

SEQ ID NO: 48207 - DNA, 20 bp, Artificial Sequence
  Description of Artificial Sequence: Synthetic oligonucleotide
  Target: ATXN1; (-) strand; PAM type: NRG; PAM sequence: TGG
aagatgcagattaagacatg

SEQ ID NO: 48208 - DNA, 20 bp, Artificial Sequence
  Description of Artificial Sequence: Synthetic oligonucleotide
  Target: ATXN1; (-) strand; PAM type: NRG; PAM sequence: AAG
tatgtactaagatgcagatt

SEQ ID NO: 48209 - DNA, 20 bp, Artificial Sequence
  Description of Artificial Sequence: Synthetic oligonucleotide
  Target: ATXN1; (-) strand; PAM type: NRG; PAM sequence: CAG
tagatttatgtactaagatg

SEQ ID NO: 48210 - DNA, 20 bp, Artificial Sequence
  Description of Artificial Sequence: Synthetic oligonucleotide
  Target: ATXN1; (-) strand; PAM type: NRG; PAM sequence: AAG
gttttgtagatttatgtact

SEQ ID NO: 48211 - DNA, 20 bp, Artificial Sequence
  Description of Artificial Sequence: Synthetic oligonucleotide
  Target: ATXN1; (-) strand; PAM type: NRG; PAM sequence: TAG
tgaaaattaatatagttttg

SEQ ID NO: 48212 - DNA, 20 bp, Artificial Sequence
  Description of Artificial Sequence: Synthetic oligonucleotide
  Target: ATXN1; (-) strand; PAM type: NRG; PAM sequence: TAG
aataccagtgaaaattaata

SEQ ID NO: 48213 - DNA, 20 bp, Artificial Sequence
  Description of Artificial Sequence: Synthetic oligonucleotide
  Target: ATXN1; (-) strand; PAM type: NRG; PAM sequence: CAG
tttagcactttctaaaatac

SEQ ID NO: 48214 - DNA, 20 bp, Artificial Sequence
  Description of Artificial Sequence: Synthetic oligonucleotide
  Target: ATXN1; (-) strand; PAM type: NRG; PAM sequence: TAG
caaatttgaaaatctccatt

SEQ ID NO: 48215 - DNA, 20 bp, Artificial Sequence
  Description of Artificial Sequence: Synthetic oligonucleotide
  Target: ATXN1; (-) strand; PAM type: NRG; PAM sequence: CAG
aaagatacctttcaacattc

SEQ ID NO: 48216 - DNA, 20 bp, Artificial Sequence
  Description of Artificial Sequence: Synthetic oligonucleotide
  Target: ATXN1; (-) strand; PAM type: NRG; PAM sequence: AAG
cttgcacacatattgaagta

SEQ ID NO: 48217 - DNA, 20 bp, Artificial Sequence
  Description of Artificial Sequence: Synthetic oligonucleotide
  Target: ATXN1; (-) strand; PAM type: NRG; PAM sequence: AAG
attatcttgcacacatattg

SEQ ID NO: 48218 - DNA, 20 bp, Artificial Sequence
  Description of Artificial Sequence: Synthetic oligonucleotide
  Target: ATXN1; (-) strand; PAM type: NRG; PAM sequence: TAG
tatattttacagctacagca

SEQ ID NO: 48219 - DNA, 20 bp, Artificial Sequence
  Description of Artificial Sequence: Synthetic oligonucleotide
  Target: ATXN1; (-) strand; PAM type: NRG; PAM sequence: CAG
agggatatattttacagcta

SEQ ID NO: 48220 - DNA, 20 bp, Artificial Sequence
  Description of Artificial Sequence: Synthetic oligonucleotide
  Target: ATXN1; (-) strand; PAM type: NRG; PAM sequence: CAG
gcatccagggatatatttta

SEQ ID NO: 48221 - DNA, 20 bp, Artificial Sequence
  Description of Artificial Sequence: Synthetic oligonucleotide
  Target: ATXN1; (-) strand; PAM type: NRG; PAM sequence: GGG
ttattctgtaaaagcatcca

SEQ ID NO: 48222 - DNA, 20 bp, Artificial Sequence
  Description of Artificial Sequence: Synthetic oligonucleotide
  Target: ATXN1; (-) strand; PAM type: NRG; PAM sequence: AGG
attattctgtaaaagcatcc

SEQ ID NO: 48223 - DNA, 20 bp, Artificial Sequence
  Description of Artificial Sequence: Synthetic oligonucleotide
  Target: ATXN1; (-) strand; PAM type: NRG; PAM sequence: CAG
tattattctgtaaaagcatc

SEQ ID NO: 48224 - DNA, 20 bp, Artificial Sequence
  Description of Artificial Sequence: Synthetic oligonucleotide
  Target: ATXN1; (-) strand; PAM type: NRG; PAM sequence: AAG
gtttcagtattattctgtaa

SEQ ID NO: 48225 - DNA, 20 bp, Artificial Sequence
  Description of Artificial Sequence: Synthetic oligonucleotide
  Target: ATXN1; (-) strand; PAM type: NRG; PAM sequence: CAG
attagtttcagagagtgttt

SEQ ID NO: 48226 - DNA, 20 bp, Artificial Sequence
  Description of Artificial Sequence: Synthetic oligonucleotide
  Target: ATXN1; (-) strand; PAM type: NRG; PAM sequence: GAG
caatatccattagtttcaga

SEQ ID NO: 48227 - DNA, 20 bp, Artificial Sequence
  Description of Artificial Sequence: Synthetic oligonucleotide
  Target: ATXN1; (-) strand; PAM type: NRG; PAM sequence: GAG
agcaatatccattagtttca

SEQ ID NO: 48228 - DNA, 20 bp, Artificial Sequence
  Description of Artificial Sequence: Synthetic oligonucleotide
  Target: ATXN1; (-) strand; PAM type: NRG; PAM sequence: CAG
ttagcaatatccattagttt

SEQ ID NO: 48229 - DNA, 20 bp, Artificial Sequence
  Description of Artificial Sequence: Synthetic oligonucleotide
  Target: ATXN1; (-) strand; PAM type: NRG; PAM sequence: TAG
gtcagtttagcaatatccat

SEQ ID NO: 48230 - DNA, 20 bp, Artificial Sequence
  Description of Artificial Sequence: Synthetic oligonucleotide
  Target: ATXN1; (-) strand; PAM type: NRG; PAM sequence: TAG
ataagtgagttttgtcagtt

SEQ ID NO: 48231 - DNA, 20 bp, Artificial Sequence
  Description of Artificial Sequence: Synthetic oligonucleotide
  Target: ATXN1; (-) strand; PAM type: NRG; PAM sequence: CAG
atttaataagtgagttttgt

SEQ ID NO: 48232 - DNA, 20 bp, Artificial Sequence
  Description of Artificial Sequence: Synthetic oligonucleotide
  Target: ATXN1; (-) strand; PAM type: NRG; PAM sequence: GAG
attaattgaatttaataagt

SEQ ID NO: 48233 - DNA, 20 bp, Artificial Sequence
  Description of Artificial Sequence: Synthetic oligonucleotide
  Target: ATXN1; (-) strand; PAM type: NRG; PAM sequence: AAG
ccccattaattgaatttaat

SEQ ID NO: 48234 - DNA, 20 bp, Artificial Sequence
  Description of Artificial Sequence: Synthetic oligonucleotide
  Target: ATXN1; (-) strand; PAM type: NRG; PAM sequence: TGG
ggaagaggcggttaatttat

SEQ ID NO: 48235 - DNA, 20 bp, Artificial Sequence
  Description of Artificial Sequence: Synthetic oligonucleotide
  Target: ATXN1; (-) strand; PAM type: NRG; PAM sequence: CGG
ggacgaacaccaggaagagg

SEQ ID NO: 48236 - DNA, 20 bp, Artificial Sequence
  Description of Artificial Sequence: Synthetic oligonucleotide
  Target: ATXN1; (-) strand; PAM type: NRG; PAM sequence: AGG
cacggacgaacaccaggaag

SEQ ID NO: 48237 - DNA, 20 bp, Artificial Sequence
  Description of Artificial Sequence: Synthetic oligonucleotide
  Target: ATXN1; (-) strand; PAM type: NRG; PAM sequence: GAG
gcacggacgaacaccaggaa

SEQ ID NO: 48238 - DNA, 20 bp, Artificial Sequence
  Description of Artificial Sequence: Synthetic oligonucleotide
  Target: ATXN1; (-) strand; PAM type: NRG; PAM sequence: AAG
gggcacggacgaacaccagg

SEQ ID NO: 48239 - DNA, 20 bp, Artificial Sequence
  Description of Artificial Sequence: Synthetic oligonucleotide
  Target: ATXN1; (-) strand; PAM type: NRG; PAM sequence: AGG
agggggcacggacgaacacc

SEQ ID NO: 48240 - DNA, 20 bp, Artificial Sequence
  Description of Artificial Sequence: Synthetic oligonucleotide
  Target: ATXN1; (-) strand; PAM type: NRG; PAM sequence: CAG
gagggggcacggacgaacac

SEQ ID NO: 48241 - DNA, 20 bp, Artificial Sequence
  Description of Artificial Sequence: Synthetic oligonucleotide
  Target: ATXN1; (-) strand; PAM type: NRG; PAM sequence: CGG
gtgaagattgggagggggca

SEQ ID NO: 48242 - DNA, 20 bp, Artificial Sequence
  Description of Artificial Sequence: Synthetic oligonucleotide
  Target: ATXN1; (-) strand; PAM type: NRG; PAM sequence: GGG
tgggagtgaagattgggagg

SEQ ID NO: 48243 - DNA, 20 bp, Artificial Sequence
  Description of Artificial Sequence: Synthetic oligonucleotide
  Target: ATXN1; (-) strand; PAM type: NRG; PAM sequence: GGG
gtgggagtgaagattgggag

SEQ ID NO: 48244 - DNA, 20 bp, Artificial Sequence
  Description of Artificial Sequence: Synthetic oligonucleotide
  Target: ATXN1; (-) strand; PAM type: NRG; PAM sequence: GGG
tgtgggagtgaagattggga

SEQ ID NO: 48245 - DNA, 20 bp, Artificial Sequence
  Description of Artificial Sequence: Synthetic oligonucleotide
  Target: ATXN1; (-) strand; PAM type: NRG; PAM sequence: AGG
ttgtgggagtgaagattggg

SEQ ID NO: 48246 - DNA, 20 bp, Artificial Sequence
  Description of Artificial Sequence: Synthetic oligonucleotide
  Target: ATXN1; (-) strand; PAM type: NRG; PAM sequence: GAG
tttgtgggagtgaagattgg

SEQ ID NO: 48247 - DNA, 20 bp, Artificial Sequence
  Description of Artificial Sequence: Synthetic oligonucleotide
  Target: ATXN1; (-) strand; PAM type: NRG; PAM sequence: GGG
gatttgtgggagtgaagatt

SEQ ID NO: 48248 - DNA, 20 bp, Artificial Sequence
  Description of Artificial Sequence: Synthetic oligonucleotide
  Target: ATXN1; (-) strand; PAM type: NRG; PAM sequence: TGG
tgatttgtgggagtgaagat

SEQ ID NO: 48249 - DNA, 20 bp, Artificial Sequence
  Description of Artificial Sequence: Synthetic oligonucleotide
  Target: ATXN1; (-) strand; PAM type: NRG; PAM sequence: AAG
gtgcatgatttgtgggagtg

SEQ ID NO: 48250 - DNA, 20 bp, Artificial Sequence
  Description of Artificial Sequence: Synthetic oligonucleotide
  Target: ATXN1; (-) strand; PAM type: NRG; PAM sequence: GAG
ggctagtgcatgatttgtgg

SEQ ID NO: 48251 - DNA, 20 bp, Artificial Sequence
  Description of Artificial Sequence: Synthetic oligonucleotide
  Target: ATXN1; (-) strand; PAM type: NRG; PAM sequence: GGG
atggctagtgcatgatttgt

SEQ ID NO: 48252 - DNA, 20 bp, Artificial Sequence
  Description of Artificial Sequence: Synthetic oligonucleotide
  Target: ATXN1; (-) strand; PAM type: NRG; PAM sequence: TGG
aatggctagtgcatgatttg

SEQ ID NO: 48253 - DNA, 20 bp, Artificial Sequence
  Description of Artificial Sequence: Synthetic oligonucleotide
  Target: ATXN1; (-) strand; PAM type: NRG; PAM sequence: TAG
ttccttctatttttaatggc

SEQ ID NO: 48254 - DNA, 20 bp, Artificial Sequence
  Description of Artificial Sequence: Synthetic oligonucleotide
  Target: ATXN1; (-) strand; PAM type: NRG; PAM sequence: TGG
aagtttccttctatttttaa

SEQ ID NO: 48255 - DNA, 20 bp, Artificial Sequence
  Description of Artificial Sequence: Synthetic oligonucleotide
  Target: ATXN1; (-) strand; PAM type: NRG; PAM sequence: AAG
tactttaacatagaggaaga

SEQ ID NO: 48256 - DNA, 20 bp, Artificial Sequence
  Description of Artificial Sequence: Synthetic oligonucleotide
  Target: ATXN1; (-) strand; PAM type: NRG; PAM sequence: AAG
aagttactttaacatagagg

SEQ ID NO: 48257 - DNA, 20 bp, Artificial Sequence
  Description of Artificial Sequence: Synthetic oligonucleotide
  Target: ATXN1; (-) strand; PAM type: NRG; PAM sequence: AGG
ttcaagttactttaacatag

SEQ ID NO: 48258 - DNA, 20 bp, Artificial Sequence
  Description of Artificial Sequence: Synthetic oligonucleotide
  Target: ATXN1; (-) strand; PAM type: NRG; PAM sequence: GAG
tttcaagttactttaacata

SEQ ID NO: 48259 - DNA, 20 bp, Artificial Sequence
  Description of Artificial Sequence: Synthetic oligonucleotide
  Target: ATXN1; (-) strand; PAM type: NRG; PAM sequence: TAG
gatttcaagttactttaaca

SEQ ID NO: 48260 - DNA, 20 bp, Artificial Sequence
  Description of Artificial Sequence: Synthetic oligonucleotide
  Target: ATXN1; (-) strand; PAM type: NRG; PAM sequence: AAG
aagacaaggtagatgatttc

SEQ ID NO: 48261 - DNA, 20 bp, Artificial Sequence
  Description of Artificial Sequence: Synthetic oligonucleotide
  Target: ATXN1; (-) strand; PAM type: NRG; PAM sequence: TAG
aggagttttagaagacaagg

SEQ ID NO: 48262 - DNA, 20 bp, Artificial Sequence
  Description of Artificial Sequence: Synthetic oligonucleotide
  Target: ATXN1; (-) strand; PAM type: NRG; PAM sequence: AGG
gagaggagttttagaagaca

SEQ ID NO: 48263 - DNA, 20 bp, Artificial Sequence
  Description of Artificial Sequence: Synthetic oligonucleotide
  Target: ATXN1; (-) strand; PAM type: NRG; PAM sequence: AAG
agagaggagttttagaagac

SEQ ID NO: 48264 - DNA, 20 bp, Artificial Sequence
  Description of Artificial Sequence: Synthetic oligonucleotide
  Target: ATXN1; (-) strand; PAM type: NRG; PAM sequence: AAG
caacaagagaggagttttag

SEQ ID NO: 48265 - DNA, 20 bp, Artificial Sequence
  Description of Artificial Sequence: Synthetic oligonucleotide
  Target: ATXN1; (-) strand; PAM type: NRG; PAM sequence: TAG
aagcaacaagagaggagttt

SEQ ID NO: 48266 - DNA, 20 bp, Artificial Sequence
  Description of Artificial Sequence: Synthetic oligonucleotide
  Target: ATXN1; (-) strand; PAM type: NRG; PAM sequence: GAG
tttagaaagcaacaagagag

SEQ ID NO: 48267 - DNA, 20 bp, Artificial Sequence
  Description of Artificial Sequence: Synthetic oligonucleotide
  Target: ATXN1; (-) strand; PAM type: NRG; PAM sequence: AGG
tatttagaaagcaacaagag

SEQ ID NO: 48268 - DNA, 20 bp, Artificial Sequence
  Description of Artificial Sequence: Synthetic oligonucleotide
  Target: ATXN1; (-) strand; PAM type: NRG; PAM sequence: GAG
atatttagaaagcaacaaga

SEQ ID NO: 48269 - DNA, 20 bp, Artificial Sequence
  Description of Artificial Sequence: Synthetic oligonucleotide
  Target: ATXN1; (-) strand; PAM type: NRG; PAM sequence: GAG
ggatatttagaaagcaacaa

SEQ ID NO: 48270 - DNA, 20 bp, Artificial Sequence
  Description of Artificial Sequence: Synthetic oligonucleotide
  Target: ATXN1; (-) strand; PAM type: NRG; PAM sequence: AAG
ttggatatttagaaagcaac

SEQ ID NO: 48271 - DNA, 20 bp, Artificial Sequence
  Description of Artificial Sequence: Synthetic oligonucleotide
  Target: ATXN1; (-) strand; PAM type: NRG; PAM sequence: AAG
tttccatttggatatttaga

SEQ ID NO: 48272 - DNA, 20 bp, Artificial Sequence
  Description of Artificial Sequence: Synthetic oligonucleotide
  Target: ATXN1; (-) strand; PAM type: NRG; PAM sequence: TAG
tcattttccatttggatatt

SEQ ID NO: 48273 - DNA, 20 bp, Artificial Sequence
  Description of Artificial Sequence: Synthetic oligonucleotide
  Target: ATXN1; (-) strand; PAM type: NRG; PAM sequence: TGG
ctccaggatcattttccatt

SEQ ID NO: 48274 - DNA, 20 bp, Artificial Sequence
  Description of Artificial Sequence: Synthetic oligonucleotide
  Target: ATXN1; (-) strand; PAM type: NRG; PAM sequence: AGG
cacatactgcccattcctcc

SEQ ID NO: 48275 - DNA, 20 bp, Artificial Sequence
  Description of Artificial Sequence: Synthetic oligonucleotide
  Target: ATXN1; (-) strand; PAM type: NRG; PAM sequence: CAG
ccacatactgcccattcctc

SEQ ID NO: 48276 - DNA, 20 bp, Artificial Sequence
  Description of Artificial Sequence: Synthetic oligonucleotide
  Target: ATXN1; (-) strand; PAM type: NRG; PAM sequence: GGG
gttggagactagtagaatag

SEQ ID NO: 48277 - DNA, 20 bp, Artificial Sequence
  Description of Artificial Sequence: Synthetic oligonucleotide
  Target: ATXN1; (-) strand; PAM type: NRG; PAM sequence: GGG
ggttggagactagtagaata

SEQ ID NO: 48278 - DNA, 20 bp, Artificial Sequence
  Description of Artificial Sequence: Synthetic oligonucleotide
  Target: ATXN1; (-) strand; PAM type: NRG; PAM sequence: AGG
gggttggagactagtagaat

SEQ ID NO: 48279 - DNA, 20 bp, Artificial Sequence
  Description of Artificial Sequence: Synthetic oligonucleotide
  Target: ATXN1; (-) strand; PAM type: NRG; PAM sequence: TAG
tgggttggagactagtagaa

SEQ ID NO: 48280 - DNA, 20 bp, Artificial Sequence
  Description of Artificial Sequence: Synthetic oligonucleotide
  Target: ATXN1; (-) strand; PAM type: NRG; PAM sequence: TAG
ctgtgtgggttggagactag

SEQ ID NO: 48281 - DNA, 20 bp, Artificial Sequence
  Description of Artificial Sequence: Synthetic oligonucleotide
  Target: ATXN1; (-) strand; PAM type: NRG; PAM sequence: TAG
tgtctgtgtgggttggagac

SEQ ID NO: 48282 - DNA, 20 bp, Artificial Sequence
  Description of Artificial Sequence: Synthetic oligonucleotide
  Target: ATXN1; (-) strand; PAM type: NRG; PAM sequence: GAG
ttctttgtctgtgtgggttg

SEQ ID NO: 48283 - DNA, 20 bp, Artificial Sequence
  Description of Artificial Sequence: Synthetic oligonucleotide
  Target: ATXN1; (-) strand; PAM type: NRG; PAM sequence: TGG
gtttctttgtctgtgtgggt

SEQ ID NO: 48284 - DNA, 20 bp, Artificial Sequence
  Description of Artificial Sequence: Synthetic oligonucleotide
  Target: ATXN1; (-) strand; PAM type: NRG; PAM sequence: GGG
tcgggtttctttgtctgtgt

SEQ ID NO: 48285 - DNA, 20 bp, Artificial Sequence
  Description of Artificial Sequence: Synthetic oligonucleotide
  Target: ATXN1; (-) strand; PAM type: NRG; PAM sequence: TGG
atcgggtttctttgtctgtg

SEQ ID NO: 48286 - DNA, 20 bp, Artificial Sequence
  Description of Artificial Sequence: Synthetic oligonucleotide
  Target: ATXN1; (-) strand; PAM type: NRG; PAM sequence: GGG
aagaacctctgttggatatc

SEQ ID NO: 48287 - DNA, 20 bp, Artificial Sequence
  Description of Artificial Sequence: Synthetic oligonucleotide
  Target: ATXN1; (-) strand; PAM type: NRG; PAM sequence: CGG
gaagaacctctgttggatat

SEQ ID NO: 48288 - DNA, 20 bp, Artificial Sequence
  Description of Artificial Sequence: Synthetic oligonucleotide
  Target: ATXN1; (-) strand; PAM type: NRG; PAM sequence: TGG
aaggagggaagaacctctgt

SEQ ID NO: 48289 - DNA, 20 bp, Artificial Sequence
  Description of Artificial Sequence: Synthetic oligonucleotide
  Target: ATXN1; (-) strand; PAM type: NRG; PAM sequence: AAG
ggtggaggtacgaaggaggg

SEQ ID NO: 48290 - DNA, 20 bp, Artificial Sequence
  Description of Artificial Sequence: Synthetic oligonucleotide
  Target: ATXN1; (-) strand; PAM type: NRG; PAM sequence: GGG
gtgggtggaggtacgaagga

SEQ ID NO: 48291 - DNA, 20 bp, Artificial Sequence
  Description of Artificial Sequence: Synthetic oligonucleotide
  Target: ATXN1; (-) strand; PAM type: NRG; PAM sequence: AGG
tgtgggtggaggtacgaagg

SEQ ID NO: 48292 - DNA, 20 bp, Artificial Sequence
  Description of Artificial Sequence: Synthetic oligonucleotide
  Target: ATXN1; (-) strand; PAM type: NRG; PAM sequence: GAG
atgtgggtggaggtacgaag

SEQ ID NO: 48293 - DNA, 20 bp, Artificial Sequence
  Description of Artificial Sequence: Synthetic oligonucleotide
  Target: ATXN1; (-) strand; PAM type: NRG; PAM sequence: AGG
ccatgtgggtggaggtacga

SEQ ID NO: 48294 - DNA, 20 bp, Artificial Sequence
  Description of Artificial Sequence: Synthetic oligonucleotide
  Target: ATXN1; (-) strand; PAM type: NRG; PAM sequence: AAG
tccatgtgggtggaggtacg

SEQ ID NO: 48295 - DNA, 20 bp, Artificial Sequence
  Description of Artificial Sequence: Synthetic oligonucleotide
  Target: ATXN1; (-) strand; PAM type: NRG; PAM sequence: AGG
ttattcatccatgtgggtgg

SEQ ID NO: 48296 - DNA, 20 bp, Artificial Sequence
  Description of Artificial Sequence: Synthetic oligonucleotide
  Target: ATXN1; (-) strand; PAM type: NRG; PAM sequence: GAG
tttattcatccatgtgggtg

SEQ ID NO: 48297 - DNA, 20 bp, Artificial Sequence
  Description of Artificial Sequence: Synthetic oligonucleotide
  Target: ATXN1; (-) strand; PAM type: NRG; PAM sequence: TGG
ggtttattcatccatgtggg

SEQ ID NO: 48298 - DNA, 20 bp, Artificial Sequence
  Description of Artificial Sequence: Synthetic oligonucleotide
  Target: ATXN1; (-) strand; PAM type: NRG; PAM sequence: GGG
tcaggtttattcatccatgt

SEQ ID NO: 48299 - DNA, 20 bp, Artificial Sequence
  Description of Artificial Sequence: Synthetic oligonucleotide
  Target: ATXN1; (-) strand; PAM type: NRG; PAM sequence: TGG
atcaggtttattcatccatg

SEQ ID NO: 48300 - DNA, 20 bp, Artificial Sequence
  Description of Artificial Sequence: Synthetic oligonucleotide
  Target: ATXN1; (-) strand; PAM type: NRG; PAM sequence: AGG
aagaacctctgttggagatc

SEQ ID NO: 48301 - DNA, 20 bp, Artificial Sequence
  Description of Artificial Sequence: Synthetic oligonucleotide
  Target: ATXN1; (-) strand; PAM type: NRG; PAM sequence: CAG
gaagaacctctgttggagat

SEQ ID NO: 48302 - DNA, 20 bp, Artificial Sequence
  Description of Artificial Sequence: Synthetic oligonucleotide
  Target: ATXN1; (-) strand; PAM type: NRG; PAM sequence: GAG
caaaggaagaacctctgttg

SEQ ID NO: 48303 - DNA, 20 bp, Artificial Sequence
  Description of Artificial Sequence: Synthetic oligonucleotide
  Target: ATXN1; (-) strand; PAM type: NRG; PAM sequence: TGG
cccaaaggaagaacctctgt

SEQ ID NO: 48304 - DNA, 20 bp, Artificial Sequence
  Description of Artificial Sequence: Synthetic oligonucleotide
  Target: ATXN1; (-) strand; PAM type: NRG; PAM sequence: AAG
cgtgagggaaggcccaaagg

SEQ ID NO: 48305 - DNA, 20 bp, Artificial Sequence
  Description of Artificial Sequence: Synthetic oligonucleotide
  Target: ATXN1; (-) strand; PAM type: NRG; PAM sequence: AGG
aaccgtgagggaaggcccaa

SEQ ID NO: 48306 - DNA, 20 bp, Artificial Sequence
  Description of Artificial Sequence: Synthetic oligonucleotide
  Target: ATXN1; (-) strand; PAM type: NRG; PAM sequence: AAG
taaccgtgagggaaggccca

SEQ ID NO: 48307 - DNA, 20 bp, Artificial Sequence
  Description of Artificial Sequence: Synthetic oligonucleotide
  Target: ATXN1; (-) strand; PAM type: NRG; PAM sequence: AGG
tgggccataaccgtgaggga

SEQ ID NO: 48308 - DNA, 20 bp, Artificial Sequence
  Description of Artificial Sequence: Synthetic oligonucleotide
  Target: ATXN1; (-) strand; PAM type: NRG; PAM sequence: AAG
ttgggccataaccgtgaggg

SEQ ID NO: 48309 - DNA, 20 bp, Artificial Sequence
  Description of Artificial Sequence: Synthetic oligonucleotide
  Target: ATXN1; (-) strand; PAM type: NRG; PAM sequence: GGG
tttttgggccataaccgtga

SEQ ID NO: 48310 - DNA, 20 bp, Artificial Sequence
  Description of Artificial Sequence: Synthetic oligonucleotide
  Target: ATXN1; (-) strand; PAM type: NRG; PAM sequence: AGG
ctttttgggccataaccgtg

SEQ ID NO: 48311 - DNA, 20 bp, Artificial Sequence
  Description of Artificial Sequence: Synthetic oligonucleotide
  Target: ATXN1; (-) strand; PAM type: NRG; PAM sequence: GAG
gctttttgggccataaccgt

SEQ ID NO: 48312 - DNA, 20 bp, Artificial Sequence
  Description of Artificial Sequence: Synthetic oligonucleotide
  Target: ATXN1; (-) strand; PAM type: NRG; PAM sequence: GGG
attgtcctttctagcttttt

SEQ ID NO: 48313 - DNA, 20 bp, Artificial Sequence
  Description of Artificial Sequence: Synthetic oligonucleotide
  Target: ATXN1; (-) strand; PAM type: NRG; PAM sequence: TGG
cattgtcctttctagctttt

SEQ ID NO: 48314 - DNA, 20 bp, Artificial Sequence
  Description of Artificial Sequence: Synthetic oligonucleotide
  Target: ATXN1; (-) strand; PAM type: NRG; PAM sequence: TAG
aggatgcccattgtcctttc

SEQ ID NO: 48315 - DNA, 20 bp, Artificial Sequence
  Description of Artificial Sequence: Synthetic oligonucleotide
  Target: ATXN1; (-) strand; PAM type: NRG; PAM sequence: AGG
agcgtatttctttatctgaa

SEQ ID NO: 48316 - DNA, 20 bp, Artificial Sequence
  Description of Artificial Sequence: Synthetic oligonucleotide
  Target: ATXN1; (-) strand; PAM type: NRG; PAM sequence: AAG
tagcgtatttctttatctga

SEQ ID NO: 48317 - DNA, 20 bp, Artificial Sequence
  Description of Artificial Sequence: Synthetic oligonucleotide
  Target: ATXN1; (-) strand; PAM type: NRG; PAM sequence: TAG
gattctgctgctcatttctg

SEQ ID NO: 48318 - DNA, 20 bp, Artificial Sequence
  Description of Artificial Sequence: Synthetic oligonucleotide
  Target: ATXN1; (-) strand; PAM type: NRG; PAM sequence: AGG
aaaaatttattgcagagttc

SEQ ID NO: 48319 - DNA, 20 bp, Artificial Sequence
  Description of Artificial Sequence: Synthetic oligonucleotide
  Target: ATXN1; (-) strand; PAM type: NRG; PAM sequence: CAG
taaaaatttattgcagagtt

SEQ ID NO: 48320 - DNA, 20 bp, Artificial Sequence
  Description of Artificial Sequence: Synthetic oligonucleotide
  Target: ATXN1; (-) strand; PAM type: NRG; PAM sequence: GAG
atgagtaaaaatttattgca

SEQ ID NO: 48321 - DNA, 20 bp, Artificial Sequence
  Description of Artificial Sequence: Synthetic oligonucleotide
  Target: ATXN1; (-) strand; PAM type: NRG; PAM sequence: CAG
gcatgagtaaaaatttattg

SEQ ID NO: 48322 - DNA, 20 bp, Artificial Sequence
  Description of Artificial Sequence: Synthetic oligonucleotide
  Target: ATXN1; (-) strand; PAM type: NRG; PAM sequence: GAG
tccatgggcatttaccgcat

SEQ ID NO: 48323 - DNA, 20 bp, Artificial Sequence
  Description of Artificial Sequence: Synthetic oligonucleotide
  Target: ATXN1; (-) strand; PAM type: NRG; PAM sequence: GGG
agaggttaacccctgtccat

SEQ ID NO: 48324 - DNA, 20 bp, Artificial Sequence
  Description of Artificial Sequence: Synthetic oligonucleotide
  Target: ATXN1; (-) strand; PAM type: NRG; PAM sequence: TGG
tagaggttaacccctgtcca

SEQ ID NO: 48325 - DNA, 20 bp, Artificial Sequence
  Description of Artificial Sequence: Synthetic oligonucleotide
  Target: ATXN1; (-) strand; PAM type: NRG; PAM sequence: AGG
tggctgcgtgcaaatgctag

SEQ ID NO: 48326 - DNA, 20 bp, Artificial Sequence
  Description of Artificial Sequence: Synthetic oligonucleotide
  Target: ATXN1; (-) strand; PAM type: NRG; PAM sequence: GAG
gtggctgcgtgcaaatgcta

SEQ ID NO: 48327 - DNA, 20 bp, Artificial Sequence
  Description of Artificial Sequence: Synthetic oligonucleotide
  Target: ATXN1; (-) strand; PAM type: NRG; PAM sequence: TAG
gggtggctgcgtgcaaatgc

SEQ ID NO: 48328 - DNA, 20 bp, Artificial Sequence
  Description of Artificial Sequence: Synthetic oligonucleotide
  Target: ATXN1; (-) strand; PAM type: NRG; PAM sequence: TGG
aggagccaagagcgaacggg

SEQ ID NO: 48329 - DNA, 20 bp, Artificial Sequence
  Description of Artificial Sequence: Synthetic oligonucleotide
  Target: ATXN1; (-) strand; PAM type: NRG; PAM sequence: GGG
accaggagccaagagcgaac

SEQ ID NO: 48330 - DNA, 20 bp, Artificial Sequence
  Description of Artificial Sequence: Synthetic oligonucleotide
  Target: ATXN1; (-) strand; PAM type: NRG; PAM sequence: CGG
taccaggagccaagagcgaa

SEQ ID NO: 48331 - DNA, 20 bp, Artificial Sequence
  Description of Artificial Sequence: Synthetic oligonucleotide
  Target: ATXN1; (-) strand; PAM type: NRG; PAM sequence: GAG
aagtgcttaccaggagccaa

SEQ ID NO: 48332 - DNA, 20 bp, Artificial Sequence
  Description of Artificial Sequence: Synthetic oligonucleotide
  Target: ATXN1; (-) strand; PAM type: NRG; PAM sequence: AAG
gtaagtgcttaccaggagcc

SEQ ID NO: 48333 - DNA, 20 bp, Artificial Sequence
  Description of Artificial Sequence: Synthetic oligonucleotide
  Target: ATXN1; (-) strand; PAM type: NRG; PAM sequence: GAG
tgcctgtaagtgcttaccag

SEQ ID NO: 48334 - DNA, 20 bp, Artificial Sequence
  Description of Artificial Sequence: Synthetic oligonucleotide
  Target: ATXN1; (-) strand; PAM type: NRG; PAM sequence: AGG
aatgcctgtaagtgcttacc

SEQ ID NO: 48335 - DNA, 20 bp, Artificial Sequence
  Description of Artificial Sequence: Synthetic oligonucleotide
  Target: ATXN1; (-) strand; PAM type: NRG; PAM sequence: CAG
aaatgcctgtaagtgcttac

SEQ ID NO: 48336 - DNA, 20 bp, Artificial Sequence
  Description of Artificial Sequence: Synthetic oligonucleotide
  Target: ATXN1; (-) strand; PAM type: NRG; PAM sequence: AAG
gcacatctttaaatgcctgt

SEQ ID NO: 48337 - DNA, 20 bp, Artificial Sequence
  Description of Artificial Sequence: Synthetic oligonucleotide
  Target: ATXN1; (-) strand; PAM type: NRG; PAM sequence: AAG
atgaggggcagagagcattg

SEQ ID NO: 48338 - DNA, 20 bp, Artificial Sequence
  Description of Artificial Sequence: Synthetic oligonucleotide
  Target: ATXN1; (-) strand; PAM type: NRG; PAM sequence: GAG
agatgcttatgaggggcaga

SEQ ID NO: 48339 - DNA, 20 bp, Artificial Sequence
  Description of Artificial Sequence: Synthetic oligonucleotide
  Target: ATXN1; (-) strand; PAM type: NRG; PAM sequence: GAG
agagatgcttatgaggggca

SEQ ID NO: 48340 - DNA, 20 bp, Artificial Sequence
  Description of Artificial Sequence: Synthetic oligonucleotide
  Target: ATXN1; (-) strand; PAM type: NRG; PAM sequence: CAG
tcagagatgcttatgagggg

SEQ ID NO: 48341 - DNA, 20 bp, Artificial Sequence
  Description of Artificial Sequence: Synthetic oligonucleotide
  Target: ATXN1; (-) strand; PAM type: NRG; PAM sequence: GGG
ttatcagagatgcttatgag

SEQ ID NO: 48342 - DNA, 20 bp, Artificial Sequence
  Description of Artificial Sequence: Synthetic oligonucleotide
  Target: ATXN1; (-) strand; PAM type: NRG; PAM sequence: GGG
attatcagagatgcttatga

SEQ ID NO: 48343 - DNA, 20 bp, Artificial Sequence
  Description of Artificial Sequence: Synthetic oligonucleotide
  Target: ATXN1; (-) strand; PAM type: NRG; PAM sequence: AGG
tattatcagagatgcttatg

SEQ ID NO: 48344 - DNA, 20 bp, Artificial Sequence
  Description of Artificial Sequence: Synthetic oligonucleotide
  Target: ATXN1; (-) strand; PAM type: NRG; PAM sequence: GAG
atattatcagagatgcttat

SEQ ID NO: 48345 - DNA, 20 bp, Artificial Sequence
  Description of Artificial Sequence: Synthetic oligonucleotide
  Target: ATXN1; (-) strand; PAM type: NRG; PAM sequence: GAG
gtagatgttggatattatca

SEQ ID NO: 48346 - DNA, 20 bp, Artificial Sequence
  Description of Artificial Sequence: Synthetic oligonucleotide
  Target: ATXN1; (-) strand; PAM type: NRG; PAM sequence: CAG
aagtagatgttggatattat

SEQ ID NO: 48347 - DNA, 20 bp, Artificial Sequence
  Description of Artificial Sequence: Synthetic oligonucleotide
  Target: ATXN1; (-) strand; PAM type: NRG; PAM sequence: TGG
gctagcatttaagtagatgt

SEQ ID NO: 48348 - DNA, 20 bp, Artificial Sequence
  Description of Artificial Sequence: Synthetic oligonucleotide
  Target: ATXN1; (-) strand; PAM type: NRG; PAM sequence: TAG
aaggtaagctagcatttaag

SEQ ID NO: 48349 - DNA, 20 bp, Artificial Sequence
  Description of Artificial Sequence: Synthetic oligonucleotide
  Target: ATXN1; (-) strand; PAM type: NRG; PAM sequence: AAG
tttaaggtaagctagcattt

SEQ ID NO: 48350 - DNA, 20 bp, Artificial Sequence
  Description of Artificial Sequence: Synthetic oligonucleotide
  Target: ATXN1; (-) strand; PAM type: NRG; PAM sequence: TAG
agtttatctttaaggtaagc

SEQ ID NO: 48351 - DNA, 20 bp, Artificial Sequence
  Description of Artificial Sequence: Synthetic oligonucleotide
  Target: ATXN1; (-) strand; PAM type: NRG; PAM sequence: AAG
ggagagtttatctttaaggt

SEQ ID NO: 48352 - DNA, 20 bp, Artificial Sequence
  Description of Artificial Sequence: Synthetic oligonucleotide
  Target: ATXN1; (-) strand; PAM type: NRG; PAM sequence: AGG
agaaggagagtttatcttta

SEQ ID NO: 48353 - DNA, 20 bp, Artificial Sequence
  Description of Artificial Sequence: Synthetic oligonucleotide
  Target: ATXN1; (-) strand; PAM type: NRG; PAM sequence: AAG
aagaaggagagtttatcttt

SEQ ID NO: 48354 - DNA, 20 bp, Artificial Sequence
  Description of Artificial Sequence: Synthetic oligonucleotide
  Target: ATXN1; (-) strand; PAM type: NRG; PAM sequence: GAG
tggaatgaaataaagaagga

SEQ ID NO: 48355 - DNA, 20 bp, Artificial Sequence
  Description of Artificial Sequence: Synthetic oligonucleotide
  Target: ATXN1; (-) strand; PAM type: NRG; PAM sequence: GAG
ggtggaatgaaataaagaag

SEQ ID NO: 48356 - DNA, 20 bp, Artificial Sequence
  Description of Artificial Sequence: Synthetic oligonucleotide
  Target: ATXN1; (-) strand; PAM type: NRG; PAM sequence: AGG
ctggtggaatgaaataaaga

SEQ ID NO: 48357 - DNA, 20 bp, Artificial Sequence
  Description of Artificial Sequence: Synthetic oligonucleotide
  Target: ATXN1; (-) strand; PAM type: NRG; PAM sequence: AAG
cctggtggaatgaaataaag

SEQ ID NO: 48358 - DNA, 20 bp, Artificial Sequence
  Description of Artificial Sequence: Synthetic oligonucleotide
  Target: ATXN1; (-) strand; PAM type: NRG; PAM sequence: AAG
agtcctggtggaatgaaata

SEQ ID NO: 48359 - DNA, 20 bp, Artificial Sequence
  Description of Artificial Sequence: Synthetic oligonucleotide
  Target: ATXN1; (-) strand; PAM type: NRG; PAM sequence: TGG
aagtcagggttcagtcctgg

SEQ ID NO: 48360 - DNA, 20 bp, Artificial Sequence
  Description of Artificial Sequence: Synthetic oligonucleotide
  Target: ATXN1; (-) strand; PAM type: NRG; PAM sequence: TGG
cccaagtcagggttcagtcc

SEQ ID NO: 48361 - DNA, 20 bp, Artificial Sequence
  Description of Artificial Sequence: Synthetic oligonucleotide
  Target: ATXN1; (-) strand; PAM type: NRG; PAM sequence: CAG
aatagtcccaagtcagggtt

SEQ ID NO: 48362 - DNA, 20 bp, Artificial Sequence
  Description of Artificial Sequence: Synthetic oligonucleotide
  Target: ATXN1; (-) strand; PAM type: NRG; PAM sequence: GGG
aggcaaatagtcccaagtca

SEQ ID NO: 48363 - DNA, 20 bp, Artificial Sequence
  Description of Artificial Sequence: Synthetic oligonucleotide
  Target: ATXN1; (-) strand; PAM type: NRG; PAM sequence: AGG
aaggcaaatagtcccaagtc

SEQ ID NO: 48364 - DNA, 20 bp, Artificial Sequence
  Description of Artificial Sequence: Synthetic oligonucleotide
  Target: ATXN1; (-) strand; PAM type: NRG; PAM sequence: CAG
caaggcaaatagtcccaagt

SEQ ID NO: 48365 - DNA, 20 bp, Artificial Sequence
  Description of Artificial Sequence: Synthetic oligonucleotide
  Target: ATXN1; (-) strand; PAM type: NRG; PAM sequence: AAG
ttttcaaggcaaatagtccc

SEQ ID NO: 48366 - DNA, 20 bp, Artificial Sequence
  Description of Artificial Sequence: Synthetic oligonucleotide
  Target: ATXN1; (-) strand; PAM type: NRG; PAM sequence: TAG
aactcatttttcaaggcaaa

SEQ ID NO: 48367 - DNA, 20 bp, Artificial Sequence
  Description of Artificial Sequence: Synthetic oligonucleotide
  Target: ATXN1; (-) strand; PAM type: NRG; PAM sequence: AGG
tggagaaaactcatttttca

SEQ ID NO: 48368 - DNA, 20 bp, Artificial Sequence
  Description of Artificial Sequence: Synthetic oligonucleotide
  Target: ATXN1; (-) strand; PAM type: NRG; PAM sequence: AAG
ctggagaaaactcatttttc

SEQ ID NO: 48369 - DNA, 20 bp, Artificial Sequence
  Description of Artificial Sequence: Synthetic oligonucleotide
  Target: ATXN1; (-) strand; PAM type: NRG; PAM sequence: GAG
agccatcctctgcagagctg

SEQ ID NO: 48370 - DNA, 20 bp, Artificial Sequence
  Description of Artificial Sequence: Synthetic oligonucleotide
  Target: ATXN1; (-) strand; PAM type: NRG; PAM sequence: TGG
gcagccatcctctgcagagc

SEQ ID NO: 48371 - DNA, 20 bp, Artificial Sequence
  Description of Artificial Sequence: Synthetic oligonucleotide
  Target: ATXN1; (-) strand; PAM type: NRG; PAM sequence: GAG
cacagcagccatcctctgca

SEQ ID NO: 48372 - DNA, 20 bp, Artificial Sequence
  Description of Artificial Sequence: Synthetic oligonucleotide
  Target: ATXN1; (-) strand; PAM type: NRG; PAM sequence: CAG
tacacagcagccatcctctg

SEQ ID NO: 48373 - DNA, 20 bp, Artificial Sequence
  Description of Artificial Sequence: Synthetic oligonucleotide
  Target: ATXN1; (-) strand; PAM type: NRG; PAM sequence: CAG
tcagagaccattatacacag

SEQ ID NO: 48374 - DNA, 20 bp, Artificial Sequence
  Description of Artificial Sequence: Synthetic oligonucleotide
  Target: ATXN1; (-) strand; PAM type: NRG; PAM sequence: CAG
atttcagagaccattataca

SEQ ID NO: 48375 - DNA, 20 bp, Artificial Sequence
  Description of Artificial Sequence: Synthetic oligonucleotide
  Target: ATXN1; (-) strand; PAM type: NRG; PAM sequence: GAG
tggcttccgttagcatttca

SEQ ID NO: 48376 - DNA, 20 bp, Artificial Sequence
  Description of Artificial Sequence: Synthetic oligonucleotide
  Target: ATXN1; (-) strand; PAM type: NRG; PAM sequence: CAG
cttggcttccgttagcattt

SEQ ID NO: 48377 - DNA, 20 bp, Artificial Sequence
  Description of Artificial Sequence: Synthetic oligonucleotide
  Target: ATXN1; (-) strand; PAM type: NRG; PAM sequence: TAG
ggtgatttcttggcttccgt

SEQ ID NO: 48378 - DNA, 20 bp, Artificial Sequence
  Description of Artificial Sequence: Synthetic oligonucleotide
  Target: ATXN1; (-) strand; PAM type: NRG; PAM sequence: TGG
gttcatgtcaggtgatttct

SEQ ID NO: 48379 - DNA, 20 bp, Artificial Sequence
  Description of Artificial Sequence: Synthetic oligonucleotide
  Target: ATXN1; (-) strand; PAM type: NRG; PAM sequence: AGG
atagcttcatagttcatgtc

SEQ ID NO: 48380 - DNA, 20 bp, Artificial Sequence
  Description of Artificial Sequence: Synthetic oligonucleotide
  Target: ATXN1; (-) strand; PAM type: NRG; PAM sequence: CAG
aatagcttcatagttcatgt

SEQ ID NO: 48381 - DNA, 20 bp, Artificial Sequence
  Description of Artificial Sequence: Synthetic oligonucleotide
  Target: ATXN1; (-) strand; PAM type: NRG; PAM sequence: TAG
tttcataactaatagcttca

SEQ ID NO: 48382 - DNA, 20 bp, Artificial Sequence
  Description of Artificial Sequence: Synthetic oligonucleotide
  Target: ATXN1; (-) strand; PAM type: NRG; PAM sequence: TAG
atattgcttttcataactaa

SEQ ID NO: 48383 - DNA, 20 bp, Artificial Sequence
  Description of Artificial Sequence: Synthetic oligonucleotide
  Target: ATXN1; (-) strand; PAM type: NRG; PAM sequence: AGG
ctccagcatgaagagttaga

SEQ ID NO: 48384 - DNA, 20 bp, Artificial Sequence
  Description of Artificial Sequence: Synthetic oligonucleotide
  Target: ATXN1; (-) strand; PAM type: NRG; PAM sequence: AAG
cctccagcatgaagagttag

SEQ ID NO: 48385 - DNA, 20 bp, Artificial Sequence
  Description of Artificial Sequence: Synthetic oligonucleotide
  Target: ATXN1; (-) strand; PAM type: NRG; PAM sequence: TAG
taccctccagcatgaagagt

SEQ ID NO: 48386 - DNA, 20 bp, Artificial Sequence
  Description of Artificial Sequence: Synthetic oligonucleotide
  Target: ATXN1; (-) strand; PAM type: NRG; PAM sequence: GAG
gctttaccctccagcatgaa

SEQ ID NO: 48387 - DNA, 20 bp, Artificial Sequence
  Description of Artificial Sequence: Synthetic oligonucleotide
  Target: ATXN1; (-) strand; PAM type: NRG; PAM sequence: AAG
ctgctttaccctccagcatg

SEQ ID NO: 48388 - DNA, 20 bp, Artificial Sequence
  Description of Artificial Sequence: Synthetic oligonucleotide
  Target: ATXN1; (-) strand; PAM type: NRG; PAM sequence: CAG
ggttgtgctgctttaccctc

SEQ ID NO: 48389 - DNA, 20 bp, Artificial Sequence
  Description of Artificial Sequence: Synthetic oligonucleotide
  Target: ATXN1; (-) strand; PAM type: NRG; PAM sequence: AGG
gctcggcaccaggcacgtcc

SEQ ID NO: 48390 - DNA, 20 bp, Artificial Sequence
  Description of Artificial Sequence: Synthetic oligonucleotide
  Target: ATXN1; (-) strand; PAM type: NRG; PAM sequence: CAG
ggctcggcaccaggcacgtc

SEQ ID NO: 48391 - DNA, 20 bp, Artificial Sequence
  Description of Artificial Sequence: Synthetic oligonucleotide
  Target: ATXN1; (-) strand; PAM type: NRG; PAM sequence: AGG
ctttatgttggctcggcacc

SEQ ID NO: 48392 - DNA, 20 bp, Artificial Sequence
  Description of Artificial Sequence: Synthetic oligonucleotide
  Target: ATXN1; (-) strand; PAM type: NRG; PAM sequence: CAG
tctttatgttggctcggcac

SEQ ID NO: 48393 - DNA, 20 bp, Artificial Sequence
  Description of Artificial Sequence: Synthetic oligonucleotide
  Target: ATXN1; (-) strand; PAM type: NRG; PAM sequence: CGG
atgttctctttatgttggct

SEQ ID NO: 48394 - DNA, 20 bp, Artificial Sequence
  Description of Artificial Sequence: Synthetic oligonucleotide
  Target: ATXN1; (-) strand; PAM type: NRG; PAM sequence: TGG
tgcagatgttctctttatgt

SEQ ID NO: 48395 - DNA, 20 bp, Artificial Sequence
  Description of Artificial Sequence: Synthetic oligonucleotide
  Target: ATXN1; (-) strand; PAM type: NRG; PAM sequence: CAG
atggtagaggagggaagatg

SEQ ID NO: 48396 - DNA, 20 bp, Artificial Sequence
  Description of Artificial Sequence: Synthetic oligonucleotide
  Target: ATXN1; (-) strand; PAM type: NRG; PAM sequence: AAG
tcaaaaatggtagaggaggg

SEQ ID NO: 48397 - DNA, 20 bp, Artificial Sequence
  Description of Artificial Sequence: Synthetic oligonucleotide
  Target: ATXN1; (-) strand; PAM type: NRG; PAM sequence: GGG
atttcaaaaatggtagagga

SEQ ID NO: 48398 - DNA, 20 bp, Artificial Sequence
  Description of Artificial Sequence: Synthetic oligonucleotide
  Target: ATXN1; (-) strand; PAM type: NRG; PAM sequence: AGG
catttcaaaaatggtagagg

SEQ ID NO: 48399 - DNA, 20 bp, Artificial Sequence
  Description of Artificial Sequence: Synthetic oligonucleotide
  Target: ATXN1; (-) strand; PAM type: NRG; PAM sequence: GAG
ccatttcaaaaatggtagag

SEQ ID NO: 48400 - DNA, 20 bp, Artificial Sequence
  Description of Artificial Sequence: Synthetic oligonucleotide
  Target: ATXN1; (-) strand; PAM type: NRG; PAM sequence: AGG
ttccatttcaaaaatggtag

SEQ ID NO: 48401 - DNA, 20 bp, Artificial Sequence
  Description of Artificial Sequence: Synthetic oligonucleotide
  Target: ATXN1; (-) strand; PAM type: NRG; PAM sequence: GAG
tttccatttcaaaaatggta

SEQ ID NO: 48402 - DNA, 20 bp, Artificial Sequence
  Description of Artificial Sequence: Synthetic oligonucleotide
  Target: ATXN1; (-) strand; PAM type: NRG; PAM sequence: TAG
tatttccatttcaaaaatgg

SEQ ID NO: 48403 - DNA, 20 bp, Artificial Sequence
  Description of Artificial Sequence: Synthetic oligonucleotide
  Target: ATXN1; (-) strand; PAM type: NRG; PAM sequence: TGG
cattatttccatttcaaaaa

SEQ ID NO: 48404 - DNA, 20 bp, Artificial Sequence
  Description of Artificial Sequence: Synthetic oligonucleotide
  Target: ATXN1; (-) strand; PAM type: NRG; PAM sequence: AAG
caccacattattaccaccat

SEQ ID NO: 48405 - DNA, 20 bp, Artificial Sequence
  Description of Artificial Sequence: Synthetic oligonucleotide
  Target: ATXN1; (-) strand; PAM type: NRG; PAM sequence: CAG
tgtgaaggggctttgaacga

SEQ ID NO: 48406 - DNA, 20 bp, Artificial Sequence
  Description of Artificial Sequence: Synthetic oligonucleotide
  Target: ATXN1; (-) strand; PAM type: NRG; PAM sequence: GGG
agatcataatgtgtgtgaag

SEQ ID NO: 48407 - DNA, 20 bp, Artificial Sequence
  Description of Artificial Sequence: Synthetic oligonucleotide
  Target: ATXN1; (-) strand; PAM type: NRG; PAM sequence: GGG
cagatcataatgtgtgtgaa

SEQ ID NO: 48408 - DNA, 20 bp, Artificial Sequence
  Description of Artificial Sequence: Synthetic oligonucleotide
  Target: ATXN1; (-) strand; PAM type: NRG; PAM sequence: AGG
tcagatcataatgtgtgtga

SEQ ID NO: 48409 - DNA, 20 bp, Artificial Sequence
  Description of Artificial Sequence: Synthetic oligonucleotide
  Target: ATXN1; (-) strand; PAM type: NRG; PAM sequence: AAG
atcagatcataatgtgtgtg

SEQ ID NO: 48410 - DNA, 20 bp, Artificial Sequence
  Description of Artificial Sequence: Synthetic oligonucleotide
  Target: ATXN1; (-) strand; PAM type: NRG; PAM sequence: CAG
gattcctgggaggagcagat

SEQ ID NO: 48411 - DNA, 20 bp, Artificial Sequence
  Description of Artificial Sequence: Synthetic oligonucleotide
  Target: ATXN1; (-) strand; PAM type: NRG; PAM sequence: CAG
tgcaggattcctgggaggag

SEQ ID NO: 48412 - DNA, 20 bp, Artificial Sequence
  Description of Artificial Sequence: Synthetic oligonucleotide
  Target: ATXN1; (-) strand; PAM type: NRG; PAM sequence: GAG
tcatgcaggattcctgggag

SEQ ID NO: 48413 - DNA, 20 bp, Artificial Sequence
  Description of Artificial Sequence: Synthetic oligonucleotide
  Target: ATXN1; (-) strand; PAM type: NRG; PAM sequence: AGG
cctcatgcaggattcctggg

SEQ ID NO: 48414 - DNA, 20 bp, Artificial Sequence
  Description of Artificial Sequence: Synthetic oligonucleotide
  Target: ATXN1; (-) strand; PAM type: NRG; PAM sequence: GAG
acctcatgcaggattcctgg

SEQ ID NO: 48415 - DNA, 20 bp, Artificial Sequence
  Description of Artificial Sequence: Synthetic oligonucleotide
  Target: ATXN1; (-) strand; PAM type: NRG; PAM sequence: GGG
ccacctcatgcaggattcct

SEQ ID NO: 48416 - DNA, 20 bp, Artificial Sequence
  Description of Artificial Sequence: Synthetic oligonucleotide
  Target: ATXN1; (-) strand; PAM type: NRG; PAM sequence: TGG
tccacctcatgcaggattcc

SEQ ID NO: 48417 - DNA, 20 bp, Artificial Sequence
  Description of Artificial Sequence: Synthetic oligonucleotide
  Target: ATXN1; (-) strand; PAM type: NRG; PAM sequence: AGG
tcatgatatccacctcatgc

SEQ ID NO: 48418 - DNA, 20 bp, Artificial Sequence
  Description of Artificial Sequence: Synthetic oligonucleotide
  Target: ATXN1; (-) strand; PAM type: NRG; PAM sequence: CAG
ttcatgatatccacctcatg

SEQ ID NO: 48419 - DNA, 20 bp, Artificial Sequence
  Description of Artificial Sequence: Synthetic oligonucleotide
  Target: ATXN1; (-) strand; PAM type: NRG; PAM sequence: TGG
tctacatcagttcctgcttc

SEQ ID NO: 48420 - DNA, 20 bp, Artificial Sequence
  Description of Artificial Sequence: Synthetic oligonucleotide
  Target: ATXN1; (-) strand; PAM type: NRG; PAM sequence: CAG
catcacttaactttctacat

SEQ ID NO: 48421 - DNA, 20 bp, Artificial Sequence
  Description of Artificial Sequence: Synthetic oligonucleotide
  Target: ATXN1; (-) strand; PAM type: NRG; PAM sequence: GAG
ggctctgtcggggtcgcctg

SEQ ID NO: 48422 - DNA, 20 bp, Artificial Sequence
  Description of Artificial Sequence: Synthetic oligonucleotide
  Target: ATXN1; (-) strand; PAM type: NRG; PAM sequence: TGG
caggctctgtcggggtcgcc

SEQ ID NO: 48423 - DNA, 20 bp, Artificial Sequence
  Description of Artificial Sequence: Synthetic oligonucleotide
  Target: ATXN1; (-) strand; PAM type: NRG; PAM sequence: GGG
agccctgccaggctctgtcg

SEQ ID NO: 48424 - DNA, 20 bp, Artificial Sequence
  Description of Artificial Sequence: Synthetic oligonucleotide
  Target: ATXN1; (-) strand; PAM type: NRG; PAM sequence: GGG
cagccctgccaggctctgtc

SEQ ID NO: 48425 - DNA, 20 bp, Artificial Sequence
  Description of Artificial Sequence: Synthetic oligonucleotide
  Target: ATXN1; (-) strand; PAM type: NRG; PAM sequence: CGG
gcagccctgccaggctctgt

SEQ ID NO: 48426 - DNA, 20 bp, Artificial Sequence
  Description of Artificial Sequence: Synthetic oligonucleotide
  Target: ATXN1; (-) strand; PAM type: NRG; PAM sequence: AGG
gtcaaagcagcagccctgcc

SEQ ID NO: 48427 - DNA, 20 bp, Artificial Sequence
  Description of Artificial Sequence: Synthetic oligonucleotide
  Target: ATXN1; (-) strand; PAM type: NRG; PAM sequence: CAG
ggtcaaagcagcagccctgc

SEQ ID NO: 48428 - DNA, 20 bp, Artificial Sequence
  Description of Artificial Sequence: Synthetic oligonucleotide
  Target: ATXN1; (-) strand; PAM type: NRG; PAM sequence: CAG
caactccagggtcaaagcag

SEQ ID NO: 48429 - DNA, 20 bp, Artificial Sequence
  Description of Artificial Sequence: Synthetic oligonucleotide
  Target: ATXN1; (-) strand; PAM type: NRG; PAM sequence: CAG
tctcaactccagggtcaaag

SEQ ID NO: 48430 - DNA, 20 bp, Artificial Sequence
  Description of Artificial Sequence: Synthetic oligonucleotide
  Target: ATXN1; (-) strand; PAM type: NRG; PAM sequence: AAG
tcctctcaactccagggtca

SEQ ID NO: 48431 - DNA, 20 bp, Artificial Sequence
  Description of Artificial Sequence: Synthetic oligonucleotide
  Target: ATXN1; (-) strand; PAM type: NRG; PAM sequence: GGG
aacaattcctctcaactcca

SEQ ID NO: 48432 - DNA, 20 bp, Artificial Sequence
  Description of Artificial Sequence: Synthetic oligonucleotide
  Target: ATXN1; (-) strand; PAM type: NRG; PAM sequence: AGG
gaacaattcctctcaactcc

SEQ ID NO: 48433 - DNA, 20 bp, Artificial Sequence
  Description of Artificial Sequence: Synthetic oligonucleotide
  Target: ATXN1; (-) strand; PAM type: NRG; PAM sequence: CAG
agaacaattcctctcaactc

SEQ ID NO: 48434 - DNA, 20 bp, Artificial Sequence
  Description of Artificial Sequence: Synthetic oligonucleotide
  Target: ATXN1; (-) strand; PAM type: NRG; PAM sequence: AAG
ccggcgggggttgatgtgga

SEQ ID NO: 48435 - DNA, 20 bp, Artificial Sequence
  Description of Artificial Sequence: Synthetic oligonucleotide
  Target: ATXN1; (-) strand; PAM type: NRG; PAM sequence: TGG
atgtccggcgggggttgatg

SEQ ID NO: 48436 - DNA, 20 bp, Artificial Sequence
  Description of Artificial Sequence: Synthetic oligonucleotide
  Target: ATXN1; (-) strand; PAM type: NRG; PAM sequence: GGG
ttttgaaatatgtccggcgg

SEQ ID NO: 48437 - DNA, 20 bp, Artificial Sequence
  Description of Artificial Sequence: Synthetic oligonucleotide
  Target: ATXN1; (-) strand; PAM type: NRG; PAM sequence: GGG
tttttgaaatatgtccggcg

SEQ ID NO: 48438 - DNA, 20 bp, Artificial Sequence
  Description of Artificial Sequence: Synthetic oligonucleotide
  Target: ATXN1; (-) strand; PAM type: NRG; PAM sequence: GGG
atttttgaaatatgtccggc

SEQ ID NO: 48439 - DNA, 20 bp, Artificial Sequence
  Description of Artificial Sequence: Synthetic oligonucleotide
  Target: ATXN1; (-) strand; PAM type: NRG; PAM sequence: CGG
catttttgaaatatgtccgg

SEQ ID NO: 48440 - DNA, 20 bp, Artificial Sequence
  Description of Artificial Sequence: Synthetic oligonucleotide
  Target: ATXN1; (-) strand; PAM type: NRG; PAM sequence: CGG
ttgcatttttgaaatatgtc

SEQ ID NO: 48441 - DNA, 20 bp, Artificial Sequence
  Description of Artificial Sequence: Synthetic oligonucleotide
  Target: ATXN1; (-) strand; PAM type: NRG; PAM sequence: CAG
agatagacccaaatgaaaaa

SEQ ID NO: 48442 - DNA, 20 bp, Artificial Sequence
  Description of Artificial Sequence: Synthetic oligonucleotide
  Target: ATXN1; (-) strand; PAM type: NRG; PAM sequence: TAG
tactattagcaaagaaaaga

SEQ ID NO: 48443 - DNA, 20 bp, Artificial Sequence
  Description of Artificial Sequence: Synthetic oligonucleotide
  Target: ATXN1; (-) strand; PAM type: NRG; PAM sequence: AAG
tgattactattagcaaagaa

SEQ ID NO: 48444 - DNA, 20 bp, Artificial Sequence
  Description of Artificial Sequence: Synthetic oligonucleotide
  Target: ATXN1; (-) strand; PAM type: NRG; PAM sequence: AAG
atctttgattactattagca

SEQ ID NO: 48445 - DNA, 20 bp, Artificial Sequence
  Description of Artificial Sequence: Synthetic oligonucleotide
  Target: ATXN1; (-) strand; PAM type: NRG; PAM sequence: TAG
tttagatctttgattactat

SEQ ID NO: 48446 - DNA, 20 bp, Artificial Sequence
  Description of Artificial Sequence: Synthetic oligonucleotide
  Target: ATXN1; (-) strand; PAM type: NRG; PAM sequence: TAG
tttgataaatctgtagcttt

SEQ ID NO: 48447 - DNA, 20 bp, Artificial Sequence
  Description of Artificial Sequence: Synthetic oligonucleotide
  Target: ATXN1; (-) strand; PAM type: NRG; PAM sequence: TAG
tcagttctttgataaatctg

SEQ ID NO: 48448 - DNA, 20 bp, Artificial Sequence
  Description of Artificial Sequence: Synthetic oligonucleotide
  Target: ATXN1; (-) strand; PAM type: NRG; PAM sequence: CAG
gcaaacaattttagtagctt

SEQ ID NO: 48449 - DNA, 20 bp, Artificial Sequence
  Description of Artificial Sequence: Synthetic oligonucleotide
  Target: ATXN1; (-) strand; PAM type: NRG; PAM sequence: TAG
gacactgcaaacaattttag

SEQ ID NO: 48450 - DNA, 20 bp, Artificial Sequence
  Description of Artificial Sequence: Synthetic oligonucleotide
  Target: ATXN1; (-) strand; PAM type: NRG; PAM sequence: TAG
cacgacactgcaaacaattt

SEQ ID NO: 48451 - DNA, 20 bp, Artificial Sequence
  Description of Artificial Sequence: Synthetic oligonucleotide
  Target: ATXN1; (-) strand; PAM type: NRG; PAM sequence: CAG
tttcttaaaatcgtgtttgc

SEQ ID NO: 48452 - DNA, 20 bp, Artificial Sequence
  Description of Artificial Sequence: Synthetic oligonucleotide
  Target: ATXN1; (-) strand; PAM type: NRG; PAM sequence: CAG
agtttttatttcttctgtca

SEQ ID NO: 48453 - DNA, 20 bp, Artificial Sequence
  Description of Artificial Sequence: Synthetic oligonucleotide
  Target: ATXN1; (-) strand; PAM type: NRG; PAM sequence: AAG
tttgaagataacctaaacac

SEQ ID NO: 48454 - DNA, 20 bp, Artificial Sequence
  Description of Artificial Sequence: Synthetic oligonucleotide
  Target: ATXN1; (-) strand; PAM type: NRG; PAM sequence: AAG
cattagaaatattagttttg

SEQ ID NO: 48455 - DNA, 20 bp, Artificial Sequence
  Description of Artificial Sequence: Synthetic oligonucleotide
  Target: ATXN1; (-) strand; PAM type: NRG; PAM sequence: TAG
gcattgtacattagaaatat

SEQ ID NO: 48456 - DNA, 20 bp, Artificial Sequence
  Description of Artificial Sequence: Synthetic oligonucleotide
  Target: ATXN1; (-) strand; PAM type: NRG; PAM sequence: TAG
cttagttgtgcattgtacat

SEQ ID NO: 48457 - DNA, 20 bp, Artificial Sequence
  Description of Artificial Sequence: Synthetic oligonucleotide
  Target: ATXN1; (-) strand; PAM type: NRG; PAM sequence: TAG
atatcagaaaaaagctatct

SEQ ID NO: 48458 - DNA, 20 bp, Artificial Sequence
  Description of Artificial Sequence: Synthetic oligonucleotide
  Target: ATXN1; (-) strand; PAM type: NRG; PAM sequence: AAG
tttatttttatatcagaaaa

SEQ ID NO: 48459 - DNA, 20 bp, Artificial Sequence
  Description of Artificial Sequence: Synthetic oligonucleotide
  Target: ATXN1; (-) strand; PAM type: NRG; PAM sequence: CAG
atcacactttatttttatat

SEQ ID NO: 48460 - DNA, 20 bp, Artificial Sequence
  Description of Artificial Sequence: Synthetic oligonucleotide
  Target: ATXN1; (-) strand; PAM type: NRG; PAM sequence: AAG
ggagcagttttatatttttt

SEQ ID NO: 48461 - DNA, 20 bp, Artificial Sequence
  Description of Artificial Sequence: Synthetic oligonucleotide
  Target: ATXN1; (-) strand; PAM type: NRG; PAM sequence: CAG
catgttggagatattaggag

SEQ ID NO: 48462 - DNA, 20 bp, Artificial Sequence
  Description of Artificial Sequence: Synthetic oligonucleotide
  Target: ATXN1; (-) strand; PAM type: NRG; PAM sequence: GAG
tatcatgttggagatattag

SEQ ID NO: 48463 - DNA, 20 bp, Artificial Sequence
  Description of Artificial Sequence: Synthetic oligonucleotide
  Target: ATXN1; (-) strand; PAM type: NRG; PAM sequence: AGG
tatatcatgttggagatatt

SEQ ID NO: 48464 - DNA, 20 bp, Artificial Sequence
  Description of Artificial Sequence: Synthetic oligonucleotide
  Target: ATXN1; (-) strand; PAM type: NRG; PAM sequence: TAG
atatatcatgttggagatat

SEQ ID NO: 48465 - DNA, 20 bp, Artificial Sequence
  Description of Artificial Sequence: Synthetic oligonucleotide
  Target: ATXN1; (-) strand; PAM type: NRG; PAM sequence: GAG
atagtggatatatcatgttg

SEQ ID NO: 48466 - DNA, 20 bp, Artificial Sequence
  Description of Artificial Sequence: Synthetic oligonucleotide
  Target: ATXN1; (-) strand; PAM type: NRG; PAM sequence: TGG
aaatagtggatatatcatgt

SEQ ID NO: 48467 - DNA, 20 bp, Artificial Sequence
  Description of Artificial Sequence: Synthetic oligonucleotide
  Target: ATXN1; (-) strand; PAM type: NRG; PAM sequence: TGG
tacaatcaaaatgtaaatag

SEQ ID NO: 48468 - DNA, 20 bp, Artificial Sequence
  Description of Artificial Sequence: Synthetic oligonucleotide
  Target: ATXN1; (-) strand; PAM type: NRG; PAM sequence: TAG
aaatacaatcaaaatgtaaa

SEQ ID NO: 48469 - DNA, 20 bp, Artificial Sequence
  Description of Artificial Sequence: Synthetic oligonucleotide
  Target: ATXN1; (-) strand; PAM type: NRG; PAM sequence: AAG
gatatatgtgagctttaaaa

SEQ ID NO: 48470 - DNA, 20 bp, Artificial Sequence
  Description of Artificial Sequence: Synthetic oligonucleotide
  Target: ATXN1; (-) strand; PAM type: NRG; PAM sequence: GAG
aaacatgcatagatatatgt

SEQ ID NO: 48471 - DNA, 20 bp, Artificial Sequence
  Description of Artificial Sequence: Synthetic oligonucleotide
  Target: ATXN1; (-) strand; PAM type: NRG; PAM sequence: TAG
tctaactttgtaaacatgca

SEQ ID NO: 48472 - DNA, 20 bp, Artificial Sequence
  Description of Artificial Sequence: Synthetic oligonucleotide
  Target: ATXN1; (-) strand; PAM type: NRG; PAM sequence: CAG
ctgattcaaaattatatatt

SEQ ID NO: 48473 - DNA, 20 bp, Artificial Sequence
  Description of Artificial Sequence: Synthetic oligonucleotide
  Target: ATXN1; (-) strand; PAM type: NRG; PAM sequence: AAG
tacaatacaatgttaagtga

SEQ ID NO: 48474 - DNA, 20 bp, Artificial Sequence
  Description of Artificial Sequence: Synthetic oligonucleotide
  Target: ATXN1; (-) strand; PAM type: NRG; PAM sequence: AAG
tctagttacaatacaatgtt

SEQ ID NO: 48475 - DNA, 20 bp, Artificial Sequence
  Description of Artificial Sequence: Synthetic oligonucleotide
  Target: ATXN1; (-) strand; PAM type: NRG; PAM sequence: TAG
aaaaaactagtttataattc

SEQ ID NO: 48476 - DNA, 20 bp, Artificial Sequence
  Description of Artificial Sequence: Synthetic oligonucleotide
  Target: ATXN1; (-) strand; PAM type: NRG; PAM sequence: TAG
tttaactagctttaaaaaac

SEQ ID NO: 48477 - DNA, 20 bp, Artificial Sequence
  Description of Artificial Sequence: Synthetic oligonucleotide
  Target: ATXN1; (-) strand; PAM type: NRG; PAM sequence: TAG
tacttcattcttcctttaac

SEQ ID NO: 48478 - DNA, 20 bp, Artificial Sequence
  Description of Artificial Sequence: Synthetic oligonucleotide
  Target: ATXN1; (-) strand; PAM type: NRG; PAM sequence: TGG
actgtagtttaaggtttttc

SEQ ID NO: 48479 - DNA, 20 bp, Artificial Sequence
  Description of Artificial Sequence: Synthetic oligonucleotide
  Target: ATXN1; (-) strand; PAM type: NRG; PAM sequence: AGG
tagttacaaactgtagttta

SEQ ID NO: 48480 - DNA, 20 bp, Artificial Sequence
  Description of Artificial Sequence: Synthetic oligonucleotide
  Target: ATXN1; (-) strand; PAM type: NRG; PAM sequence: AAG
ttagttacaaactgtagttt

SEQ ID NO: 48481 - DNA, 20 bp, Artificial Sequence
  Description of Artificial Sequence: Synthetic oligonucleotide
  Target: ATXN1; (-) strand; PAM type: NRG; PAM sequence: TAG
ttacagttagttacaaactg

SEQ ID NO: 48482 - DNA, 20 bp, Artificial Sequence
  Description of Artificial Sequence: Synthetic oligonucleotide
  Target: ATXN1; (-) strand; PAM type: NRG; PAM sequence: TAG
gtgcttttggattttacagt

SEQ ID NO: 48483 - DNA, 20 bp, Artificial Sequence
  Description of Artificial Sequence: Synthetic oligonucleotide
  Target: ATXN1; (-) strand; PAM type: NRG; PAM sequence: CAG
ccaagtgcttttggatttta

SEQ ID NO: 48484 - DNA, 20 bp, Artificial Sequence
  Description of Artificial Sequence: Synthetic oligonucleotide
  Target: ATXN1; (-) strand; PAM type: NRG; PAM sequence: TGG
taccatttgccaagtgcttt

SEQ ID NO: 48485 - DNA, 20 bp, Artificial Sequence
  Description of Artificial Sequence: Synthetic oligonucleotide
  Target: ATXN1; (-) strand; PAM type: NRG; PAM sequence: AAG
caaattccttaccatttgcc

SEQ ID NO: 48486 - DNA, 20 bp, Artificial Sequence
  Description of Artificial Sequence: Synthetic oligonucleotide
  Target: ATXN1; (-) strand; PAM type: NRG; PAM sequence: TAG
tttgctcactgattaatatt

SEQ ID NO: 48487 - DNA, 20 bp, Artificial Sequence
  Description of Artificial Sequence: Synthetic oligonucleotide
  Target: ATXN1; (-) strand; PAM type: NRG; PAM sequence: AAG
tagaataatttcagctcttt

SEQ ID NO: 48488 - DNA, 20 bp, Artificial Sequence
  Description of Artificial Sequence: Synthetic oligonucleotide
  Target: ATXN1; (-) strand; PAM type: NRG; PAM sequence: CAG
catggctcctagaataattt

SEQ ID NO: 48489 - DNA, 20 bp, Artificial Sequence
  Description of Artificial Sequence: Synthetic oligonucleotide
  Target: ATXN1; (-) strand; PAM type: NRG; PAM sequence: TAG
gacatcccaggcatggctcc

SEQ ID NO: 48490 - DNA, 20 bp, Artificial Sequence
  Description of Artificial Sequence: Synthetic oligonucleotide
  Target: ATXN1; (-) strand; PAM type: NRG; PAM sequence: TGG
ccaccacgacatcccaggca

SEQ ID NO: 48491 - DNA, 20 bp, Artificial Sequence
  Description of Artificial Sequence: Synthetic oligonucleotide
  Target: ATXN1; (-) strand; PAM type: NRG; PAM sequence: AGG
cttagccaccacgacatccc

SEQ ID NO: 48492 - DNA, 20 bp, Artificial Sequence
  Description of Artificial Sequence: Synthetic oligonucleotide
  Target: ATXN1; (-) strand; PAM type: NRG; PAM sequence: CAG
tcttagccaccacgacatcc

SEQ ID NO: 48493 - DNA, 20 bp, Artificial Sequence
  Description of Artificial Sequence: Synthetic oligonucleotide
  Target: ATXN1; (-) strand; PAM type: NRG; PAM sequence: TAG
caatagtagggactccatct

SEQ ID NO: 48494 - DNA, 20 bp, Artificial Sequence
  Description of Artificial Sequence: Synthetic oligonucleotide
  Target: ATXN1; (-) strand; PAM type: NRG; PAM sequence: GGG
actctatgctcccaatagta

SEQ ID NO: 48495 - DNA, 20 bp, Artificial Sequence
  Description of Artificial Sequence: Synthetic oligonucleotide
  Target: ATXN1; (-) strand; PAM type: NRG; PAM sequence: AGG
cactctatgctcccaatagt

SEQ ID NO: 48496 - DNA, 20 bp, Artificial Sequence
  Description of Artificial Sequence: Synthetic oligonucleotide
  Target: ATXN1; (-) strand; PAM type: NRG; PAM sequence: TAG
acactctatgctcccaatag

SEQ ID NO: 48497 - DNA, 20 bp, Artificial Sequence
  Description of Artificial Sequence: Synthetic oligonucleotide
  Target: ATXN1; (-) strand; PAM type: NRG; PAM sequence: TAG
ctgacactctatgctcccaa

SEQ ID NO: 48498 - DNA, 20 bp, Artificial Sequence
  Description of Artificial Sequence: Synthetic oligonucleotide
  Target: ATXN1; (-) strand; PAM type: NRG; PAM sequence: TGG
caaattgagcccatctctac

SEQ ID NO: 48499 - DNA, 20 bp, Artificial Sequence
  Description of Artificial Sequence: Synthetic oligonucleotide
  Target: ATXN1; (-) strand; PAM type: NRG; PAM sequence: GAG
agttggtgtgaaagcaaatt

SEQ ID NO: 48500 - DNA, 20 bp, Artificial Sequence
  Description of Artificial Sequence: Synthetic oligonucleotide
  Target: ATXN1; (-) strand; PAM type: NRG; PAM sequence: AAG
caccattctagttggtgtga

SEQ ID NO: 48501 - DNA, 20 bp, Artificial Sequence
  Description of Artificial Sequence: Synthetic oligonucleotide
  Target: ATXN1; (-) strand; PAM type: NRG; PAM sequence: TGG
ttctttcacaccattctagt

SEQ ID NO: 48502 - DNA, 20 bp, Artificial Sequence
  Description of Artificial Sequence: Synthetic oligonucleotide
  Target: ATXN1; (-) strand; PAM type: NRG; PAM sequence: TAG
accattctttcacaccattc

SEQ ID NO: 48503 - DNA, 20 bp, Artificial Sequence
  Description of Artificial Sequence: Synthetic oligonucleotide
  Target: ATXN1; (-) strand; PAM type: NRG; PAM sequence: TGG
taagtgctattcttagacga

SEQ ID NO: 48504 - DNA, 20 bp, Artificial Sequence
  Description of Artificial Sequence: Synthetic oligonucleotide
  Target: ATXN1; (-) strand; PAM type: NRG; PAM sequence: TAG
agtaaattaagtgctattct

SEQ ID NO: 48505 - DNA, 20 bp, Artificial Sequence
  Description of Artificial Sequence: Synthetic oligonucleotide
  Target: ATXN1; (-) strand; PAM type: NRG; PAM sequence: AAG
ttccttcttgtaagtaaatt

SEQ ID NO: 48506 - DNA, 20 bp, Artificial Sequence
  Description of Artificial Sequence: Synthetic oligonucleotide
  Target: ATXN1; (-) strand; PAM type: NRG; PAM sequence: AAG
ttaaaacagttccttcttgt

SEQ ID NO: 48507 - DNA, 20 bp, Artificial Sequence
  Description of Artificial Sequence: Synthetic oligonucleotide
  Target: ATXN1; (-) strand; PAM type: NRG; PAM sequence: CAG
tatttttaaaccaattaaaa

SEQ ID NO: 48508 - DNA, 20 bp, Artificial Sequence
  Description of Artificial Sequence: Synthetic oligonucleotide
  Target: ATXN1; (-) strand; PAM type: NRG; PAM sequence: GAG
acaaaatatttgtgtgtagt

SEQ ID NO: 48509 - DNA, 20 bp, Artificial Sequence
  Description of Artificial Sequence: Synthetic oligonucleotide
  Target: ATXN1; (-) strand; PAM type: NRG; PAM sequence: TAG
attaacaaaatatttgtgtg

SEQ ID NO: 48510 - DNA, 20 bp, Artificial Sequence
  Description of Artificial Sequence: Synthetic oligonucleotide
  Target: ATXN1; (-) strand; PAM type: NRG; PAM sequence: AGG
gttcacataagtgttcaaat

SEQ ID NO: 48511 - DNA, 20 bp, Artificial Sequence
  Description of Artificial Sequence: Synthetic oligonucleotide
  Target: ATXN1; (-) strand; PAM type: NRG; PAM sequence: TAG
agttcacataagtgttcaaa

SEQ ID NO: 48512 - DNA, 20 bp, Artificial Sequence
  Description of Artificial Sequence: Synthetic oligonucleotide
  Target: ATXN1; (-) strand; PAM type: NRG; PAM sequence: AAG
agctcctatttagttcacat

SEQ ID NO: 48513 - DNA, 20 bp, Artificial Sequence
  Description of Artificial Sequence: Synthetic oligonucleotide
  Target: ATXN1; (-) strand; PAM type: NRG; PAM sequence: TAG
ctcatgtattagctcctatt

SEQ ID NO: 48514 - DNA, 20 bp, Artificial Sequence
  Description of Artificial Sequence: Synthetic oligonucleotide
  Target: ATXN1; (-) strand; PAM type: NRG; PAM sequence: TAG
ataatttttatctcatgtat

SEQ ID NO: 48515 - DNA, 20 bp, Artificial Sequence
  Description of Artificial Sequence: Synthetic oligonucleotide
  Target: ATXN1; (-) strand; PAM type: NRG; PAM sequence: AAG
agtctgattcaattaatgaa

SEQ ID NO: 48516 - DNA, 20 bp, Artificial Sequence
  Description of Artificial Sequence: Synthetic oligonucleotide
  Target: ATXN1; (-) strand; PAM type: NRG; PAM sequence: CAG
tcacatgcttggagaaagtc

SEQ ID NO: 48517 - DNA, 20 bp, Artificial Sequence
  Description of Artificial Sequence: Synthetic oligonucleotide
  Target: ATXN1; (-) strand; PAM type: NRG; PAM sequence: AAG
ctcattcacatgcttggaga

SEQ ID NO: 48518 - DNA, 20 bp, Artificial Sequence
  Description of Artificial Sequence: Synthetic oligonucleotide
  Target: ATXN1; (-) strand; PAM type: NRG; PAM sequence: GAG
ctcactcattcacatgcttg

SEQ ID NO: 48519 - DNA, 20 bp, Artificial Sequence
  Description of Artificial Sequence: Synthetic oligonucleotide
  Target: ATXN1; (-) strand; PAM type: NRG; PAM sequence: TGG
tcctcactcattcacatgct

SEQ ID NO: 48520 - DNA, 20 bp, Artificial Sequence
  Description of Artificial Sequence: Synthetic oligonucleotide
  Target: ATXN1; (-) strand; PAM type: NRG; PAM sequence: TGG
aaagatcctaagtttttgca

SEQ ID NO: 48521 - DNA, 20 bp, Artificial Sequence
  Description of Artificial Sequence: Synthetic oligonucleotide
  Target: ATXN1; (-) strand; PAM type: NRG; PAM sequence: AAG
ataaaacctgtaaagatcct

SEQ ID NO: 48522 - DNA, 20 bp, Artificial Sequence
  Description of Artificial Sequence: Synthetic oligonucleotide
  Target: ATXN1; (-) strand; PAM type: NRG; PAM sequence: AAG
tacaaataataaaacctgta

SEQ ID NO: 48523 - DNA, 20 bp, Artificial Sequence
  Description of Artificial Sequence: Synthetic oligonucleotide
  Target: ATXN1; (-) strand; PAM type: NRG; PAM sequence: TAG
ctgaccagctgaaatggaac

SEQ ID NO: 48524 - DNA, 20 bp, Artificial Sequence
  Description of Artificial Sequence: Synthetic oligonucleotide
  Target: ATXN1; (-) strand; PAM type: NRG; PAM sequence: TGG
tcttatctgaccagctgaaa

SEQ ID NO: 48525 - DNA, 20 bp, Artificial Sequence
  Description of Artificial Sequence: Synthetic oligonucleotide
  Target: ATXN1; (-) strand; PAM type: NRG; PAM sequence: CAG
cacatttcttcttatctgac

SEQ ID NO: 48526 - DNA, 20 bp, Artificial Sequence
  Description of Artificial Sequence: Synthetic oligonucleotide
  Target: ATXN1; (-) strand; PAM type: NRG; PAM sequence: CAG
tggtttcttttttttaagag

SEQ ID NO: 48527 - DNA, 20 bp, Artificial Sequence
  Description of Artificial Sequence: Synthetic oligonucleotide
  Target: ATXN1; (-) strand; PAM type: NRG; PAM sequence: GAG
tattggtttcttttttttaa

SEQ ID NO: 48528 - DNA, 20 bp, Artificial Sequence
  Description of Artificial Sequence: Synthetic oligonucleotide
  Target: ATXN1; (-) strand; PAM type: NRG; PAM sequence: AAG
aatattggtttctttttttt

SEQ ID NO: 48529 - DNA, 20 bp, Artificial Sequence
  Description of Artificial Sequence: Synthetic oligonucleotide
  Target: ATXN1; (-) strand; PAM type: NRG; PAM sequence: TGG
tatcaattcaggtcaaatat

SEQ ID NO: 48530 - DNA, 20 bp, Artificial Sequence
  Description of Artificial Sequence: Synthetic oligonucleotide
  Target: ATXN1; (-) strand; PAM type: NRG; PAM sequence: AGG
gaaaacacttgtatcaattc

SEQ ID NO: 48531 - DNA, 20 bp, Artificial Sequence
  Description of Artificial Sequence: Synthetic oligonucleotide
  Target: ATXN1; (-) strand; PAM type: NRG; PAM sequence: CAG
agaaaacacttgtatcaatt

SEQ ID NO: 48532 - DNA, 20 bp, Artificial Sequence
  Description of Artificial Sequence: Synthetic oligonucleotide
  Target: ATXN1; (-) strand; PAM type: NRG; PAM sequence: AAG
ccctgtctcggctcaaaaaa

SEQ ID NO: 48533 - DNA, 20 bp, Artificial Sequence
  Description of Artificial Sequence: Synthetic oligonucleotide
  Target: ATXN1; (-) strand; PAM type: NRG; PAM sequence: CGG
aacagagcaagaccctgtct

SEQ ID NO: 48534 - DNA, 20 bp, Artificial Sequence
  Description of Artificial Sequence: Synthetic oligonucleotide
  Target: ATXN1; (-) strand; PAM type: NRG; PAM sequence: AAG
cactctagatgcaacagagc

SEQ ID NO: 48535 - DNA, 20 bp, Artificial Sequence
  Description of Artificial Sequence: Synthetic oligonucleotide
  Target: ATXN1; (-) strand; PAM type: NRG; PAM sequence: GAG
actgcactctagatgcaaca

SEQ ID NO: 48536 - DNA, 20 bp, Artificial Sequence
  Description of Artificial Sequence: Synthetic oligonucleotide
  Target: ATXN1; (-) strand; PAM type: NRG; PAM sequence: CAG
ccactgcactctagatgcaa

SEQ ID NO: 48537 - DNA, 20 bp, Artificial Sequence
  Description of Artificial Sequence: Synthetic oligonucleotide
  Target: ATXN1; (-) strand; PAM type: NRG; PAM sequence: TAG
atgattgcaccactgcactc

SEQ ID NO: 48538 - DNA, 20 bp, Artificial Sequence
  Description of Artificial Sequence: Synthetic oligonucleotide
  Target: ATXN1; (-) strand; PAM type: NRG; PAM sequence: GAG
cagcagtttgagactgcagt

SEQ ID NO: 48539 - DNA, 20 bp, Artificial Sequence
  Description of Artificial Sequence: Synthetic oligonucleotide
  Target: ATXN1; (-) strand; PAM type: NRG; PAM sequence: CAG
gagccagcagtttgagactg

SEQ ID NO: 48540 - DNA, 20 bp, Artificial Sequence
  Description of Artificial Sequence: Synthetic oligonucleotide
  Target: ATXN1; (-) strand; PAM type: NRG; PAM sequence: GAG
atcacttgagccagcagttt

SEQ ID NO: 48541 - DNA, 20 bp, Artificial Sequence
  Description of Artificial Sequence: Synthetic oligonucleotide
  Target: ATXN1; (-) strand; PAM type: NRG; PAM sequence: CAG
gggaggatcacttgagccag

SEQ ID NO: 48542 - DNA, 20 bp, Artificial Sequence
  Description of Artificial Sequence: Synthetic oligonucleotide
  Target: ATXN1; (-) strand; PAM type: NRG; PAM sequence: CAG
gatgggaggatcacttgagc

SEQ ID NO: 48543 - DNA, 20 bp, Artificial Sequence
  Description of Artificial Sequence: Synthetic oligonucleotide
  Target: ATXN1; (-) strand; PAM type: NRG; PAM sequence: GAG
ctgagatgggaggatcactt

SEQ ID NO: 48544 - DNA, 20 bp, Artificial Sequence
  Description of Artificial Sequence: Synthetic oligonucleotide
  Target: ATXN1; (-) strand; PAM type: NRG; PAM sequence: AGG
actcaggaagctgagatggg

SEQ ID NO: 48545 - DNA, 20 bp, Artificial Sequence
  Description of Artificial Sequence: Synthetic oligonucleotide
  Target: ATXN1; (-) strand; PAM type: NRG; PAM sequence: GAG
tactcaggaagctgagatgg

SEQ ID NO: 48546 - DNA, 20 bp, Artificial Sequence
  Description of Artificial Sequence: Synthetic oligonucleotide
  Target: ATXN1; (-) strand; PAM type: NRG; PAM sequence: GGG
gctactcaggaagctgagat

SEQ ID NO: 48547 - DNA, 20 bp, Artificial Sequence
  Description of Artificial Sequence: Synthetic oligonucleotide
  Target: ATXN1; (-) strand; PAM type: NRG; PAM sequence: TGG
agctactcaggaagctgaga

SEQ ID NO: 48548 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaagct

SEQ ID NO: 48549 - DNA, 20 bp, Artificial Sequence
  Description of Artificial Sequence: Synthetic oligonucleotide
  Target: ATXN1; (-) strand; PAM type: NRG; PAM sequence: AAG
tgtagtcccagctactcagg

SEQ ID NO: 48550 - DNA, 20 bp, Artificial Sequence
  Description of Artificial Sequence: Synthetic oligonucleotide
  Target: ATXN1; (-) strand; PAM type: NRG; PAM sequence: AGG
gcctgtagtcccagctactc

SEQ ID NO: 48551 - DNA, 20 bp, Artificial Sequence
  Description of Artificial Sequence: Synthetic oligonucleotide
  Target: ATXN1; (-) strand; PAM type: NRG; PAM sequence: CAG
tgcctgtagtcccagctact

SEQ ID NO: 48552 - DNA, 20 bp, Artificial Sequence
  Description of Artificial Sequence: Synthetic oligonucleotide
  Target: ATXN1; (-) strand; PAM type: NRG; PAM sequence: CAG
tagtggcatgcctgtagtcc

SEQ ID NO: 48553 - DNA, 20 bp, Artificial Sequence
  Description of Artificial Sequence: Synthetic oligonucleotide
  Target: ATXN1; (-) strand; PAM type: NRG; PAM sequence: TAG
caggcatagtggcatgcctg

SEQ ID NO: 48554 - DNA, 20 bp, Artificial Sequence
  Description of Artificial Sequence: Synthetic oligonucleotide
  Target: ATXN1; (-) strand; PAM type: NRG; PAM sequence: TGG
aaataaataaccaggcatag

SEQ ID NO: 48555 - DNA, 20 bp, Artificial Sequence
  Description of Artificial Sequence: Synthetic oligonucleotide
  Target: ATXN1; (-) strand; PAM type: NRG; PAM sequence: TAG
taaaaataaataaccaggca

SEQ ID NO: 48556 - DNA, 20 bp, Artificial Sequence
  Description of Artificial Sequence: Synthetic oligonucleotide
  Target: ATXN1; (-) strand; PAM type: NRG; PAM sequence: AGG
aaaaataaaaataaataacc

SEQ ID NO: 48557 - DNA, 20 bp, Artificial Sequence
  Description of Artificial Sequence: Synthetic oligonucleotide
  Target: ATXN1; (-) strand; PAM type: NRG; PAM sequence: CAG
taaaaataaaaataaataac

SEQ ID NO: 48558 - DNA, 20 bp, Artificial Sequence
  Description of Artificial Sequence: Synthetic oligonucleotide
  Target: ATXN1; (-) strand; PAM type: NRG; PAM sequence: AAG
accagcctaggtaccatagc

SEQ ID NO: 48559 - DNA, 20 bp, Artificial Sequence
  Description of Artificial Sequence: Synthetic oligonucleotide
  Target: ATXN1; (-) strand; PAM type: NRG; PAM sequence: TAG
tgagaccagcctaggtacca

SEQ ID NO: 48560 - DNA, 20 bp, Artificial Sequence
  Description of Artificial Sequence: Synthetic oligonucleotide
  Target: ATXN1; (-) strand; PAM type: NRG; PAM sequence: AGG
caggattttgagaccagcct

SEQ ID NO: 48561 - DNA, 20 bp, Artificial Sequence
  Description of Artificial Sequence: Synthetic oligonucleotide
  Target: ATXN1; (-) strand; PAM type: NRG; PAM sequence: TAG
ccaggattttgagaccagcc

SEQ ID NO: 48562 - DNA, 20 bp, Artificial Sequence
  Description of Artificial Sequence: Synthetic oligonucleotide
  Target: ATXN1; (-) strand; PAM type: NRG; PAM sequence: CAG
tgagcccaggattttgagac

SEQ ID NO: 48563 - DNA, 20 bp, Artificial Sequence
  Description of Artificial Sequence: Synthetic oligonucleotide
  Target: ATXN1; (-) strand; PAM type: NRG; PAM sequence: GAG
tcacttgagcccaggatttt

SEQ ID NO: 48564 - DNA, 20 bp, Artificial Sequence
  Description of Artificial Sequence: Synthetic oligonucleotide
  Target: ATXN1; (-) strand; PAM type: NRG; PAM sequence: AGG
caggaggatcacttgagccc

SEQ ID NO: 48565 - DNA, 20 bp, Artificial Sequence
  Description of Artificial Sequence: Synthetic oligonucleotide
  Target: ATXN1; (-) strand; PAM type: NRG; PAM sequence: CAG
gcaggaggatcacttgagcc

SEQ ID NO: 48566 - DNA, 20 bp, Artificial Sequence
  Description of Artificial Sequence: Synthetic oligonucleotide
  Target: ATXN1; (-) strand; PAM type: NRG; PAM sequence: GAG
ctaaggcaggaggatcactt

SEQ ID NO: 48567 - DNA, 20 bp, Artificial Sequence
  Description of Artificial Sequence: Synthetic oligonucleotide
  Target: ATXN1; (-) strand; PAM type: NRG; PAM sequence: AGG
ctttgggaggctaaggcagg

SEQ ID NO: 48568 - DNA, 20 bp, Artificial Sequence
  Description of Artificial Sequence: Synthetic oligonucleotide
  Target: ATXN1; (-) strand; PAM type: NRG; PAM sequence: GAG
actttgggaggctaaggcag

SEQ ID NO: 48569 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggctaaggc

SEQ ID NO: 48570 - DNA, 20 bp, Artificial Sequence
  Description of Artificial Sequence: Synthetic oligonucleotide
  Target: ATXN1; (-) strand; PAM type: NRG; PAM sequence: CAG
agcactttgggaggctaagg

SEQ ID NO: 48571 - DNA, 20 bp, Artificial Sequence
  Description of Artificial Sequence: Synthetic oligonucleotide
  Target: ATXN1; (-) strand; PAM type: NRG; PAM sequence: AGG
tccagcactttgggaggcta

SEQ ID NO: 48572 - DNA, 20 bp, Artificial Sequence
  Description of Artificial Sequence: Synthetic oligonucleotide
  Target: ATXN1; (-) strand; PAM type: NRG; PAM sequence: AAG
ttccagcactttgggaggct

SEQ ID NO: 48573 - DNA, 20 bp, Artificial Sequence
  Description of Artificial Sequence: Synthetic oligonucleotide
  Target: ATXN1; (-) strand; PAM type: NRG; PAM sequence: AGG
tgtaattccagcactttggg

SEQ ID NO: 48574 - DNA, 20 bp, Artificial Sequence
  Description of Artificial Sequence: Synthetic oligonucleotide
  Target: ATXN1; (-) strand; PAM type: NRG; PAM sequence: GAG
ctgtaattccagcactttgg

SEQ ID NO: 48575 - DNA, 20 bp, Artificial Sequence
  Description of Artificial Sequence: Synthetic oligonucleotide
  Target: ATXN1; (-) strand; PAM type: NRG; PAM sequence: GGG
gcctgtaattccagcacttt

SEQ ID NO: 48576 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaattccagcactt

SEQ ID NO: 48577 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctgtaattc

SEQ ID NO: 48578 - DNA, 20 bp, Artificial Sequence
  Description of Artificial Sequence: Synthetic oligonucleotide
  Target: ATXN1; (-) strand; PAM type: NRG; PAM sequence: TGG
cctgtatgggctgggcatgg

SEQ ID NO: 48579 - DNA, 20 bp, Artificial Sequence
  Description of Artificial Sequence: Synthetic oligonucleotide
  Target: ATXN1; (-) strand; PAM type: NRG; PAM sequence: TGG
acacctgtatgggctgggca

SEQ ID NO: 48580 - DNA, 20 bp, Artificial Sequence
  Description of Artificial Sequence: Synthetic oligonucleotide
  Target: ATXN1; (-) strand; PAM type: NRG; PAM sequence: GGG
ttaaaacacctgtatgggct

SEQ ID NO: 48581 - DNA, 20 bp, Artificial Sequence
  Description of Artificial Sequence: Synthetic oligonucleotide
  Target: ATXN1; (-) strand; PAM type: NRG; PAM sequence: TGG
attaaaacacctgtatgggc

SEQ ID NO: 48582 - DNA, 20 bp, Artificial Sequence
  Description of Artificial Sequence: Synthetic oligonucleotide
  Target: ATXN1; (-) strand; PAM type: NRG; PAM sequence: GGG
ccaaattaaaacacctgtat

SEQ ID NO: 48583 - DNA, 20 bp, Artificial Sequence
  Description of Artificial Sequence: Synthetic oligonucleotide
  Target: ATXN1; (-) strand; PAM type: NRG; PAM sequence: TGG
accaaattaaaacacctgta

SEQ ID NO: 48584 - DNA, 20 bp, Artificial Sequence
  Description of Artificial Sequence: Synthetic oligonucleotide
  Target: ATXN1; (-) strand; PAM type: NRG; PAM sequence: GGG
tgtgacctctgtagacattt

SEQ ID NO: 48585 - DNA, 20 bp, Artificial Sequence
  Description of Artificial Sequence: Synthetic oligonucleotide
  Target: ATXN1; (-) strand; PAM type: NRG; PAM sequence: TGG
ctgtgacctctgtagacatt

SEQ ID NO: 48586 - DNA, 20 bp, Artificial Sequence
  Description of Artificial Sequence: Synthetic oligonucleotide
  Target: ATXN1; (-) strand; PAM type: NRG; PAM sequence: TAG
gtaaagtcctgtgacctctg

SEQ ID NO: 48587 - DNA, 20 bp, Artificial Sequence
  Description of Artificial Sequence: Synthetic oligonucleotide
  Target: ATXN1; (-) strand; PAM type: NRG; PAM sequence: AAG
agaagtcaaagaaatatgta

SEQ ID NO: 48588 - DNA, 20 bp, Artificial Sequence
  Description of Artificial Sequence: Synthetic oligonucleotide
  Target: ATXN1; (-) strand; PAM type: NRG; PAM sequence: AAG
tccagtagagaaagaagtca

SEQ ID NO: 48589 - DNA, 20 bp, Artificial Sequence
  Description of Artificial Sequence: Synthetic oligonucleotide
  Target: ATXN1; (-) strand; PAM type: NRG; PAM sequence: AAG
acatgatccagtagagaaag

SEQ ID NO: 48590 - DNA, 20 bp, Artificial Sequence
  Description of Artificial Sequence: Synthetic oligonucleotide
  Target: ATXN1; (-) strand; PAM type: NRG; PAM sequence: AAG
aacacatgatccagtagaga

SEQ ID NO: 48591 - DNA, 20 bp, Artificial Sequence
  Description of Artificial Sequence: Synthetic oligonucleotide
  Target: ATXN1; (-) strand; PAM type: NRG; PAM sequence: GAG
caataacacatgatccagta

SEQ ID NO: 48592 - DNA, 20 bp, Artificial Sequence
  Description of Artificial Sequence: Synthetic oligonucleotide
  Target: ATXN1; (-) strand; PAM type: NRG; PAM sequence: TAG
tacaataacacatgatccag

SEQ ID NO: 48593 - DNA, 20 bp, Artificial Sequence
  Description of Artificial Sequence: Synthetic oligonucleotide
  Target: ATXN1; (-) strand; PAM type: NRG; PAM sequence: CAG
ttttacaataacacatgatc

SEQ ID NO: 48594 - DNA, 20 bp, Artificial Sequence
  Description of Artificial Sequence: Synthetic oligonucleotide
  Target: ATXN1; (-) strand; PAM type: NRG; PAM sequence: AAG
cctgggtttaatcacacata

SEQ ID NO: 48595 - DNA, 20 bp, Artificial Sequence
  Description of Artificial Sequence: Synthetic oligonucleotide
  Target: ATXN1; (-) strand; PAM type: NRG; PAM sequence: GGG
tattgactctggcttgccct

SEQ ID NO: 48596 - DNA, 20 bp, Artificial Sequence
  Description of Artificial Sequence: Synthetic oligonucleotide
  Target: ATXN1; (-) strand; PAM type: NRG; PAM sequence: TGG
ttattgactctggcttgccc

SEQ ID NO: 48597 - DNA, 20 bp, Artificial Sequence
  Description of Artificial Sequence: Synthetic oligonucleotide
  Target: ATXN1; (-) strand; PAM type: NRG; PAM sequence: TGG
tgtaactgatttattgactc

SEQ ID NO: 48598 - DNA, 20 bp, Artificial Sequence
  Description of Artificial Sequence: Synthetic oligonucleotide
  Target: ATXN1; (-) strand; PAM type: NRG; PAM sequence: AAG
taatttgttgattttctaaa

SEQ ID NO: 48599 - DNA, 20 bp, Artificial Sequence
  Description of Artificial Sequence: Synthetic oligonucleotide
  Target: ATXN1; (-) strand; PAM type: NRG; PAM sequence: AAG
aaaaatagattggatttgca

SEQ ID NO: 48600 - DNA, 20 bp, Artificial Sequence
  Description of Artificial Sequence: Synthetic oligonucleotide
  Target: ATXN1; (-) strand; PAM type: NRG; PAM sequence: TGG
tttataaaagaaaaatagat

SEQ ID NO: 48601 - DNA, 20 bp, Artificial Sequence
  Description of Artificial Sequence: Synthetic oligonucleotide
  Target: ATXN1; (-) strand; PAM type: NRG; PAM sequence: TAG
cctgttttataaaagaaaaa

SEQ ID NO: 48602 - DNA, 20 bp, Artificial Sequence
  Description of Artificial Sequence: Synthetic oligonucleotide
  Target: ATXN1; (-) strand; PAM type: NRG; PAM sequence: AAG
tattccttcctgttttataa

SEQ ID NO: 48603 - DNA, 20 bp, Artificial Sequence
  Description of Artificial Sequence: Synthetic oligonucleotide
  Target: ATXN1; (-) strand; PAM type: NRG; PAM sequence: GAG
tctccttcttggcatttact

SEQ ID NO: 48604 - DNA, 20 bp, Artificial Sequence
  Description of Artificial Sequence: Synthetic oligonucleotide
  Target: ATXN1; (-) strand; PAM type: NRG; PAM sequence: TGG
ccaaggcacaatctccttct

SEQ ID NO: 48605 - DNA, 20 bp, Artificial Sequence
  Description of Artificial Sequence: Synthetic oligonucleotide
  Target: ATXN1; (-) strand; PAM type: NRG; PAM sequence: AGG
ccatgccaacctttcctcca

SEQ ID NO: 48606 - DNA, 20 bp, Artificial Sequence
  Description of Artificial Sequence: Synthetic oligonucleotide
  Target: ATXN1; (-) strand; PAM type: NRG; PAM sequence: AAG
tccatgccaacctttcctcc

SEQ ID NO: 48607 - DNA, 20 bp, Artificial Sequence
  Description of Artificial Sequence: Synthetic oligonucleotide
  Target: ATXN1; (-) strand; PAM type: NRG; PAM sequence: TGG
ccaagggcacagaaggatac

SEQ ID NO: 48608 - DNA, 20 bp, Artificial Sequence
  Description of Artificial Sequence: Synthetic oligonucleotide
  Target: ATXN1; (-) strand; PAM type: NRG; PAM sequence: AGG
ggtgagaccaagggcacaga

SEQ ID NO: 48609 - DNA, 20 bp, Artificial Sequence
  Description of Artificial Sequence: Synthetic oligonucleotide
  Target: ATXN1; (-) strand; PAM type: NRG; PAM sequence: AAG
tggtgagaccaagggcacag

SEQ ID NO: 48610 - DNA, 20 bp, Artificial Sequence
  Description of Artificial Sequence: Synthetic oligonucleotide
  Target: ATXN1; (-) strand; PAM type: NRG; PAM sequence: CAG
gtctggtgagaccaagggca

SEQ ID NO: 48611 - DNA, 20 bp, Artificial Sequence
  Description of Artificial Sequence: Synthetic oligonucleotide
  Target: ATXN1; (-) strand; PAM type: NRG; PAM sequence: GGG
cctgggtctggtgagaccaa

SEQ ID NO: 48612 - DNA, 20 bp, Artificial Sequence
  Description of Artificial Sequence: Synthetic oligonucleotide
  Target: ATXN1; (-) strand; PAM type: NRG; PAM sequence: AGG
ccctgggtctggtgagacca

SEQ ID NO: 48613 - DNA, 20 bp, Artificial Sequence
  Description of Artificial Sequence: Synthetic oligonucleotide
  Target: ATXN1; (-) strand; PAM type: NRG; PAM sequence: AAG
gccctgggtctggtgagacc

SEQ ID NO: 48614 - DNA, 20 bp, Artificial Sequence
  Description of Artificial Sequence: Synthetic oligonucleotide
  Target: ATXN1; (-) strand; PAM type: NRG; PAM sequence: GAG
ggtctggccctgggtctggt

SEQ ID NO: 48615 - DNA, 20 bp, Artificial Sequence
  Description of Artificial Sequence: Synthetic oligonucleotide
  Target: ATXN1; (-) strand; PAM type: NRG; PAM sequence: TGG
tattggtctggccctgggtc

SEQ ID NO: 48616 - DNA, 20 bp, Artificial Sequence
  Description of Artificial Sequence: Synthetic oligonucleotide
  Target: ATXN1; (-) strand; PAM type: NRG; PAM sequence: GGG
tttcttattggtctggccct

SEQ ID NO: 48617 - DNA, 20 bp, Artificial Sequence
  Description of Artificial Sequence: Synthetic oligonucleotide
  Target: ATXN1; (-) strand; PAM type: NRG; PAM sequence: TGG
ctttcttattggtctggccc

SEQ ID NO: 48618 - DNA, 20 bp, Artificial Sequence
  Description of Artificial Sequence: Synthetic oligonucleotide
  Target: ATXN1; (-) strand; PAM type: NRG; PAM sequence: TGG
tcccttctttcttattggtc

SEQ ID NO: 48619 - DNA, 20 bp, Artificial Sequence
  Description of Artificial Sequence: Synthetic oligonucleotide
  Target: ATXN1; (-) strand; PAM type: NRG; PAM sequence: TGG
ccttttcccttctttcttat

SEQ ID NO: 48620 - DNA, 20 bp, Artificial Sequence
  Description of Artificial Sequence: Synthetic oligonucleotide
  Target: ATXN1; (-) strand; PAM type: NRG; PAM sequence: TGG
cttgtttctgtccatatctc

SEQ ID NO: 48621 - DNA, 20 bp, Artificial Sequence
  Description of Artificial Sequence: Synthetic oligonucleotide
  Target: ATXN1; (-) strand; PAM type: NRG; PAM sequence: CAG
ctcggtttgcagtttctcca

SEQ ID NO: 48622 - DNA, 20 bp, Artificial Sequence
  Description of Artificial Sequence: Synthetic oligonucleotide
  Target: ATXN1; (-) strand; PAM type: NRG; PAM sequence: CAG
gagggctttcactcggtttg

SEQ ID NO: 48623 - DNA, 20 bp, Artificial Sequence
  Description of Artificial Sequence: Synthetic oligonucleotide
  Target: ATXN1; (-) strand; PAM type: NRG; PAM sequence: CGG
agtgttagagggctttcact

SEQ ID NO: 48624 - DNA, 20 bp, Artificial Sequence
  Description of Artificial Sequence: Synthetic oligonucleotide
  Target: ATXN1; (-) strand; PAM type: NRG; PAM sequence: GGG
tattgcatttcagtgttaga

SEQ ID NO: 48625 - DNA, 20 bp, Artificial Sequence
  Description of Artificial Sequence: Synthetic oligonucleotide
  Target: ATXN1; (-) strand; PAM type: NRG; PAM sequence: AGG
ttattgcatttcagtgttag

SEQ ID NO: 48626 - DNA, 20 bp, Artificial Sequence
  Description of Artificial Sequence: Synthetic oligonucleotide
  Target: ATXN1; (-) strand; PAM type: NRG; PAM sequence: GAG
cttattgcatttcagtgtta

SEQ ID NO: 48627 - DNA, 20 bp, Artificial Sequence
  Description of Artificial Sequence: Synthetic oligonucleotide
  Target: ATXN1; (-) strand; PAM type: NRG; PAM sequence: TAG
gtcttattgcatttcagtgt

SEQ ID NO: 48628 - DNA, 20 bp, Artificial Sequence
  Description of Artificial Sequence: Synthetic oligonucleotide
  Target: ATXN1; (-) strand; PAM type: NRG; PAM sequence: CAG
aatgcagtcttattgcattt

SEQ ID NO: 48629 - DNA, 20 bp, Artificial Sequence
  Description of Artificial Sequence: Synthetic oligonucleotide
  Target: ATXN1; (-) strand; PAM type: NRG; PAM sequence: CAG
gagcatgggatggagtaatg

SEQ ID NO: 48630 - DNA, 20 bp, Artificial Sequence
  Description of Artificial Sequence: Synthetic oligonucleotide
  Target: ATXN1; (-) strand; PAM type: NRG; PAM sequence: GAG
ttggggctgagcatgggatg

SEQ ID NO: 48631 - DNA, 20 bp, Artificial Sequence
  Description of Artificial Sequence: Synthetic oligonucleotide
  Target: ATXN1; (-) strand; PAM type: NRG; PAM sequence: TGG
ggttggggctgagcatggga

SEQ ID NO: 48632 - DNA, 20 bp, Artificial Sequence
  Description of Artificial Sequence: Synthetic oligonucleotide
  Target: ATXN1; (-) strand; PAM type: NRG; PAM sequence: GGG
gcatggttggggctgagcat

SEQ ID NO: 48633 - DNA, 20 bp, Artificial Sequence
  Description of Artificial Sequence: Synthetic oligonucleotide
  Target: ATXN1; (-) strand; PAM type: NRG; PAM sequence: TGG
ggcatggttggggctgagca

SEQ ID NO: 48634 - DNA, 20 bp, Artificial Sequence
  Description of Artificial Sequence: Synthetic oligonucleotide
  Target: ATXN1; (-) strand; PAM type: NRG; PAM sequence: GAG
aaatgggcatggttggggct

SEQ ID NO: 48635 - DNA, 20 bp, Artificial Sequence
  Description of Artificial Sequence: Synthetic oligonucleotide
  Target: ATXN1; (-) strand; PAM type: NRG; PAM sequence: GGG
tatccaaatgggcatggttg

SEQ ID NO: 48636 - DNA, 20 bp, Artificial Sequence
  Description of Artificial Sequence: Synthetic oligonucleotide
  Target: ATXN1; (-) strand; PAM type: NRG; PAM sequence: GGG
ttatccaaatgggcatggtt

SEQ ID NO: 48637 - DNA, 20 bp, Artificial Sequence
  Description of Artificial Sequence: Synthetic oligonucleotide
  Target: ATXN1; (-) strand; PAM type: NRG; PAM sequence: TGG
tttatccaaatgggcatggt

SEQ ID NO: 48638 - DNA, 20 bp, Artificial Sequence
  Description of Artificial Sequence: Synthetic oligonucleotide
  Target: ATXN1; (-) strand; PAM type: NRG; PAM sequence: TGG
ccattttatccaaatgggca

SEQ ID NO: 48639 - DNA, 20 bp, Artificial Sequence
  Description of Artificial Sequence: Synthetic oligonucleotide
  Target: ATXN1; (-) strand; PAM type: NRG; PAM sequence: GGG
ggaatccattttatccaaat

SEQ ID NO: 48640 - DNA, 20 bp, Artificial Sequence
  Description of Artificial Sequence: Synthetic oligonucleotide
  Target: ATXN1; (-) strand; PAM type: NRG; PAM sequence: TGG
tggaatccattttatccaaa

SEQ ID NO: 48641 - DNA, 20 bp, Artificial Sequence
  Description of Artificial Sequence: Synthetic oligonucleotide
  Target: ATXN1; (-) strand; PAM type: NRG; PAM sequence: TGG
tattgccaaccattaccaaa

SEQ ID NO: 48642 - DNA, 20 bp, Artificial Sequence
  Description of Artificial Sequence: Synthetic oligonucleotide
  Target: ATXN1; (-) strand; PAM type: NRG; PAM sequence: CAG
ccttggcatttcagaaatga

SEQ ID NO: 48643 - DNA, 20 bp, Artificial Sequence
  Description of Artificial Sequence: Synthetic oligonucleotide
  Target: ATXN1; (-) strand; PAM type: NRG; PAM sequence: CAG
tatgtgggcccttggcattt

SEQ ID NO: 48644 - DNA, 20 bp, Artificial Sequence
  Description of Artificial Sequence: Synthetic oligonucleotide
  Target: ATXN1; (-) strand; PAM type: NRG; PAM sequence: TGG
tggttgtatatgtgggccct

SEQ ID NO: 48645 - DNA, 20 bp, Artificial Sequence
  Description of Artificial Sequence: Synthetic oligonucleotide
  Target: ATXN1; (-) strand; PAM type: NRG; PAM sequence: GGG
tgtcaactggttgtatatgt

SEQ ID NO: 48646 - DNA, 20 bp, Artificial Sequence
  Description of Artificial Sequence: Synthetic oligonucleotide
  Target: ATXN1; (-) strand; PAM type: NRG; PAM sequence: TGG
gtgtcaactggttgtatatg

SEQ ID NO: 48647 - DNA, 20 bp, Artificial Sequence
  Description of Artificial Sequence: Synthetic oligonucleotide
  Target: ATXN1; (-) strand; PAM type: NRG; PAM sequence: TGG
actactataaaggtgtcaac

SEQ ID NO: 48648 - DNA, 20 bp, Artificial Sequence
  Description of Artificial Sequence: Synthetic oligonucleotide
  Target: ATXN1; (-) strand; PAM type: NRG; PAM sequence: AGG
agctataaatactactataa

SEQ ID NO: 48649 - DNA, 20 bp, Artificial Sequence
  Description of Artificial Sequence: Synthetic oligonucleotide
  Target: ATXN1; (-) strand; PAM type: NRG; PAM sequence: AAG
gagctataaatactactata

SEQ ID NO: 48650 - DNA, 20 bp, Artificial Sequence
  Description of Artificial Sequence: Synthetic oligonucleotide
  Target: ATXN1; (-) strand; PAM type: NRG; PAM sequence: GAG
agtcatgttttaaagtgtct

SEQ ID NO: 48651 - DNA, 20 bp, Artificial Sequence
  Description of Artificial Sequence: Synthetic oligonucleotide
  Target: ATXN1; (-) strand; PAM type: NRG; PAM sequence: AAG
cagcccacagtcatgtttta

SEQ ID NO: 48652 - DNA, 20 bp, Artificial Sequence
  Description of Artificial Sequence: Synthetic oligonucleotide
  Target: ATXN1; (-) strand; PAM type: NRG; PAM sequence: CAG
gagccactgtgcccagccca

SEQ ID NO: 48653 - DNA, 20 bp, Artificial Sequence
  Description of Artificial Sequence: Synthetic oligonucleotide
  Target: ATXN1; (-) strand; PAM type: NRG; PAM sequence: CAG
cagacatgagccactgtgcc

SEQ ID NO: 48654 - DNA, 20 bp, Artificial Sequence
  Description of Artificial Sequence: Synthetic oligonucleotide
  Target: ATXN1; (-) strand; PAM type: NRG; PAM sequence: GAG
agagcttggattacagacat

SEQ ID NO: 48655 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagagcttggatta

SEQ ID NO: 48656 - DNA, 20 bp, Artificial Sequence
  Description of Artificial Sequence: Synthetic oligonucleotide
  Target: ATXN1; (-) strand; PAM type: NRG; PAM sequence: TGG
cctcagactcccaaagagct

SEQ ID NO: 48657 - DNA, 20 bp, Artificial Sequence
  Description of Artificial Sequence: Synthetic oligonucleotide
  Target: ATXN1; (-) strand; PAM type: NRG; PAM sequence: GAG
ttctgcctcagactcccaaa

SEQ ID NO: 48658 - DNA, 20 bp, Artificial Sequence
  Description of Artificial Sequence: Synthetic oligonucleotide
  Target: ATXN1; (-) strand; PAM type: NRG; PAM sequence: AAG
ccttctgcctcagactccca

SEQ ID NO: 48659 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatccttctgcct

SEQ ID NO: 48660 - DNA, 20 bp, Artificial Sequence
  Description of Artificial Sequence: Synthetic oligonucleotide
  Target: ATXN1; (-) strand; PAM type: NRG; PAM sequence: AAG
ggtctcaaactcctgggctc

SEQ ID NO: 48661 - DNA, 20 bp, Artificial Sequence
  Description of Artificial Sequence: Synthetic oligonucleotide
  Target: ATXN1; (-) strand; PAM type: NRG; PAM sequence: GGG
caggctggtctcaaactcct

SEQ ID NO: 48662 - DNA, 20 bp, Artificial Sequence
  Description of Artificial Sequence: Synthetic oligonucleotide
  Target: ATXN1; (-) strand; PAM type: NRG; PAM sequence: TGG
ccaggctggtctcaaactcc

SEQ ID NO: 48663 - DNA, 20 bp, Artificial Sequence
  Description of Artificial Sequence: Synthetic oligonucleotide
  Target: ATXN1; (-) strand; PAM type: NRG; PAM sequence: TGG
tctcactgggttgcccaggc

SEQ ID NO: 48664 - DNA, 20 bp, Artificial Sequence
  Description of Artificial Sequence: Synthetic oligonucleotide
  Target: ATXN1; (-) strand; PAM type: NRG; PAM sequence: AGG
gagttctcactgggttgccc

SEQ ID NO: 48665 - DNA, 20 bp, Artificial Sequence
  Description of Artificial Sequence: Synthetic oligonucleotide
  Target: ATXN1; (-) strand; PAM type: NRG; PAM sequence: CAG
tgagttctcactgggttgcc

SEQ ID NO: 48666 - DNA, 20 bp, Artificial Sequence
  Description of Artificial Sequence: Synthetic oligonucleotide
  Target: ATXN1; (-) strand; PAM type: NRG; PAM sequence: GGG
tgtagagatgagttctcact

SEQ ID NO: 48667 - DNA, 20 bp, Artificial Sequence
  Description of Artificial Sequence: Synthetic oligonucleotide
  Target: ATXN1; (-) strand; PAM type: NRG; PAM sequence: TGG
ttgtagagatgagttctcac

SEQ ID NO: 48668 - DNA, 20 bp, Artificial Sequence
  Description of Artificial Sequence: Synthetic oligonucleotide
  Target: ATXN1; (-) strand; PAM type: NRG; PAM sequence: GAG
taccttttttttgtagagat

SEQ ID NO: 48669 - DNA, 20 bp, Artificial Sequence
  Description of Artificial Sequence: Synthetic oligonucleotide
  Target: ATXN1; (-) strand; PAM type: NRG; PAM sequence: GAG
atttttaccttttttttgta

SEQ ID NO: 48670 - DNA, 20 bp, Artificial Sequence
  Description of Artificial Sequence: Synthetic oligonucleotide
  Target: ATXN1; (-) strand; PAM type: NRG; PAM sequence: TAG
taatttttaccttttttttg

SEQ ID NO: 48671 - DNA, 20 bp, Artificial Sequence
  Description of Artificial Sequence: Synthetic oligonucleotide
  Target: ATXN1; (-) strand; PAM type: NRG; PAM sequence: CAG
tagacatgtgccaccacgcc

SEQ ID NO: 48672 - DNA, 20 bp, Artificial Sequence
  Description of Artificial Sequence: Synthetic oligonucleotide
  Target: ATXN1; (-) strand; PAM type: NRG; PAM sequence: TAG
ctccctagtagcaaggacta

SEQ ID NO: 48673 - DNA, 20 bp, Artificial Sequence
  Description of Artificial Sequence: Synthetic oligonucleotide
  Target: ATXN1; (-) strand; PAM type: NRG; PAM sequence: AGG
cctcagcctccctagtagca

SEQ ID NO: 48674 - DNA, 20 bp, Artificial Sequence
  Description of Artificial Sequence: Synthetic oligonucleotide
  Target: ATXN1; (-) strand; PAM type: NRG; PAM sequence: AAG
gcctcagcctccctagtagc

SEQ ID NO: 48675 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctccctag

SEQ ID NO: 48676 - DNA, 20 bp, Artificial Sequence
  Description of Artificial Sequence: Synthetic oligonucleotide
  Target: ATXN1; (-) strand; PAM type: NRG; PAM sequence: TAG
tcctcctgcctcagcctccc

SEQ ID NO: 48677 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatcctcctgcct

SEQ ID NO: 48678 - DNA, 20 bp, Artificial Sequence
  Description of Artificial Sequence: Synthetic oligonucleotide
  Target: ATXN1; (-) strand; PAM type: NRG; PAM sequence: AAG
agcctctgtctcccaggctc

SEQ ID NO: 48679 - DNA, 20 bp, Artificial Sequence
  Description of Artificial Sequence: Synthetic oligonucleotide
  Target: ATXN1; (-) strand; PAM type: NRG; PAM sequence: AGG
ccctatagcctctgtctccc

SEQ ID NO: 48680 - DNA, 20 bp, Artificial Sequence
  Description of Artificial Sequence: Synthetic oligonucleotide
  Target: ATXN1; (-) strand; PAM type: NRG; PAM sequence: CAG
tccctatagcctctgtctcc

SEQ ID NO: 48681 - DNA, 20 bp, Artificial Sequence
  Description of Artificial Sequence: Synthetic oligonucleotide
  Target: ATXN1; (-) strand; PAM type: NRG; PAM sequence: TAG
tgtgcaatcacagctcccta

SEQ ID NO: 48682 - DNA, 20 bp, Artificial Sequence
  Description of Artificial Sequence: Synthetic oligonucleotide
  Target: ATXN1; (-) strand; PAM type: NRG; PAM sequence: CAG
tggagtgcagtgtgcaatca

SEQ ID NO: 48683 - DNA, 20 bp, Artificial Sequence
  Description of Artificial Sequence: Synthetic oligonucleotide
  Target: ATXN1; (-) strand; PAM type: NRG; PAM sequence: CAG
tttgctgtccagctggagtg

SEQ ID NO: 48684 - DNA, 20 bp, Artificial Sequence
  Description of Artificial Sequence: Synthetic oligonucleotide
  Target: ATXN1; (-) strand; PAM type: NRG; PAM sequence: GAG
ctcactttgctgtccagctg

SEQ ID NO: 48685 - DNA, 20 bp, Artificial Sequence
  Description of Artificial Sequence: Synthetic oligonucleotide
  Target: ATXN1; (-) strand; PAM type: NRG; PAM sequence: TGG
gtctcactttgctgtccagc

SEQ ID NO: 48686 - DNA, 20 bp, Artificial Sequence
  Description of Artificial Sequence: Synthetic oligonucleotide
  Target: ATXN1; (-) strand; PAM type: NRG; PAM sequence: CAG
cagtgtctcactttgctgtc

SEQ ID NO: 48687 - DNA, 20 bp, Artificial Sequence
  Description of Artificial Sequence: Synthetic oligonucleotide
  Target: ATXN1; (-) strand; PAM type: NRG; PAM sequence: CAG
tttatttatttattttgata

SEQ ID NO: 48688 - DNA, 20 bp, Artificial Sequence
  Description of Artificial Sequence: Synthetic oligonucleotide
  Target: ATXN1; (-) strand; PAM type: NRG; PAM sequence: AGG
tacattctctactctaccac

SEQ ID NO: 48689 - DNA, 20 bp, Artificial Sequence
  Description of Artificial Sequence: Synthetic oligonucleotide
  Target: ATXN1; (-) strand; PAM type: NRG; PAM sequence: CAG
ctacattctctactctacca

SEQ ID NO: 48690 - DNA, 20 bp, Artificial Sequence
  Description of Artificial Sequence: Synthetic oligonucleotide
  Target: ATXN1; (-) strand; PAM type: NRG; PAM sequence: GGG
ccctatgtgtccctccactt

SEQ ID NO: 48691 - DNA, 20 bp, Artificial Sequence
  Description of Artificial Sequence: Synthetic oligonucleotide
  Target: ATXN1; (-) strand; PAM type: NRG; PAM sequence: TGG
gccctatgtgtccctccact

SEQ ID NO: 48692 - DNA, 20 bp, Artificial Sequence
  Description of Artificial Sequence: Synthetic oligonucleotide
  Target: ATXN1; (-) strand; PAM type: NRG; PAM sequence: TGG
gagttaacaggacacctaca

SEQ ID NO: 48693 - DNA, 20 bp, Artificial Sequence
  Description of Artificial Sequence: Synthetic oligonucleotide
  Target: ATXN1; (-) strand; PAM type: NRG; PAM sequence: AGG
acctcctccatggagttaac

SEQ ID NO: 48694 - DNA, 20 bp, Artificial Sequence
  Description of Artificial Sequence: Synthetic oligonucleotide
  Target: ATXN1; (-) strand; PAM type: NRG; PAM sequence: CAG
aacctcctccatggagttaa

SEQ ID NO: 48695 - DNA, 20 bp, Artificial Sequence
  Description of Artificial Sequence: Synthetic oligonucleotide
  Target: ATXN1; (-) strand; PAM type: NRG; PAM sequence: GAG
ccccagaaacctcctccatg

SEQ ID NO: 48696 - DNA, 20 bp, Artificial Sequence
  Description of Artificial Sequence: Synthetic oligonucleotide
  Target: ATXN1; (-) strand; PAM type: NRG; PAM sequence: TGG
atccccagaaacctcctcca

SEQ ID NO: 48697 - DNA, 20 bp, Artificial Sequence
  Description of Artificial Sequence: Synthetic oligonucleotide
  Target: ATXN1; (-) strand; PAM type: NRG; PAM sequence: CAG
aacatggcctgggacatccc

SEQ ID NO: 48698 - DNA, 20 bp, Artificial Sequence
  Description of Artificial Sequence: Synthetic oligonucleotide
  Target: ATXN1; (-) strand; PAM type: NRG; PAM sequence: GGG
gttctcaggcaacatggcct

SEQ ID NO: 48699 - DNA, 20 bp, Artificial Sequence
  Description of Artificial Sequence: Synthetic oligonucleotide
  Target: ATXN1; (-) strand; PAM type: NRG; PAM sequence: TGG
tgttctcaggcaacatggcc

SEQ ID NO: 48700 - DNA, 20 bp, Artificial Sequence
  Description of Artificial Sequence: Synthetic oligonucleotide
  Target: ATXN1; (-) strand; PAM type: NRG; PAM sequence: TGG
agacatgttctcaggcaaca

SEQ ID NO: 48701 - DNA, 20 bp, Artificial Sequence
  Description of Artificial Sequence: Synthetic oligonucleotide
  Target: ATXN1; (-) strand; PAM type: NRG; PAM sequence: AGG
tctcaggcagacatgttctc

SEQ ID NO: 48702 - DNA, 20 bp, Artificial Sequence
  Description of Artificial Sequence: Synthetic oligonucleotide
  Target: ATXN1; (-) strand; PAM type: NRG; PAM sequence: CAG
gtctcaggcagacatgttct

SEQ ID NO: 48703 - DNA, 20 bp, Artificial Sequence
  Description of Artificial Sequence: Synthetic oligonucleotide
  Target: ATXN1; (-) strand; PAM type: NRG; PAM sequence: CAG
ggaatagaatgagtctcagg

SEQ ID NO: 48704 - DNA, 20 bp, Artificial Sequence
  Description of Artificial Sequence: Synthetic oligonucleotide
  Target: ATXN1; (-) strand; PAM type: NRG; PAM sequence: AGG
tcaggaatagaatgagtctc

SEQ ID NO: 48705 - DNA, 20 bp, Artificial Sequence
  Description of Artificial Sequence: Synthetic oligonucleotide
  Target: ATXN1; (-) strand; PAM type: NRG; PAM sequence: CAG
ttcaggaatagaatgagtct

SEQ ID NO: 48706 - DNA, 20 bp, Artificial Sequence
  Description of Artificial Sequence: Synthetic oligonucleotide
  Target: ATXN1; (-) strand; PAM type: NRG; PAM sequence: GAG
cagactttcaggaatagaat

SEQ ID NO: 48707 - DNA, 20 bp, Artificial Sequence
  Description of Artificial Sequence: Synthetic oligonucleotide
  Target: ATXN1; (-) strand; PAM type: NRG; PAM sequence: TAG
tggtttcagactttcaggaa

SEQ ID NO: 48708 - DNA, 20 bp, Artificial Sequence
  Description of Artificial Sequence: Synthetic oligonucleotide
  Target: ATXN1; (-) strand; PAM type: NRG; PAM sequence: AGG
actgatggtttcagactttc

SEQ ID NO: 48709 - DNA, 20 bp, Artificial Sequence
  Description of Artificial Sequence: Synthetic oligonucleotide
  Target: ATXN1; (-) strand; PAM type: NRG; PAM sequence: CAG
aactgatggtttcagacttt

SEQ ID NO: 48710 - DNA, 20 bp, Artificial Sequence
  Description of Artificial Sequence: Synthetic oligonucleotide
  Target: ATXN1; (-) strand; PAM type: NRG; PAM sequence: CAG
aagaatacaactgatggttt

SEQ ID NO: 48711 - DNA, 20 bp, Artificial Sequence
  Description of Artificial Sequence: Synthetic oligonucleotide
  Target: ATXN1; (-) strand; PAM type: NRG; PAM sequence: TGG
caatgtaagaatacaactga

SEQ ID NO: 48712 - DNA, 20 bp, Artificial Sequence
  Description of Artificial Sequence: Synthetic oligonucleotide
  Target: ATXN1; (-) strand; PAM type: NRG; PAM sequence: AAG
cattgaaccataatcaatgt

SEQ ID NO: 48713 - DNA, 20 bp, Artificial Sequence
  Description of Artificial Sequence: Synthetic oligonucleotide
  Target: ATXN1; (-) strand; PAM type: NRG; PAM sequence: GAG
gtggccaggacgtttatacg

SEQ ID NO: 48714 - DNA, 20 bp, Artificial Sequence
  Description of Artificial Sequence: Synthetic oligonucleotide
  Target: ATXN1; (-) strand; PAM type: NRG; PAM sequence: CGG
tggtggccaggacgtttata

SEQ ID NO: 48715 - DNA, 20 bp, Artificial Sequence
  Description of Artificial Sequence: Synthetic oligonucleotide
  Target: ATXN1; (-) strand; PAM type: NRG; PAM sequence: AGG
atcatttctaaatggtggcc

SEQ ID NO: 48716 - DNA, 20 bp, Artificial Sequence
  Description of Artificial Sequence: Synthetic oligonucleotide
  Target: ATXN1; (-) strand; PAM type: NRG; PAM sequence: CAG
gatcatttctaaatggtggc

SEQ ID NO: 48717 - DNA, 20 bp, Artificial Sequence
  Description of Artificial Sequence: Synthetic oligonucleotide
  Target: ATXN1; (-) strand; PAM type: NRG; PAM sequence: TGG
tatggatcatttctaaatgg

SEQ ID NO: 48718 - DNA, 20 bp, Artificial Sequence
  Description of Artificial Sequence: Synthetic oligonucleotide
  Target: ATXN1; (-) strand; PAM type: NRG; PAM sequence: TGG
aattatggatcatttctaaa

SEQ ID NO: 48719 - DNA, 20 bp, Artificial Sequence
  Description of Artificial Sequence: Synthetic oligonucleotide
  Target: ATXN1; (-) strand; PAM type: NRG; PAM sequence: TGG
aagacccaaacaagaaatta

SEQ ID NO: 48720 - DNA, 20 bp, Artificial Sequence
  Description of Artificial Sequence: Synthetic oligonucleotide
  Target: ATXN1; (-) strand; PAM type: NRG; PAM sequence: AAG
ggaaaaactaagacccaaac

SEQ ID NO: 48721 - DNA, 20 bp, Artificial Sequence
  Description of Artificial Sequence: Synthetic oligonucleotide
  Target: ATXN1; (-) strand; PAM type: NRG; PAM sequence: AAG
attgtataagtggaaaaact

SEQ ID NO: 48722 - DNA, 20 bp, Artificial Sequence
  Description of Artificial Sequence: Synthetic oligonucleotide
  Target: ATXN1; (-) strand; PAM type: NRG; PAM sequence: TGG
taagtaaaaaattgtataag

SEQ ID NO: 48723 - DNA, 20 bp, Artificial Sequence
  Description of Artificial Sequence: Synthetic oligonucleotide
  Target: ATXN1; (-) strand; PAM type: NRG; PAM sequence: AAG
aaataagtaaaaaattgtat

SEQ ID NO: 48724 - DNA, 20 bp, Artificial Sequence
  Description of Artificial Sequence: Synthetic oligonucleotide
  Target: ATXN1; (-) strand; PAM type: NRG; PAM sequence: AAG
aagcagatagaaaataaaat

SEQ ID NO: 48725 - DNA, 20 bp, Artificial Sequence
  Description of Artificial Sequence: Synthetic oligonucleotide
  Target: ATXN1; (-) strand; PAM type: NRG; PAM sequence: TAG
taatatgcccgtgaagcaga

SEQ ID NO: 48726 - DNA, 20 bp, Artificial Sequence
  Description of Artificial Sequence: Synthetic oligonucleotide
  Target: ATXN1; (-) strand; PAM type: NRG; PAM sequence: CAG
acattaatatgcccgtgaag

SEQ ID NO: 48727 - DNA, 20 bp, Artificial Sequence
  Description of Artificial Sequence: Synthetic oligonucleotide
  Target: ATXN1; (-) strand; PAM type: NRG; PAM sequence: AAG
tacacattaatatgcccgtg

SEQ ID NO: 48728 - DNA, 20 bp, Artificial Sequence
  Description of Artificial Sequence: Synthetic oligonucleotide
  Target: ATXN1; (-) strand; PAM type: NRG; PAM sequence: TGG
tctgccatttgtctttcact

SEQ ID NO: 48729 - DNA, 20 bp, Artificial Sequence
  Description of Artificial Sequence: Synthetic oligonucleotide
  Target: ATXN1; (-) strand; PAM type: NRG; PAM sequence: AAG
acgtgtgtgggacagatcaa

SEQ ID NO: 48730 - DNA, 20 bp, Artificial Sequence
  Description of Artificial Sequence: Synthetic oligonucleotide
  Target: ATXN1; (-) strand; PAM type: NRG; PAM sequence: CAG
accaagacacgtgtgtggga

SEQ ID NO: 48731 - DNA, 20 bp, Artificial Sequence
  Description of Artificial Sequence: Synthetic oligonucleotide
  Target: ATXN1; (-) strand; PAM type: NRG; PAM sequence: GGG
cttcaccaagacacgtgtgt

SEQ ID NO: 48732 - DNA, 20 bp, Artificial Sequence
  Description of Artificial Sequence: Synthetic oligonucleotide
  Target: ATXN1; (-) strand; PAM type: NRG; PAM sequence: TGG
ccttcaccaagacacgtgtg

SEQ ID NO: 48733 - DNA, 20 bp, Artificial Sequence
  Description of Artificial Sequence: Synthetic oligonucleotide
  Target: ATXN1; (-) strand; PAM type: NRG; PAM sequence: AAG
gtggcctgaataccttcacc

SEQ ID NO: 48734 - DNA, 20 bp, Artificial Sequence
  Description of Artificial Sequence: Synthetic oligonucleotide
  Target: ATXN1; (-) strand; PAM type: NRG; PAM sequence: TGG
ttccagactggcccctggag

SEQ ID NO: 48735 - DNA, 20 bp, Artificial Sequence
  Description of Artificial Sequence: Synthetic oligonucleotide
  Target: ATXN1; (-) strand; PAM type: NRG; PAM sequence: GAG
ggcttccagactggcccctg

SEQ ID NO: 48736 - DNA, 20 bp, Artificial Sequence
  Description of Artificial Sequence: Synthetic oligonucleotide
  Target: ATXN1; (-) strand; PAM type: NRG; PAM sequence: TGG
atggcttccagactggcccc

SEQ ID NO: 48737 - DNA, 20 bp, Artificial Sequence
  Description of Artificial Sequence: Synthetic oligonucleotide
  Target: ATXN1; (-) strand; PAM type: NRG; PAM sequence: TGG
atcagatatggcttccagac

SEQ ID NO: 48738 - DNA, 20 bp, Artificial Sequence
  Description of Artificial Sequence: Synthetic oligonucleotide
  Target: ATXN1; (-) strand; PAM type: NRG; PAM sequence: CAG
acctgatcagatatggcttc

SEQ ID NO: 48739 - DNA, 20 bp, Artificial Sequence
  Description of Artificial Sequence: Synthetic oligonucleotide
  Target: ATXN1; (-) strand; PAM type: NRG; PAM sequence: TGG
tgccctaacctgatcagata

SEQ ID NO: 48740 - DNA, 20 bp, Artificial Sequence
  Description of Artificial Sequence: Synthetic oligonucleotide
  Target: ATXN1; (-) strand; PAM type: NRG; PAM sequence: CAG
atatcatgccctaacctgat

SEQ ID NO: 48741 - DNA, 20 bp, Artificial Sequence
  Description of Artificial Sequence: Synthetic oligonucleotide
  Target: ATXN1; (-) strand; PAM type: NRG; PAM sequence: CAG
atgacacttgggtggggaca

SEQ ID NO: 48742 - DNA, 20 bp, Artificial Sequence
  Description of Artificial Sequence: Synthetic oligonucleotide
  Target: ATXN1; (-) strand; PAM type: NRG; PAM sequence: GGG
ttcaggatgacacttgggtg

SEQ ID NO: 48743 - DNA, 20 bp, Artificial Sequence
  Description of Artificial Sequence: Synthetic oligonucleotide
  Target: ATXN1; (-) strand; PAM type: NRG; PAM sequence: GGG
attcaggatgacacttgggt

SEQ ID NO: 48744 - DNA, 20 bp, Artificial Sequence
  Description of Artificial Sequence: Synthetic oligonucleotide
  Target: ATXN1; (-) strand; PAM type: NRG; PAM sequence: TGG
gattcaggatgacacttggg

SEQ ID NO: 48745 - DNA, 20 bp, Artificial Sequence
  Description of Artificial Sequence: Synthetic oligonucleotide
  Target: ATXN1; (-) strand; PAM type: NRG; PAM sequence: GGG
tacgattcaggatgacactt

SEQ ID NO: 48746 - DNA, 20 bp, Artificial Sequence
  Description of Artificial Sequence: Synthetic oligonucleotide
  Target: ATXN1; (-) strand; PAM type: NRG; PAM sequence: TGG
ctacgattcaggatgacact

SEQ ID NO: 48747 - DNA, 20 bp, Artificial Sequence
  Description of Artificial Sequence: Synthetic oligonucleotide
  Target: ATXN1; (-) strand; PAM type: NRG; PAM sequence: AGG
aattgtgggagctacgattc

SEQ ID NO: 48748 - DNA, 20 bp, Artificial Sequence
  Description of Artificial Sequence: Synthetic oligonucleotide
  Target: ATXN1; (-) strand; PAM type: NRG; PAM sequence: CAG
gaattgtgggagctacgatt

SEQ ID NO: 48749 - DNA, 20 bp, Artificial Sequence
  Description of Artificial Sequence: Synthetic oligonucleotide
  Target: ATXN1; (-) strand; PAM type: NRG; PAM sequence: GAG
acaatatgtgggaattgtgg

SEQ ID NO: 48750 - DNA, 20 bp, Artificial Sequence
  Description of Artificial Sequence: Synthetic oligonucleotide
  Target: ATXN1; (-) strand; PAM type: NRG; PAM sequence: GGG
ctacaatatgtgggaattgt

SEQ ID NO: 48751 - DNA, 20 bp, Artificial Sequence
  Description of Artificial Sequence: Synthetic oligonucleotide
  Target: ATXN1; (-) strand; PAM type: NRG; PAM sequence: TGG
cctacaatatgtgggaattg

SEQ ID NO: 48752 - DNA, 20 bp, Artificial Sequence
  Description of Artificial Sequence: Synthetic oligonucleotide
  Target: ATXN1; (-) strand; PAM type: NRG; PAM sequence: GGG
aggtccctcctacaatatgt

SEQ ID NO: 48753 - DNA, 20 bp, Artificial Sequence
  Description of Artificial Sequence: Synthetic oligonucleotide
  Target: ATXN1; (-) strand; PAM type: NRG; PAM sequence: TGG
caggtccctcctacaatatg

SEQ ID NO: 48754 - DNA, 20 bp, Artificial Sequence
  Description of Artificial Sequence: Synthetic oligonucleotide
  Target: ATXN1; (-) strand; PAM type: NRG; PAM sequence: AGG
ttattcagttgtctcccagc

SEQ ID NO: 48755 - DNA, 20 bp, Artificial Sequence
  Description of Artificial Sequence: Synthetic oligonucleotide
  Target: ATXN1; (-) strand; PAM type: NRG; PAM sequence: CAG
attattcagttgtctcccag

SEQ ID NO: 48756 - DNA, 20 bp, Artificial Sequence
  Description of Artificial Sequence: Synthetic oligonucleotide
  Target: ATXN1; (-) strand; PAM type: NRG; PAM sequence: CAG
cccattattcagttgtctcc

SEQ ID NO: 48757 - DNA, 20 bp, Artificial Sequence
  Description of Artificial Sequence: Synthetic oligonucleotide
  Target: ATXN1; (-) strand; PAM type: NRG; PAM sequence: CAG
gggaaactgcccccattatt

SEQ ID NO: 48758 - DNA, 20 bp, Artificial Sequence
  Description of Artificial Sequence: Synthetic oligonucleotide
  Target: ATXN1; (-) strand; PAM type: NRG; PAM sequence: GGG
ctaccacgagaacagtatgg

SEQ ID NO: 48759 - DNA, 20 bp, Artificial Sequence
  Description of Artificial Sequence: Synthetic oligonucleotide
  Target: ATXN1; (-) strand; PAM type: NRG; PAM sequence: GGG
actaccacgagaacagtatg

SEQ ID NO: 48760 - DNA, 20 bp, Artificial Sequence
  Description of Artificial Sequence: Synthetic oligonucleotide
  Target: ATXN1; (-) strand; PAM type: NRG; PAM sequence: GGG
cactaccacgagaacagtat

SEQ ID NO: 48761 - DNA, 20 bp, Artificial Sequence
  Description of Artificial Sequence: Synthetic oligonucleotide
  Target: ATXN1; (-) strand; PAM type: NRG; PAM sequence: TGG
tcactaccacgagaacagta

SEQ ID NO: 48762 - DNA, 20 bp, Artificial Sequence
  Description of Artificial Sequence: Synthetic oligonucleotide
  Target: ATXN1; (-) strand; PAM type: NRG; PAM sequence: CAG
cttattcactaccacgagaa

SEQ ID NO: 48763 - DNA, 20 bp, Artificial Sequence
  Description of Artificial Sequence: Synthetic oligonucleotide
  Target: ATXN1; (-) strand; PAM type: NRG; PAM sequence: GAG
tgagacttattcactaccac

SEQ ID NO: 48764 - DNA, 20 bp, Artificial Sequence
  Description of Artificial Sequence: Synthetic oligonucleotide
  Target: ATXN1; (-) strand; PAM type: NRG; PAM sequence: GAG
ataaaacaatcagatctcgt

SEQ ID NO: 48765 - DNA, 20 bp, Artificial Sequence
  Description of Artificial Sequence: Synthetic oligonucleotide
  Target: ATXN1; (-) strand; PAM type: NRG; PAM sequence: CAG
gaaacctcttataaaacaat

SEQ ID NO: 48766 - DNA, 20 bp, Artificial Sequence
  Description of Artificial Sequence: Synthetic oligonucleotide
  Target: ATXN1; (-) strand; PAM type: NRG; PAM sequence: GGG
aaatgagaggcaatcaaaag

SEQ ID NO: 48767 - DNA, 20 bp, Artificial Sequence
  Description of Artificial Sequence: Synthetic oligonucleotide
  Target: ATXN1; (-) strand; PAM type: NRG; PAM sequence: GGG
aaaatgagaggcaatcaaaa

SEQ ID NO: 48768 - DNA, 20 bp, Artificial Sequence
  Description of Artificial Sequence: Synthetic oligonucleotide
  Target: ATXN1; (-) strand; PAM type: NRG; PAM sequence: AGG
gaaaatgagaggcaatcaaa

SEQ ID NO: 48769 - DNA, 20 bp, Artificial Sequence
  Description of Artificial Sequence: Synthetic oligonucleotide
  Target: ATXN1; (-) strand; PAM type: NRG; PAM sequence: AAG
agaaaatgagaggcaatcaa

SEQ ID NO: 48770 - DNA, 20 bp, Artificial Sequence
  Description of Artificial Sequence: Synthetic oligonucleotide
  Target: ATXN1; (-) strand; PAM type: NRG; PAM sequence: AGG
agcaggcaagagaaaatgag

SEQ ID NO: 48771 - DNA, 20 bp, Artificial Sequence
  Description of Artificial Sequence: Synthetic oligonucleotide
  Target: ATXN1; (-) strand; PAM type: NRG; PAM sequence: GAG
cagcaggcaagagaaaatga

SEQ ID NO: 48772 - DNA, 20 bp, Artificial Sequence
  Description of Artificial Sequence: Synthetic oligonucleotide
  Target: ATXN1; (-) strand; PAM type: NRG; PAM sequence: GAG
ggcagcaggcaagagaaaat

SEQ ID NO: 48773 - DNA, 20 bp, Artificial Sequence
  Description of Artificial Sequence: Synthetic oligonucleotide
  Target: ATXN1; (-) strand; PAM type: NRG; PAM sequence: GAG
tcttacatggcagcaggcaa

SEQ ID NO: 48774 - DNA, 20 bp, Artificial Sequence
  Description of Artificial Sequence: Synthetic oligonucleotide
  Target: ATXN1; (-) strand; PAM type: NRG; PAM sequence: AAG
tgtcttacatggcagcaggc

SEQ ID NO: 48775 - DNA, 20 bp, Artificial Sequence
  Description of Artificial Sequence: Synthetic oligonucleotide
  Target: ATXN1; (-) strand; PAM type: NRG; PAM sequence: AGG
ggcatgtcttacatggcagc

SEQ ID NO: 48776 - DNA, 20 bp, Artificial Sequence
  Description of Artificial Sequence: Synthetic oligonucleotide
  Target: ATXN1; (-) strand; PAM type: NRG; PAM sequence: CAG
aggcatgtcttacatggcag

SEQ ID NO: 48777 - DNA, 20 bp, Artificial Sequence
  Description of Artificial Sequence: Synthetic oligonucleotide
  Target: ATXN1; (-) strand; PAM type: NRG; PAM sequence: CAG
aaaaggcatgtcttacatgg

SEQ ID NO: 48778 - DNA, 20 bp, Artificial Sequence
  Description of Artificial Sequence: Synthetic oligonucleotide
  Target: ATXN1; (-) strand; PAM type: NRG; PAM sequence: TGG
ggcaaaaggcatgtcttaca

SEQ ID NO: 48779 - DNA, 20 bp, Artificial Sequence
  Description of Artificial Sequence: Synthetic oligonucleotide
  Target: ATXN1; (-) strand; PAM type: NRG; PAM sequence: AGG
caatcatggtggaaggcaaa

SEQ ID NO: 48780 - DNA, 20 bp, Artificial Sequence
  Description of Artificial Sequence: Synthetic oligonucleotide
  Target: ATXN1; (-) strand; PAM type: NRG; PAM sequence: AAG
acaatcatggtggaaggcaa

SEQ ID NO: 48781 - DNA, 20 bp, Artificial Sequence
  Description of Artificial Sequence: Synthetic oligonucleotide
  Target: ATXN1; (-) strand; PAM type: NRG; PAM sequence: AGG
ggcttcacaatcatggtgga

SEQ ID NO: 48782 - DNA, 20 bp, Artificial Sequence
  Description of Artificial Sequence: Synthetic oligonucleotide
  Target: ATXN1; (-) strand; PAM type: NRG; PAM sequence: AAG
aggcttcacaatcatggtgg

SEQ ID NO: 48783 - DNA, 20 bp, Artificial Sequence
  Description of Artificial Sequence: Synthetic oligonucleotide
  Target: ATXN1; (-) strand; PAM type: NRG; PAM sequence: TGG
gggaggcttcacaatcatgg

SEQ ID NO: 48784 - DNA, 20 bp, Artificial Sequence
  Description of Artificial Sequence: Synthetic oligonucleotide
  Target: ATXN1; (-) strand; PAM type: NRG; PAM sequence: TGG
ctggggaggcttcacaatca

SEQ ID NO: 48785 - DNA, 20 bp, Artificial Sequence
  Description of Artificial Sequence: Synthetic oligonucleotide
  Target: ATXN1; (-) strand; PAM type: NRG; PAM sequence: AGG
acagttccacgtggctgggg

SEQ ID NO: 48786 - DNA, 20 bp, Artificial Sequence
  Description of Artificial Sequence: Synthetic oligonucleotide
  Target: ATXN1; (-) strand; PAM type: NRG; PAM sequence: GAG
cacagttccacgtggctggg

SEQ ID NO: 48787 - DNA, 20 bp, Artificial Sequence
  Description of Artificial Sequence: Synthetic oligonucleotide
  Target: ATXN1; (-) strand; PAM type: NRG; PAM sequence: GGG
ctcacagttccacgtggctg

SEQ ID NO: 48788 - DNA, 20 bp, Artificial Sequence
  Description of Artificial Sequence: Synthetic oligonucleotide
  Target: ATXN1; (-) strand; PAM type: NRG; PAM sequence: GGG
actcacagttccacgtggct

SEQ ID NO: 48789 - DNA, 20 bp, Artificial Sequence
  Description of Artificial Sequence: Synthetic oligonucleotide
  Target: ATXN1; (-) strand; PAM type: NRG; PAM sequence: TGG
gactcacagttccacgtggc

SEQ ID NO: 48790 - DNA, 20 bp, Artificial Sequence
  Description of Artificial Sequence: Synthetic oligonucleotide
  Target: ATXN1; (-) strand; PAM type: NRG; PAM sequence: TGG
aatggactcacagttccacg

SEQ ID NO: 48791 - DNA, 20 bp, Artificial Sequence
  Description of Artificial Sequence: Synthetic oligonucleotide
  Target: ATXN1; (-) strand; PAM type: NRG; PAM sequence: CAG
aaagaggtttaatggactca

SEQ ID NO: 48792 - DNA, 20 bp, Artificial Sequence
  Description of Artificial Sequence: Synthetic oligonucleotide
  Target: ATXN1; (-) strand; PAM type: NRG; PAM sequence: TGG
ataaagaaaaagaggtttaa

SEQ ID NO: 48793 - DNA, 20 bp, Artificial Sequence
  Description of Artificial Sequence: Synthetic oligonucleotide
  Target: ATXN1; (-) strand; PAM type: NRG; PAM sequence: AGG
ggtaatttataaagaaaaag

SEQ ID NO: 48794 - DNA, 20 bp, Artificial Sequence
  Description of Artificial Sequence: Synthetic oligonucleotide
  Target: ATXN1; (-) strand; PAM type: NRG; PAM sequence: GAG
aggtaatttataaagaaaaa

SEQ ID NO: 48795 - DNA, 20 bp, Artificial Sequence
  Description of Artificial Sequence: Synthetic oligonucleotide
  Target: ATXN1; (-) strand; PAM type: NRG; PAM sequence: AAG
ctaggtaatttataaagaaa

SEQ ID NO: 48796 - DNA, 20 bp, Artificial Sequence
  Description of Artificial Sequence: Synthetic oligonucleotide
  Target: ATXN1; (-) strand; PAM type: NRG; PAM sequence: AAG
ccaagcctaggtaatttata

SEQ ID NO: 48797 - DNA, 20 bp, Artificial Sequence
  Description of Artificial Sequence: Synthetic oligonucleotide
  Target: ATXN1; (-) strand; PAM type: NRG; PAM sequence: AGG
ataaagacatacccaagcct

SEQ ID NO: 48798 - DNA, 20 bp, Artificial Sequence
  Description of Artificial Sequence: Synthetic oligonucleotide
  Target: ATXN1; (-) strand; PAM type: NRG; PAM sequence: TAG
aataaagacatacccaagcc

SEQ ID NO: 48799 - DNA, 20 bp, Artificial Sequence
  Description of Artificial Sequence: Synthetic oligonucleotide
  Target: ATXN1; (-) strand; PAM type: NRG; PAM sequence: AAG
ctgctaataaagacataccc

SEQ ID NO: 48800 - DNA, 20 bp, Artificial Sequence
  Description of Artificial Sequence: Synthetic oligonucleotide
  Target: ATXN1; (-) strand; PAM type: NRG; PAM sequence: AAG
ctgttttcatgctgctaata

SEQ ID NO: 48801 - DNA, 20 bp, Artificial Sequence
  Description of Artificial Sequence: Synthetic oligonucleotide
  Target: ATXN1; (-) strand; PAM type: NRG; PAM sequence: TAG
ttgggtgtgatgccctgtat

SEQ ID NO: 48802 - DNA, 20 bp, Artificial Sequence
  Description of Artificial Sequence: Synthetic oligonucleotide
  Target: ATXN1; (-) strand; PAM type: NRG; PAM sequence: GGG
aggagaaacaggtctaattt

SEQ ID NO: 48803 - DNA, 20 bp, Artificial Sequence
  Description of Artificial Sequence: Synthetic oligonucleotide
  Target: ATXN1; (-) strand; PAM type: NRG; PAM sequence: TGG
gaggagaaacaggtctaatt

SEQ ID NO: 48804 - DNA, 20 bp, Artificial Sequence
  Description of Artificial Sequence: Synthetic oligonucleotide
  Target: ATXN1; (-) strand; PAM type: NRG; PAM sequence: AGG
tatggaagtagaggagaaac

SEQ ID NO: 48805 - DNA, 20 bp, Artificial Sequence
  Description of Artificial Sequence: Synthetic oligonucleotide
  Target: ATXN1; (-) strand; PAM type: NRG; PAM sequence: CAG
atatggaagtagaggagaaa

SEQ ID NO: 48806 - DNA, 20 bp, Artificial Sequence
  Description of Artificial Sequence: Synthetic oligonucleotide
  Target: ATXN1; (-) strand; PAM type: NRG; PAM sequence: GAG
gagttcatatggaagtagag

SEQ ID NO: 48807 - DNA, 20 bp, Artificial Sequence
  Description of Artificial Sequence: Synthetic oligonucleotide
  Target: ATXN1; (-) strand; PAM type: NRG; PAM sequence: AGG
cagagttcatatggaagtag

SEQ ID NO: 48808 - DNA, 20 bp, Artificial Sequence
  Description of Artificial Sequence: Synthetic oligonucleotide
  Target: ATXN1; (-) strand; PAM type: NRG; PAM sequence: GAG
acagagttcatatggaagta

SEQ ID NO: 48809 - DNA, 20 bp, Artificial Sequence
  Description of Artificial Sequence: Synthetic oligonucleotide
  Target: ATXN1; (-) strand; PAM type: NRG; PAM sequence: TAG
ttacagagttcatatggaag

SEQ ID NO: 48810 - DNA, 20 bp, Artificial Sequence
  Description of Artificial Sequence: Synthetic oligonucleotide
  Target: ATXN1; (-) strand; PAM type: NRG; PAM sequence: AAG
gcattacagagttcatatgg

SEQ ID NO: 48811 - DNA, 20 bp, Artificial Sequence
  Description of Artificial Sequence: Synthetic oligonucleotide
  Target: ATXN1; (-) strand; PAM type: NRG; PAM sequence: TGG
aaagcattacagagttcata

SEQ ID NO: 48812 - DNA, 20 bp, Artificial Sequence
  Description of Artificial Sequence: Synthetic oligonucleotide
  Target: ATXN1; (-) strand; PAM type: NRG; PAM sequence: GAG
gcaataggaaaagcattaca

SEQ ID NO: 48813 - DNA, 20 bp, Artificial Sequence
  Description of Artificial Sequence: Synthetic oligonucleotide
  Target: ATXN1; (-) strand; PAM type: NRG; PAM sequence: CAG
cagcaataggaaaagcatta

SEQ ID NO: 48814 - DNA, 20 bp, Artificial Sequence
  Description of Artificial Sequence: Synthetic oligonucleotide
  Target: ATXN1; (-) strand; PAM type: NRG; PAM sequence: AAG
gttgttatcagcaataggaa

SEQ ID NO: 48815 - DNA, 20 bp, Artificial Sequence
  Description of Artificial Sequence: Synthetic oligonucleotide
  Target: ATXN1; (-) strand; PAM type: NRG; PAM sequence: AGG
accaggttgttatcagcaat

SEQ ID NO: 48816 - DNA, 20 bp, Artificial Sequence
  Description of Artificial Sequence: Synthetic oligonucleotide
  Target: ATXN1; (-) strand; PAM type: NRG; PAM sequence: TAG
aaccaggttgttatcagcaa

SEQ ID NO: 48817 - DNA, 20 bp, Artificial Sequence
  Description of Artificial Sequence: Synthetic oligonucleotide
  Target: ATXN1; (-) strand; PAM type: NRG; PAM sequence: CAG
gtctgcaaccaggttgttat

SEQ ID NO: 48818 - DNA, 20 bp, Artificial Sequence
  Description of Artificial Sequence: Synthetic oligonucleotide
  Target: ATXN1; (-) strand; PAM type: NRG; PAM sequence: AGG
taacatgttggtctgcaacc

SEQ ID NO: 48819 - DNA, 20 bp, Artificial Sequence
  Description of Artificial Sequence: Synthetic oligonucleotide
  Target: ATXN1; (-) strand; PAM type: NRG; PAM sequence: CAG
ataacatgttggtctgcaac

SEQ ID NO: 48820 - DNA, 20 bp, Artificial Sequence
  Description of Artificial Sequence: Synthetic oligonucleotide
  Target: ATXN1; (-) strand; PAM type: NRG; PAM sequence: TGG
agaacattgatataacatgt

SEQ ID NO: 48821 - DNA, 20 bp, Artificial Sequence
  Description of Artificial Sequence: Synthetic oligonucleotide
  Target: ATXN1; (-) strand; PAM type: NRG; PAM sequence: CAG
atgtaacatgtgcctattta

SEQ ID NO: 48822 - DNA, 20 bp, Artificial Sequence
  Description of Artificial Sequence: Synthetic oligonucleotide
  Target: ATXN1; (-) strand; PAM type: NRG; PAM sequence: TGG
ttatcacctggtttatgccg

SEQ ID NO: 48823 - DNA, 20 bp, Artificial Sequence
  Description of Artificial Sequence: Synthetic oligonucleotide
  Target: ATXN1; (-) strand; PAM type: NRG; PAM sequence: TGG
cattacaatgtattatcacc

SEQ ID NO: 48824 - DNA, 20 bp, Artificial Sequence
  Description of Artificial Sequence: Synthetic oligonucleotide
  Target: ATXN1; (-) strand; PAM type: NRG; PAM sequence: GAG
gagtgattactacattttta

SEQ ID NO: 48825 - DNA, 20 bp, Artificial Sequence
  Description of Artificial Sequence: Synthetic oligonucleotide
  Target: ATXN1; (-) strand; PAM type: NRG; PAM sequence: TAG
ttgagtgattactacatttt

SEQ ID NO: 48826 - DNA, 20 bp, Artificial Sequence
  Description of Artificial Sequence: Synthetic oligonucleotide
  Target: ATXN1; (-) strand; PAM type: NRG; PAM sequence: GAG
cagatgctaaggattttatt

SEQ ID NO: 48827 - DNA, 20 bp, Artificial Sequence
  Description of Artificial Sequence: Synthetic oligonucleotide
  Target: ATXN1; (-) strand; PAM type: NRG; PAM sequence: AGG
gaggtatatagcagatgcta

SEQ ID NO: 48828 - DNA, 20 bp, Artificial Sequence
  Description of Artificial Sequence: Synthetic oligonucleotide
  Target: ATXN1; (-) strand; PAM type: NRG; PAM sequence: AAG
cgaggtatatagcagatgct

SEQ ID NO: 48829 - DNA, 20 bp, Artificial Sequence
  Description of Artificial Sequence: Synthetic oligonucleotide
  Target: ATXN1; (-) strand; PAM type: NRG; PAM sequence: CAG
gtataattcgaggtatatag

SEQ ID NO: 48830 - DNA, 20 bp, Artificial Sequence
  Description of Artificial Sequence: Synthetic oligonucleotide
  Target: ATXN1; (-) strand; PAM type: NRG; PAM sequence: TAG
ctggtataattcgaggtata

SEQ ID NO: 48831 - DNA, 20 bp, Artificial Sequence
  Description of Artificial Sequence: Synthetic oligonucleotide
  Target: ATXN1; (-) strand; PAM type: NRG; PAM sequence: AGG
aaagcttctggtataattcg

SEQ ID NO: 48832 - DNA, 20 bp, Artificial Sequence
  Description of Artificial Sequence: Synthetic oligonucleotide
  Target: ATXN1; (-) strand; PAM type: NRG; PAM sequence: GAG
aaaagcttctggtataattc

SEQ ID NO: 48833 - DNA, 20 bp, Artificial Sequence
  Description of Artificial Sequence: Synthetic oligonucleotide
  Target: ATXN1; (-) strand; PAM type: NRG; PAM sequence: TGG
gctcatatcctaaaagcttc

SEQ ID NO: 48834 - DNA, 20 bp, Artificial Sequence
  Description of Artificial Sequence: Synthetic oligonucleotide
  Target: ATXN1; (-) strand; PAM type: NRG; PAM sequence: AAG
tttttttgctcatatcctaa

SEQ ID NO: 48835 - DNA, 20 bp, Artificial Sequence
  Description of Artificial Sequence: Synthetic oligonucleotide
  Target: ATXN1; (-) strand; PAM type: NRG; PAM sequence: GGG
ttgtaagttcctttttagca

SEQ ID NO: 48836 - DNA, 20 bp, Artificial Sequence
  Description of Artificial Sequence: Synthetic oligonucleotide
  Target: ATXN1; (-) strand; PAM type: NRG; PAM sequence: AGG
attgtaagttcctttttagc

SEQ ID NO: 48837 - DNA, 20 bp, Artificial Sequence
  Description of Artificial Sequence: Synthetic oligonucleotide
  Target: ATXN1; (-) strand; PAM type: NRG; PAM sequence: CAG
gattgtaagttcctttttag

SEQ ID NO: 48838 - DNA, 20 bp, Artificial Sequence
  Description of Artificial Sequence: Synthetic oligonucleotide
  Target: ATXN1; (-) strand; PAM type: NRG; PAM sequence: TAG
ctggattgtaagttcctttt

SEQ ID NO: 48839 - DNA, 20 bp, Artificial Sequence
  Description of Artificial Sequence: Synthetic oligonucleotide
  Target: ATXN1; (-) strand; PAM type: NRG; PAM sequence: AAG
atttcttcaagctggattgt

SEQ ID NO: 48840 - DNA, 20 bp, Artificial Sequence
  Description of Artificial Sequence: Synthetic oligonucleotide
  Target: ATXN1; (-) strand; PAM type: NRG; PAM sequence: TGG
tgggctttatttcttcaagc

SEQ ID NO: 48841 - DNA, 20 bp, Artificial Sequence
  Description of Artificial Sequence: Synthetic oligonucleotide
  Target: ATXN1; (-) strand; PAM type: NRG; PAM sequence: AAG
tgtgtgggctttatttcttc

SEQ ID NO: 48842 - DNA, 20 bp, Artificial Sequence
  Description of Artificial Sequence: Synthetic oligonucleotide
  Target: ATXN1; (-) strand; PAM type: NRG; PAM sequence: GGG
tccctaatttttttatgtgt

SEQ ID NO: 48843 - DNA, 20 bp, Artificial Sequence
  Description of Artificial Sequence: Synthetic oligonucleotide
  Target: ATXN1; (-) strand; PAM type: NRG; PAM sequence: TGG
ttccctaatttttttatgtg

SEQ ID NO: 48844 - DNA, 20 bp, Artificial Sequence
  Description of Artificial Sequence: Synthetic oligonucleotide
  Target: ATXN1; (-) strand; PAM type: NRG; PAM sequence: TGG
tttttgcacttaactgaata

SEQ ID NO: 48845 - DNA, 20 bp, Artificial Sequence
  Description of Artificial Sequence: Synthetic oligonucleotide
  Target: ATXN1; (-) strand; PAM type: NRG; PAM sequence: GAG
aaccctctagcttgctaatc

SEQ ID NO: 48846 - DNA, 20 bp, Artificial Sequence
  Description of Artificial Sequence: Synthetic oligonucleotide
  Target: ATXN1; (-) strand; PAM type: NRG; PAM sequence: TAG
gttatttctaataaaccctc

SEQ ID NO: 48847 - DNA, 20 bp, Artificial Sequence
  Description of Artificial Sequence: Synthetic oligonucleotide
  Target: ATXN1; (-) strand; PAM type: NRG; PAM sequence: AAG
tttatagtagggaagttttt

SEQ ID NO: 48848 - DNA, 20 bp, Artificial Sequence
  Description of Artificial Sequence: Synthetic oligonucleotide
  Target: ATXN1; (-) strand; PAM type: NRG; PAM sequence: AAG
ctatggtttttatagtaggg

SEQ ID NO: 48849 - DNA, 20 bp, Artificial Sequence
  Description of Artificial Sequence: Synthetic oligonucleotide
  Target: ATXN1; (-) strand; PAM type: NRG; PAM sequence: GGG
aaactatggtttttatagta

SEQ ID NO: 48850 - DNA, 20 bp, Artificial Sequence
  Description of Artificial Sequence: Synthetic oligonucleotide
  Target: ATXN1; (-) strand; PAM type: NRG; PAM sequence: AGG
taaactatggtttttatagt

SEQ ID NO: 48851 - DNA, 20 bp, Artificial Sequence
  Description of Artificial Sequence: Synthetic oligonucleotide
  Target: ATXN1; (-) strand; PAM type: NRG; PAM sequence: TAG
ttaaactatggtttttatag

SEQ ID NO: 48852 - DNA, 20 bp, Artificial Sequence
  Description of Artificial Sequence: Synthetic oligonucleotide
  Target: ATXN1; (-) strand; PAM type: NRG; PAM sequence: TAG
ggcttaaactatggttttta

SEQ ID NO: 48853 - DNA, 20 bp, Artificial Sequence
  Description of Artificial Sequence: Synthetic oligonucleotide
  Target: ATXN1; (-) strand; PAM type: NRG; PAM sequence: TGG
gttaaagcaggcttaaacta

SEQ ID NO: 48854 - DNA, 20 bp, Artificial Sequence
  Description of Artificial Sequence: Synthetic oligonucleotide
  Target: ATXN1; (-) strand; PAM type: NRG; PAM sequence: AGG
accagatctaatgttaaagc

SEQ ID NO: 48855 - DNA, 20 bp, Artificial Sequence
  Description of Artificial Sequence: Synthetic oligonucleotide
  Target: ATXN1; (-) strand; PAM type: NRG; PAM sequence: CAG
aaccagatctaatgttaaag

SEQ ID NO: 48856 - DNA, 20 bp, Artificial Sequence
  Description of Artificial Sequence: Synthetic oligonucleotide
  Target: ATXN1; (-) strand; PAM type: NRG; PAM sequence: AAG
ggaaaccagatctaatgtta

SEQ ID NO: 48857 - DNA, 20 bp, Artificial Sequence
  Description of Artificial Sequence: Synthetic oligonucleotide
  Target: ATXN1; (-) strand; PAM type: NRG; PAM sequence: CAG
gttaatcagttgtgggaaac

SEQ ID NO: 48858 - DNA, 20 bp, Artificial Sequence
  Description of Artificial Sequence: Synthetic oligonucleotide
  Target: ATXN1; (-) strand; PAM type: NRG; PAM sequence: GGG
ttttcaggttaatcagttgt

SEQ ID NO: 48859 - DNA, 20 bp, Artificial Sequence
  Description of Artificial Sequence: Synthetic oligonucleotide
  Target: ATXN1; (-) strand; PAM type: NRG; PAM sequence: TGG
attttcaggttaatcagttg

SEQ ID NO: 48860 - DNA, 20 bp, Artificial Sequence
  Description of Artificial Sequence: Synthetic oligonucleotide
  Target: ATXN1; (-) strand; PAM type: NRG; PAM sequence: CAG
taaaccattttcaggttaat

SEQ ID NO: 48861 - DNA, 20 bp, Artificial Sequence
  Description of Artificial Sequence: Synthetic oligonucleotide
  Target: ATXN1; (-) strand; PAM type: NRG; PAM sequence: AGG
tgttgtgctaaaccattttc

SEQ ID NO: 48862 - DNA, 20 bp, Artificial Sequence
  Description of Artificial Sequence: Synthetic oligonucleotide
  Target: ATXN1; (-) strand; PAM type: NRG; PAM sequence: CAG
gtgttgtgctaaaccatttt

SEQ ID NO: 48863 - DNA, 20 bp, Artificial Sequence
  Description of Artificial Sequence: Synthetic oligonucleotide
  Target: ATXN1; (-) strand; PAM type: NRG; PAM sequence: TAG
aggttgttaaattaaaggat

SEQ ID NO: 48864 - DNA, 20 bp, Artificial Sequence
  Description of Artificial Sequence: Synthetic oligonucleotide
  Target: ATXN1; (-) strand; PAM type: NRG; PAM sequence: AGG
tttataggttgttaaattaa

SEQ ID NO: 48865 - DNA, 20 bp, Artificial Sequence
  Description of Artificial Sequence: Synthetic oligonucleotide
  Target: ATXN1; (-) strand; PAM type: NRG; PAM sequence: AAG
atttataggttgttaaatta

SEQ ID NO: 48866 - DNA, 20 bp, Artificial Sequence
  Description of Artificial Sequence: Synthetic oligonucleotide
  Target: ATXN1; (-) strand; PAM type: NRG; PAM sequence: AGG
ttgttatatacggcatttat

SEQ ID NO: 48867 - DNA, 20 bp, Artificial Sequence
  Description of Artificial Sequence: Synthetic oligonucleotide
  Target: ATXN1; (-) strand; PAM type: NRG; PAM sequence: TAG
cttgttatatacggcattta

SEQ ID NO: 48868 - DNA, 20 bp, Artificial Sequence
  Description of Artificial Sequence: Synthetic oligonucleotide
  Target: ATXN1; (-) strand; PAM type: NRG; PAM sequence: CGG
tctgtggaacttgttatata

SEQ ID NO: 48869 - DNA, 20 bp, Artificial Sequence
  Description of Artificial Sequence: Synthetic oligonucleotide
  Target: ATXN1; (-) strand; PAM type: NRG; PAM sequence: TGG
gaatccaagaaagggctctg

SEQ ID NO: 48870 - DNA, 20 bp, Artificial Sequence
  Description of Artificial Sequence: Synthetic oligonucleotide
  Target: ATXN1; (-) strand; PAM type: NRG; PAM sequence: GGG
atcattatgaatccaagaaa

SEQ ID NO: 48871 - DNA, 20 bp, Artificial Sequence
  Description of Artificial Sequence: Synthetic oligonucleotide
  Target: ATXN1; (-) strand; PAM type: NRG; PAM sequence: AGG
tatcattatgaatccaagaa

SEQ ID NO: 48872 - DNA, 20 bp, Artificial Sequence
  Description of Artificial Sequence: Synthetic oligonucleotide
  Target: ATXN1; (-) strand; PAM type: NRG; PAM sequence: AAG
ttatcattatgaatccaaga

SEQ ID NO: 48873 - DNA, 20 bp, Artificial Sequence
  Description of Artificial Sequence: Synthetic oligonucleotide
  Target: ATXN1; (-) strand; PAM type: NRG; PAM sequence: AAG
caggttatcattatgaatcc

SEQ ID NO: 48874 - DNA, 20 bp, Artificial Sequence
  Description of Artificial Sequence: Synthetic oligonucleotide
  Target: ATXN1; (-) strand; PAM type: NRG; PAM sequence: AGG
ttggatagtgtggtagatgc

SEQ ID NO: 48875 - DNA, 20 bp, Artificial Sequence
  Description of Artificial Sequence: Synthetic oligonucleotide
  Target: ATXN1; (-) strand; PAM type: NRG; PAM sequence: CAG
attggatagtgtggtagatg

SEQ ID NO: 48876 - DNA, 20 bp, Artificial Sequence
  Description of Artificial Sequence: Synthetic oligonucleotide
  Target: ATXN1; (-) strand; PAM type: NRG; PAM sequence: TAG
atgaacattggatagtgtgg

SEQ ID NO: 48877 - DNA, 20 bp, Artificial Sequence
  Description of Artificial Sequence: Synthetic oligonucleotide
  Target: ATXN1; (-) strand; PAM type: NRG; PAM sequence: TGG
aaaatgaacattggatagtg

SEQ ID NO: 48878 - DNA, 20 bp, Artificial Sequence
  Description of Artificial Sequence: Synthetic oligonucleotide
  Target: ATXN1; (-) strand; PAM type: NRG; PAM sequence: TAG
tcattaaaatgaacattgga

SEQ ID NO: 48879 - DNA, 20 bp, Artificial Sequence
  Description of Artificial Sequence: Synthetic oligonucleotide
  Target: ATXN1; (-) strand; PAM type: NRG; PAM sequence: TGG
gtgctcattaaaatgaacat

SEQ ID NO: 48880 - DNA, 20 bp, Artificial Sequence
  Description of Artificial Sequence: Synthetic oligonucleotide
  Target: ATXN1; (-) strand; PAM type: NRG; PAM sequence: AGG
gattgttcattaaagtccag

SEQ ID NO: 48881 - DNA, 20 bp, Artificial Sequence
  Description of Artificial Sequence: Synthetic oligonucleotide
  Target: ATXN1; (-) strand; PAM type: NRG; PAM sequence: GAG
agattgttcattaaagtcca

SEQ ID NO: 48882 - DNA, 20 bp, Artificial Sequence
  Description of Artificial Sequence: Synthetic oligonucleotide
  Target: ATXN1; (-) strand; PAM type: NRG; PAM sequence: CAG
taagattgttcattaaagtc

SEQ ID NO: 48883 - DNA, 20 bp, Artificial Sequence
  Description of Artificial Sequence: Synthetic oligonucleotide
  Target: ATXN1; (-) strand; PAM type: NRG; PAM sequence: AAG
agacctaagattgttcatta

SEQ ID NO: 48884 - DNA, 20 bp, Artificial Sequence
  Description of Artificial Sequence: Synthetic oligonucleotide
  Target: ATXN1; (-) strand; PAM type: NRG; PAM sequence: AAG
attgatgctcacttagacct

SEQ ID NO: 48885 - DNA, 20 bp, Artificial Sequence
  Description of Artificial Sequence: Synthetic oligonucleotide
  Target: ATXN1; (-) strand; PAM type: NRG; PAM sequence: TAG
ctctttaattgatgctcact

SEQ ID NO: 48886 - DNA, 20 bp, Artificial Sequence
  Description of Artificial Sequence: Synthetic oligonucleotide
  Target: ATXN1; (-) strand; PAM type: NRG; PAM sequence: AGG
atcaccatttatacctttgg

SEQ ID NO: 48887 - DNA, 20 bp, Artificial Sequence
  Description of Artificial Sequence: Synthetic oligonucleotide
  Target: ATXN1; (-) strand; PAM type: NRG; PAM sequence: GAG
catcaccatttatacctttg

SEQ ID NO: 48888 - DNA, 20 bp, Artificial Sequence
  Description of Artificial Sequence: Synthetic oligonucleotide
  Target: ATXN1; (-) strand; PAM type: NRG; PAM sequence: TGG
tacatcaccatttatacctt

SEQ ID NO: 48889 - DNA, 20 bp, Artificial Sequence
  Description of Artificial Sequence: Synthetic oligonucleotide
  Target: ATXN1; (-) strand; PAM type: NRG; PAM sequence: CAG
tcctttcaaccctgctaacc

SEQ ID NO: 48890 - DNA, 20 bp, Artificial Sequence
  Description of Artificial Sequence: Synthetic oligonucleotide
  Target: ATXN1; (-) strand; PAM type: NRG; PAM sequence: AGG
ccaaacctcacgatgctcac

SEQ ID NO: 48891 - DNA, 20 bp, Artificial Sequence
  Description of Artificial Sequence: Synthetic oligonucleotide
  Target: ATXN1; (-) strand; PAM type: NRG; PAM sequence: CAG
tccaaacctcacgatgctca

SEQ ID NO: 48892 - DNA, 20 bp, Artificial Sequence
  Description of Artificial Sequence: Synthetic oligonucleotide
  Target: ATXN1; (-) strand; PAM type: NRG; PAM sequence: GGG
gtgggagctgctgatcaagg

SEQ ID NO: 48893 - DNA, 20 bp, Artificial Sequence
  Description of Artificial Sequence: Synthetic oligonucleotide
  Target: ATXN1; (-) strand; PAM type: NRG; PAM sequence: GGG
ggtgggagctgctgatcaag

SEQ ID NO: 48894 - DNA, 20 bp, Artificial Sequence
  Description of Artificial Sequence: Synthetic oligonucleotide
  Target: ATXN1; (-) strand; PAM type: NRG; PAM sequence: GGG
aggtgggagctgctgatcaa

SEQ ID NO: 48895 - DNA, 20 bp, Artificial Sequence
  Description of Artificial Sequence: Synthetic oligonucleotide
  Target: ATXN1; (-) strand; PAM type: NRG; PAM sequence: AGG
gaggtgggagctgctgatca

SEQ ID NO: 48896 - DNA, 20 bp, Artificial Sequence
  Description of Artificial Sequence: Synthetic oligonucleotide
  Target: ATXN1; (-) strand; PAM type: NRG; PAM sequence: AAG
agaggtgggagctgctgatc

SEQ ID NO: 48897 - DNA, 20 bp, Artificial Sequence
  Description of Artificial Sequence: Synthetic oligonucleotide
  Target: ATXN1; (-) strand; PAM type: NRG; PAM sequence: GAG
tctatatcagacagaggtgg

SEQ ID NO: 48898 - DNA, 20 bp, Artificial Sequence
  Description of Artificial Sequence: Synthetic oligonucleotide
  Target: ATXN1; (-) strand; PAM type: NRG; PAM sequence: GGG
gctctatatcagacagaggt

SEQ ID NO: 48899 - DNA, 20 bp, Artificial Sequence
  Description of Artificial Sequence: Synthetic oligonucleotide
  Target: ATXN1; (-) strand; PAM type: NRG; PAM sequence: TGG
cgctctatatcagacagagg

SEQ ID NO: 48900 - DNA, 20 bp, Artificial Sequence
  Description of Artificial Sequence: Synthetic oligonucleotide
  Target: ATXN1; (-) strand; PAM type: NRG; PAM sequence: AGG
cttcgctctatatcagacag

SEQ ID NO: 48901 - DNA, 20 bp, Artificial Sequence
  Description of Artificial Sequence: Synthetic oligonucleotide
  Target: ATXN1; (-) strand; PAM type: NRG; PAM sequence: GAG
gcttcgctctatatcagaca

SEQ ID NO: 48902 - DNA, 20 bp, Artificial Sequence
  Description of Artificial Sequence: Synthetic oligonucleotide
  Target: ATXN1; (-) strand; PAM type: NRG; PAM sequence: CAG
cagcttcgctctatatcaga

SEQ ID NO: 48903 - DNA, 20 bp, Artificial Sequence
  Description of Artificial Sequence: Synthetic oligonucleotide
  Target: ATXN1; (-) strand; PAM type: NRG; PAM sequence: CAG
gccccagcttcgctctatat

SEQ ID NO: 48904 - DNA, 20 bp, Artificial Sequence
  Description of Artificial Sequence: Synthetic oligonucleotide
  Target: ATXN1; (-) strand; PAM type: NRG; PAM sequence: CAG
tcttctttcatcccaggccc

SEQ ID NO: 48905 - DNA, 20 bp, Artificial Sequence
  Description of Artificial Sequence: Synthetic oligonucleotide
  Target: ATXN1; (-) strand; PAM type: NRG; PAM sequence: AGG
gggctttcttctttcatccc

SEQ ID NO: 48906 - DNA, 20 bp, Artificial Sequence
  Description of Artificial Sequence: Synthetic oligonucleotide
  Target: ATXN1; (-) strand; PAM type: NRG; PAM sequence: CAG
ggggctttcttctttcatcc

SEQ ID NO: 48907 - DNA, 20 bp, Artificial Sequence
  Description of Artificial Sequence: Synthetic oligonucleotide
  Target: ATXN1; (-) strand; PAM type: NRG; PAM sequence: GGG
cccctaatatttatgtgctg

SEQ ID NO: 48908 - DNA, 20 bp, Artificial Sequence
  Description of Artificial Sequence: Synthetic oligonucleotide
  Target: ATXN1; (-) strand; PAM type: NRG; PAM sequence: GGG
tcccctaatatttatgtgct

SEQ ID NO: 48909 - DNA, 20 bp, Artificial Sequence
  Description of Artificial Sequence: Synthetic oligonucleotide
  Target: ATXN1; (-) strand; PAM type: NRG; PAM sequence: TGG
ttcccctaatatttatgtgc

SEQ ID NO: 48910 - DNA, 20 bp, Artificial Sequence
  Description of Artificial Sequence: Synthetic oligonucleotide
  Target: ATXN1; (-) strand; PAM type: NRG; PAM sequence: TAG
tttcagaattcctccttcta

SEQ ID NO: 48911 - DNA, 20 bp, Artificial Sequence
  Description of Artificial Sequence: Synthetic oligonucleotide
  Target: ATXN1; (-) strand; PAM type: NRG; PAM sequence: CAG
cagatgtatttctcttcttt

SEQ ID NO: 48912 - DNA, 20 bp, Artificial Sequence
  Description of Artificial Sequence: Synthetic oligonucleotide
  Target: ATXN1; (-) strand; PAM type: NRG; PAM sequence: CAG
tgcagcaattctgtgttgct

SEQ ID NO: 48913 - DNA, 20 bp, Artificial Sequence
  Description of Artificial Sequence: Synthetic oligonucleotide
  Target: ATXN1; (-) strand; PAM type: NRG; PAM sequence: CAG
aatgcgtgcaggtaactctg

SEQ ID NO: 48914 - DNA, 20 bp, Artificial Sequence
  Description of Artificial Sequence: Synthetic oligonucleotide
  Target: ATXN1; (-) strand; PAM type: NRG; PAM sequence: AGG
aaaactgtaagaatgcgtgc

SEQ ID NO: 48915 - DNA, 20 bp, Artificial Sequence
  Description of Artificial Sequence: Synthetic oligonucleotide
  Target: ATXN1; (-) strand; PAM type: NRG; PAM sequence: CAG
gaaaactgtaagaatgcgtg

SEQ ID NO: 48916 - DNA, 20 bp, Artificial Sequence
  Description of Artificial Sequence: Synthetic oligonucleotide
  Target: ATXN1; (-) strand; PAM type: NRG; PAM sequence: AAG
tcttgtccttggaaaactgt

SEQ ID NO: 48917 - DNA, 20 bp, Artificial Sequence
  Description of Artificial Sequence: Synthetic oligonucleotide
  Target: ATXN1; (-) strand; PAM type: NRG; PAM sequence: TGG
ccataccctcctcttgtcct

SEQ ID NO: 48918 - DNA, 20 bp, Artificial Sequence
  Description of Artificial Sequence: Synthetic oligonucleotide
  Target: ATXN1; (-) strand; PAM type: NRG; PAM sequence: GGG
ttagacatattcaggggctc

SEQ ID NO: 48919 - DNA, 20 bp, Artificial Sequence
  Description of Artificial Sequence: Synthetic oligonucleotide
  Target: ATXN1; (-) strand; PAM type: NRG; PAM sequence: CGG
attagacatattcaggggct

SEQ ID NO: 48920 - DNA, 20 bp, Artificial Sequence
  Description of Artificial Sequence: Synthetic oligonucleotide
  Target: ATXN1; (-) strand; PAM type: NRG; PAM sequence: GGG
acagaattagacatattcag

SEQ ID NO: 48921 - DNA, 20 bp, Artificial Sequence
  Description of Artificial Sequence: Synthetic oligonucleotide
  Target: ATXN1; (-) strand; PAM type: NRG; PAM sequence: GGG
tacagaattagacatattca

SEQ ID NO: 48922 - DNA, 20 bp, Artificial Sequence
  Description of Artificial Sequence: Synthetic oligonucleotide
  Target: ATXN1; (-) strand; PAM type: NRG; PAM sequence: AGG
ctacagaattagacatattc

SEQ ID NO: 48923 - DNA, 20 bp, Artificial Sequence
  Description of Artificial Sequence: Synthetic oligonucleotide
  Target: ATXN1; (-) strand; PAM type: NRG; PAM sequence: CAG
cctacagaattagacatatt

SEQ ID NO: 48924 - DNA, 20 bp, Artificial Sequence
  Description of Artificial Sequence: Synthetic oligonucleotide
  Target: ATXN1; (-) strand; PAM type: NRG; PAM sequence: TAG
catttgcatgcctacagaat

SEQ ID NO: 48925 - DNA, 20 bp, Artificial Sequence
  Description of Artificial Sequence: Synthetic oligonucleotide
  Target: ATXN1; (-) strand; PAM type: NRG; PAM sequence: CAG
aattctcatttgcatgccta

SEQ ID NO: 48926 - DNA, 20 bp, Artificial Sequence
  Description of Artificial Sequence: Synthetic oligonucleotide
  Target: ATXN1; (-) strand; PAM type: NRG; PAM sequence: CAG
gctgctgccgcaaagtcagt

SEQ ID NO: 48927 - DNA, 20 bp, Artificial Sequence
  Description of Artificial Sequence: Synthetic oligonucleotide
  Target: ATXN1; (-) strand; PAM type: NRG; PAM sequence: CAG
ctcagctgctgccgcaaagt

SEQ ID NO: 48928 - DNA, 20 bp, Artificial Sequence
  Description of Artificial Sequence: Synthetic oligonucleotide
  Target: ATXN1; (-) strand; PAM type: NRG; PAM sequence: AAG
agggctcagctgctgccgca

SEQ ID NO: 48929 - DNA, 20 bp, Artificial Sequence
  Description of Artificial Sequence: Synthetic oligonucleotide
  Target: ATXN1; (-) strand; PAM type: NRG; PAM sequence: CAG
gaagggaagttagcagggct

SEQ ID NO: 48930 - DNA, 20 bp, Artificial Sequence
  Description of Artificial Sequence: Synthetic oligonucleotide
  Target: ATXN1; (-) strand; PAM type: NRG; PAM sequence: GGG
gttctgaagggaagttagca

SEQ ID NO: 48931 - DNA, 20 bp, Artificial Sequence
  Description of Artificial Sequence: Synthetic oligonucleotide
  Target: ATXN1; (-) strand; PAM type: NRG; PAM sequence: AGG
agttctgaagggaagttagc

SEQ ID NO: 48932 - DNA, 20 bp, Artificial Sequence
  Description of Artificial Sequence: Synthetic oligonucleotide
  Target: ATXN1; (-) strand; PAM type: NRG; PAM sequence: CAG
gagttctgaagggaagttag

SEQ ID NO: 48933 - DNA, 20 bp, Artificial Sequence
  Description of Artificial Sequence: Synthetic oligonucleotide
  Target: ATXN1; (-) strand; PAM type: NRG; PAM sequence: TAG
gctgagttctgaagggaagt

SEQ ID NO: 48934 - DNA, 20 bp, Artificial Sequence
  Description of Artificial Sequence: Synthetic oligonucleotide
  Target: ATXN1; (-) strand; PAM type: NRG; PAM sequence: AAG
ccaagctgagttctgaaggg

SEQ ID NO: 48935 - DNA, 20 bp, Artificial Sequence
  Description of Artificial Sequence: Synthetic oligonucleotide
  Target: ATXN1; (-) strand; PAM type: NRG; PAM sequence: GGG
agcccaagctgagttctgaa

SEQ ID NO: 48936 - DNA, 20 bp, Artificial Sequence
  Description of Artificial Sequence: Synthetic oligonucleotide
  Target: ATXN1; (-) strand; PAM type: NRG; PAM sequence: AGG
tagcccaagctgagttctga

SEQ ID NO: 48937 - DNA, 20 bp, Artificial Sequence
  Description of Artificial Sequence: Synthetic oligonucleotide
  Target: ATXN1; (-) strand; PAM type: NRG; PAM sequence: AAG
ctagcccaagctgagttctg

SEQ ID NO: 48938 - DNA, 20 bp, Artificial Sequence
  Description of Artificial Sequence: Synthetic oligonucleotide
  Target: ATXN1; (-) strand; PAM type: NRG; PAM sequence: GAG
tttctttgctagcccaagct

SEQ ID NO: 48939 - DNA, 20 bp, Artificial Sequence
  Description of Artificial Sequence: Synthetic oligonucleotide
  Target: ATXN1; (-) strand; PAM type: NRG; PAM sequence: AAG
cgtcttttctttgctagccc

SEQ ID NO: 48940 - DNA, 20 bp, Artificial Sequence
  Description of Artificial Sequence: Synthetic oligonucleotide
  Target: ATXN1; (-) strand; PAM type: NRG; PAM sequence: TAG
agtgggcgtcttttctttgc

SEQ ID NO: 48941 - DNA, 20 bp, Artificial Sequence
  Description of Artificial Sequence: Synthetic oligonucleotide
  Target: ATXN1; (-) strand; PAM type: NRG; PAM sequence: GGG
gctggggtaggtgggtgagt

SEQ ID NO: 48942 - DNA, 20 bp, Artificial Sequence
  Description of Artificial Sequence: Synthetic oligonucleotide
  Target: ATXN1; (-) strand; PAM type: NRG; PAM sequence: TGG
tgctggggtaggtgggtgag

SEQ ID NO: 48943 - DNA, 20 bp, Artificial Sequence
  Description of Artificial Sequence: Synthetic oligonucleotide
  Target: ATXN1; (-) strand; PAM type: NRG; PAM sequence: GAG
agctgctggggtaggtgggt

SEQ ID NO: 48944 - DNA, 20 bp, Artificial Sequence
  Description of Artificial Sequence: Synthetic oligonucleotide
  Target: ATXN1; (-) strand; PAM type: NRG; PAM sequence: GGG
gcaaagctgctggggtaggt

SEQ ID NO: 48945 - DNA, 20 bp, Artificial Sequence
  Description of Artificial Sequence: Synthetic oligonucleotide
  Target: ATXN1; (-) strand; PAM type: NRG; PAM sequence: TGG
tgcaaagctgctggggtagg

SEQ ID NO: 48946 - DNA, 20 bp, Artificial Sequence
  Description of Artificial Sequence: Synthetic oligonucleotide
  Target: ATXN1; (-) strand; PAM type: NRG; PAM sequence: AGG
ttctgcaaagctgctggggt

SEQ ID NO: 48947 - DNA, 20 bp, Artificial Sequence
  Description of Artificial Sequence: Synthetic oligonucleotide
  Target: ATXN1; (-) strand; PAM type: NRG; PAM sequence: TAG
cttctgcaaagctgctgggg

SEQ ID NO: 48948 - DNA, 20 bp, Artificial Sequence
  Description of Artificial Sequence: Synthetic oligonucleotide
  Target: ATXN1; (-) strand; PAM type: NRG; PAM sequence: GGG
gcacttctgcaaagctgctg

SEQ ID NO: 48949 - DNA, 20 bp, Artificial Sequence
  Description of Artificial Sequence: Synthetic oligonucleotide
  Target: ATXN1; (-) strand; PAM type: NRG; PAM sequence: GGG
agcacttctgcaaagctgct

SEQ ID NO: 48950 - DNA, 20 bp, Artificial Sequence
  Description of Artificial Sequence: Synthetic oligonucleotide
  Target: ATXN1; (-) strand; PAM type: NRG; PAM sequence: TGG
cagcacttctgcaaagctgc

SEQ ID NO: 48951 - DNA, 20 bp, Artificial Sequence
  Description of Artificial Sequence: Synthetic oligonucleotide
  Target: ATXN1; (-) strand; PAM type: NRG; PAM sequence: AAG
caccctgcagcacttctgca

SEQ ID NO: 48952 - DNA, 20 bp, Artificial Sequence
  Description of Artificial Sequence: Synthetic oligonucleotide
  Target: ATXN1; (-) strand; PAM type: NRG; PAM sequence: CAG
tcttcattgtcttcaccctg

SEQ ID NO: 48953 - DNA, 20 bp, Artificial Sequence
  Description of Artificial Sequence: Synthetic oligonucleotide
  Target: ATXN1; (-) strand; PAM type: NRG; PAM sequence: CAG
cagaatgcctcggctttctt

SEQ ID NO: 48954 - DNA, 20 bp, Artificial Sequence
  Description of Artificial Sequence: Synthetic oligonucleotide
  Target: ATXN1; (-) strand; PAM type: NRG; PAM sequence: CGG
tgggagagggcagaatgcct

SEQ ID NO: 48955 - DNA, 20 bp, Artificial Sequence
  Description of Artificial Sequence: Synthetic oligonucleotide
  Target: ATXN1; (-) strand; PAM type: NRG; PAM sequence: CAG
ctgtctttgctgggagaggg

SEQ ID NO: 48956 - DNA, 20 bp, Artificial Sequence
  Description of Artificial Sequence: Synthetic oligonucleotide
  Target: ATXN1; (-) strand; PAM type: NRG; PAM sequence: GGG
aggctgtctttgctgggaga

SEQ ID NO: 48957 - DNA, 20 bp, Artificial Sequence
  Description of Artificial Sequence: Synthetic oligonucleotide
  Target: ATXN1; (-) strand; PAM type: NRG; PAM sequence: AGG
caggctgtctttgctgggag

SEQ ID NO: 48958 - DNA, 20 bp, Artificial Sequence
  Description of Artificial Sequence: Synthetic oligonucleotide
  Target: ATXN1; (-) strand; PAM type: NRG; PAM sequence: GAG
ccaggctgtctttgctggga

SEQ ID NO: 48959 - DNA, 20 bp, Artificial Sequence
  Description of Artificial Sequence: Synthetic oligonucleotide
  Target: ATXN1; (-) strand; PAM type: NRG; PAM sequence: GAG
gtccaggctgtctttgctgg

SEQ ID NO: 48960 - DNA, 20 bp, Artificial Sequence
  Description of Artificial Sequence: Synthetic oligonucleotide
  Target: ATXN1; (-) strand; PAM type: NRG; PAM sequence: GGG
acgtccaggctgtctttgct

SEQ ID NO: 48961 - DNA, 20 bp, Artificial Sequence
  Description of Artificial Sequence: Synthetic oligonucleotide
  Target: ATXN1; (-) strand; PAM type: NRG; PAM sequence: TGG
cacgtccaggctgtctttgc

SEQ ID NO: 48962 - DNA, 20 bp, Artificial Sequence
  Description of Artificial Sequence: Synthetic oligonucleotide
  Target: ATXN1; (-) strand; PAM type: NRG; PAM sequence: AGG
gatagggtctgaacacgtcc

SEQ ID NO: 48963 - DNA, 20 bp, Artificial Sequence
  Description of Artificial Sequence: Synthetic oligonucleotide
  Target: ATXN1; (-) strand; PAM type: NRG; PAM sequence: CAG
cgatagggtctgaacacgtc

SEQ ID NO: 48964 - DNA, 20 bp, Artificial Sequence
  Description of Artificial Sequence: Synthetic oligonucleotide
  Target: ATXN1; (-) strand; PAM type: NRG; PAM sequence: GGG
cttcttttgatgcggcgata

SEQ ID NO: 48965 - DNA, 20 bp, Artificial Sequence
  Description of Artificial Sequence: Synthetic oligonucleotide
  Target: ATXN1; (-) strand; PAM type: NRG; PAM sequence: AGG
tcttcttttgatgcggcgat

SEQ ID NO: 48966 - DNA, 20 bp, Artificial Sequence
  Description of Artificial Sequence: Synthetic oligonucleotide
  Target: ATXN1; (-) strand; PAM type: NRG; PAM sequence: TAG
ttcttcttttgatgcggcga

SEQ ID NO: 48967 - DNA, 20 bp, Artificial Sequence
  Description of Artificial Sequence: Synthetic oligonucleotide
  Target: ATXN1; (-) strand; PAM type: NRG; PAM sequence: CGG
ttggtgttcttcttttgatg

SEQ ID NO: 48968 - DNA, 20 bp, Artificial Sequence
  Description of Artificial Sequence: Synthetic oligonucleotide
  Target: ATXN1; (-) strand; PAM type: NRG; PAM sequence: TGG
ttttgtgactcctttctcct

SEQ ID NO: 48969 - DNA, 20 bp, Artificial Sequence
  Description of Artificial Sequence: Synthetic oligonucleotide
  Target: ATXN1; (-) strand; PAM type: NRG; PAM sequence: GAG
gtgccttcctgatcatgcca

SEQ ID NO: 48970 - DNA, 20 bp, Artificial Sequence
  Description of Artificial Sequence: Synthetic oligonucleotide
  Target: ATXN1; (-) strand; PAM type: NRG; PAM sequence: CAG
aggtgccttcctgatcatgc

SEQ ID NO: 48971 - DNA, 20 bp, Artificial Sequence
  Description of Artificial Sequence: Synthetic oligonucleotide
  Target: ATXN1; (-) strand; PAM type: NRG; PAM sequence: AGG
aatatatccttttcaaatcc

SEQ ID NO: 48972 - DNA, 20 bp, Artificial Sequence
  Description of Artificial Sequence: Synthetic oligonucleotide
  Target: ATXN1; (-) strand; PAM type: NRG; PAM sequence: CAG
taatatatccttttcaaatc

SEQ ID NO: 48973 - DNA, 20 bp, Artificial Sequence
  Description of Artificial Sequence: Synthetic oligonucleotide
  Target: ATXN1; (-) strand; PAM type: NRG; PAM sequence: GGG
aaatcagtgaagttaagctt

SEQ ID NO: 48974 - DNA, 20 bp, Artificial Sequence
  Description of Artificial Sequence: Synthetic oligonucleotide
  Target: ATXN1; (-) strand; PAM type: NRG; PAM sequence: TGG
gaaatcagtgaagttaagct

SEQ ID NO: 48975 - DNA, 20 bp, Artificial Sequence
  Description of Artificial Sequence: Synthetic oligonucleotide
  Target: ATXN1; (-) strand; PAM type: NRG; PAM sequence: AAG
tcatggaaatcagtgaagtt

SEQ ID NO: 48976 - DNA, 20 bp, Artificial Sequence
  Description of Artificial Sequence: Synthetic oligonucleotide
  Target: ATXN1; (-) strand; PAM type: NRG; PAM sequence: AAG
cttagtcatggaaatcagtg

SEQ ID NO: 48977 - DNA, 20 bp, Artificial Sequence
  Description of Artificial Sequence: Synthetic oligonucleotide
  Target: ATXN1; (-) strand; PAM type: NRG; PAM sequence: CAG
agtggcttagtcatggaaat

SEQ ID NO: 48978 - DNA, 20 bp, Artificial Sequence
  Description of Artificial Sequence: Synthetic oligonucleotide
  Target: ATXN1; (-) strand; PAM type: NRG; PAM sequence: TGG
tctgtcaagtggcttagtca

SEQ ID NO: 48979 - DNA, 20 bp, Artificial Sequence
  Description of Artificial Sequence: Synthetic oligonucleotide
  Target: ATXN1; (-) strand; PAM type: NRG; PAM sequence: TAG
gagttttctgtcaagtggct

SEQ ID NO: 48980 - DNA, 20 bp, Artificial Sequence
  Description of Artificial Sequence: Synthetic oligonucleotide
  Target: ATXN1; (-) strand; PAM type: NRG; PAM sequence: TGG
aaaaggagttttctgtcaag

SEQ ID NO: 48981 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaggagttttctgtc

SEQ ID NO: 48982 - DNA, 20 bp, Artificial Sequence
  Description of Artificial Sequence: Synthetic oligonucleotide
  Target: ATXN1; (-) strand; PAM type: NRG; PAM sequence: GAG
aagtttaaattgaaaaaaag

SEQ ID NO: 48983 - DNA, 20 bp, Artificial Sequence
  Description of Artificial Sequence: Synthetic oligonucleotide
  Target: ATXN1; (-) strand; PAM type: NRG; PAM sequence: AGG
taaagtttaaattgaaaaaa

SEQ ID NO: 48984 - DNA, 20 bp, Artificial Sequence
  Description of Artificial Sequence: Synthetic oligonucleotide
  Target: ATXN1; (-) strand; PAM type: NRG; PAM sequence: AAG
ttaaagtttaaattgaaaaa

SEQ ID NO: 48985 - DNA, 20 bp, Artificial Sequence
  Description of Artificial Sequence: Synthetic oligonucleotide
  Target: ATXN1; (-) strand; PAM type: NRG; PAM sequence: AAG
taacagagctgtagttctta

SEQ ID NO: 48986 - DNA, 20 bp, Artificial Sequence
  Description of Artificial Sequence: Synthetic oligonucleotide
  Target: ATXN1; (-) strand; PAM type: NRG; PAM sequence: TAG
gattctaagtaacagagctg

SEQ ID NO: 48987 - DNA, 20 bp, Artificial Sequence
  Description of Artificial Sequence: Synthetic oligonucleotide
  Target: ATXN1; (-) strand; PAM type: NRG; PAM sequence: GAG
gctttggattctaagtaaca

SEQ ID NO: 48988 - DNA, 20 bp, Artificial Sequence
  Description of Artificial Sequence: Synthetic oligonucleotide
  Target: ATXN1; (-) strand; PAM type: NRG; PAM sequence: CAG
ttgctttggattctaagtaa

SEQ ID NO: 48989 - DNA, 20 bp, Artificial Sequence
  Description of Artificial Sequence: Synthetic oligonucleotide
  Target: ATXN1; (-) strand; PAM type: NRG; PAM sequence: AAG
tgatatttgctttggattct

SEQ ID NO: 48990 - DNA, 20 bp, Artificial Sequence
  Description of Artificial Sequence: Synthetic oligonucleotide
  Target: ATXN1; (-) strand; PAM type: NRG; PAM sequence: TGG
tgtcctgatgatatttgctt

SEQ ID NO: 48991 - DNA, 20 bp, Artificial Sequence
  Description of Artificial Sequence: Synthetic oligonucleotide
  Target: ATXN1; (-) strand; PAM type: NRG; PAM sequence: GAG
tgttgacagctgtttcctca

SEQ ID NO: 48992 - DNA, 20 bp, Artificial Sequence
  Description of Artificial Sequence: Synthetic oligonucleotide
  Target: ATXN1; (-) strand; PAM type: NRG; PAM sequence: CAG
gttgttgacagctgtttcct

SEQ ID NO: 48993 - DNA, 20 bp, Artificial Sequence
  Description of Artificial Sequence: Synthetic oligonucleotide
  Target: ATXN1; (-) strand; PAM type: NRG; PAM sequence: CAG
aggaattgcagagttgttga

SEQ ID NO: 48994 - DNA, 20 bp, Artificial Sequence
  Description of Artificial Sequence: Synthetic oligonucleotide
  Target: ATXN1; (-) strand; PAM type: NRG; PAM sequence: GAG
tagtggataaaggaattgca

SEQ ID NO: 48995 - DNA, 20 bp, Artificial Sequence
  Description of Artificial Sequence: Synthetic oligonucleotide
  Target: ATXN1; (-) strand; PAM type: NRG; PAM sequence: CAG
tgtagtggataaaggaattg

SEQ ID NO: 48996 - DNA, 20 bp, Artificial Sequence
  Description of Artificial Sequence: Synthetic oligonucleotide
  Target: ATXN1; (-) strand; PAM type: NRG; PAM sequence: AGG
tgttagcatgtagtggataa

SEQ ID NO: 48997 - DNA, 20 bp, Artificial Sequence
  Description of Artificial Sequence: Synthetic oligonucleotide
  Target: ATXN1; (-) strand; PAM type: NRG; PAM sequence: AAG
gtgttagcatgtagtggata

SEQ ID NO: 48998 - DNA, 20 bp, Artificial Sequence
  Description of Artificial Sequence: Synthetic oligonucleotide
  Target: ATXN1; (-) strand; PAM type: NRG; PAM sequence: TGG
ggatgggtgttagcatgtag

SEQ ID NO: 48999 - DNA, 20 bp, Artificial Sequence
  Description of Artificial Sequence: Synthetic oligonucleotide
  Target: ATXN1; (-) strand; PAM type: NRG; PAM sequence: TAG
tcaggatgggtgttagcatg

SEQ ID NO: 49000 - DNA, 20 bp, Artificial Sequence
  Description of Artificial Sequence: Synthetic oligonucleotide
  Target: ATXN1; (-) strand; PAM type: NRG; PAM sequence: TAG
gctgggctcaggatgggtgt

SEQ ID NO: 49001 - DNA, 20 bp, Artificial Sequence
  Description of Artificial Sequence: Synthetic oligonucleotide
  Target: ATXN1; (-) strand; PAM type: NRG; PAM sequence: GGG
acattcgctgggctcaggat

SEQ ID NO: 49002 - DNA, 20 bp, Artificial Sequence
  Description of Artificial Sequence: Synthetic oligonucleotide
  Target: ATXN1; (-) strand; PAM type: NRG; PAM sequence: TGG
gacattcgctgggctcagga

SEQ ID NO: 49003 - DNA, 20 bp, Artificial Sequence
  Description of Artificial Sequence: Synthetic oligonucleotide
  Target: ATXN1; (-) strand; PAM type: NRG; PAM sequence: AGG
gaaggacattcgctgggctc

SEQ ID NO: 49004 - DNA, 20 bp, Artificial Sequence
  Description of Artificial Sequence: Synthetic oligonucleotide
  Target: ATXN1; (-) strand; PAM type: NRG; PAM sequence: CAG
agaaggacattcgctgggct

SEQ ID NO: 49005 - DNA, 20 bp, Artificial Sequence
  Description of Artificial Sequence: Synthetic oligonucleotide
  Target: ATXN1; (-) strand; PAM type: NRG; PAM sequence: GGG
ggcatagaaggacattcgct

SEQ ID NO: 49006 - DNA, 20 bp, Artificial Sequence
  Description of Artificial Sequence: Synthetic oligonucleotide
  Target: ATXN1; (-) strand; PAM type: NRG; PAM sequence: TGG
aggcatagaaggacattcgc

SEQ ID NO: 49007 - DNA, 20 bp, Artificial Sequence
  Description of Artificial Sequence: Synthetic oligonucleotide
  Target: ATXN1; (-) strand; PAM type: NRG; PAM sequence: AGG
tctttgtaaccaggcataga

SEQ ID NO: 49008 - DNA, 20 bp, Artificial Sequence
  Description of Artificial Sequence: Synthetic oligonucleotide
  Target: ATXN1; (-) strand; PAM type: NRG; PAM sequence: AAG
atctttgtaaccaggcatag

SEQ ID NO: 49009 - DNA, 20 bp, Artificial Sequence
  Description of Artificial Sequence: Synthetic oligonucleotide
  Target: ATXN1; (-) strand; PAM type: NRG; PAM sequence: TAG
ccaatctttgtaaccaggca

SEQ ID NO: 49010 - DNA, 20 bp, Artificial Sequence
  Description of Artificial Sequence: Synthetic oligonucleotide
  Target: ATXN1; (-) strand; PAM type: NRG; PAM sequence: AGG
atgccccaatctttgtaacc

SEQ ID NO: 49011 - DNA, 20 bp, Artificial Sequence
  Description of Artificial Sequence: Synthetic oligonucleotide
  Target: ATXN1; (-) strand; PAM type: NRG; PAM sequence: CAG
aatgccccaatctttgtaac

SEQ ID NO: 49012 - DNA, 20 bp, Artificial Sequence
  Description of Artificial Sequence: Synthetic oligonucleotide
  Target: ATXN1; (-) strand; PAM type: NRG; PAM sequence: GGG
attatcagggtgagagaagg

SEQ ID NO: 49013 - DNA, 20 bp, Artificial Sequence
  Description of Artificial Sequence: Synthetic oligonucleotide
  Target: ATXN1; (-) strand; PAM type: NRG; PAM sequence: GGG
gattatcagggtgagagaag

SEQ ID NO: 49014 - DNA, 20 bp, Artificial Sequence
  Description of Artificial Sequence: Synthetic oligonucleotide
  Target: ATXN1; (-) strand; PAM type: NRG; PAM sequence: GGG
tgattatcagggtgagagaa

SEQ ID NO: 49015 - DNA, 20 bp, Artificial Sequence
  Description of Artificial Sequence: Synthetic oligonucleotide
  Target: ATXN1; (-) strand; PAM type: NRG; PAM sequence: AGG
gtgattatcagggtgagaga

SEQ ID NO: 49016 - DNA, 20 bp, Artificial Sequence
  Description of Artificial Sequence: Synthetic oligonucleotide
  Target: ATXN1; (-) strand; PAM type: NRG; PAM sequence: AAG
tgtgattatcagggtgagag

SEQ ID NO: 49017 - DNA, 20 bp, Artificial Sequence
  Description of Artificial Sequence: Synthetic oligonucleotide
  Target: ATXN1; (-) strand; PAM type: NRG; PAM sequence: GAG
tactgtgattatcagggtga

SEQ ID NO: 49018 - DNA, 20 bp, Artificial Sequence
  Description of Artificial Sequence: Synthetic oligonucleotide
  Target: ATXN1; (-) strand; PAM type: NRG; PAM sequence: GAG
actactgtgattatcagggt

SEQ ID NO: 49019 - DNA, 20 bp, Artificial Sequence
  Description of Artificial Sequence: Synthetic oligonucleotide
  Target: ATXN1; (-) strand; PAM type: NRG; PAM sequence: GGG
agaaactactgtgattatca

SEQ ID NO: 49020 - DNA, 20 bp, Artificial Sequence
  Description of Artificial Sequence: Synthetic oligonucleotide
  Target: ATXN1; (-) strand; PAM type: NRG; PAM sequence: AGG
cagaaactactgtgattatc

SEQ ID NO: 49021 - DNA, 20 bp, Artificial Sequence
  Description of Artificial Sequence: Synthetic oligonucleotide
  Target: ATXN1; (-) strand; PAM type: NRG; PAM sequence: CAG
ccagaaactactgtgattat

SEQ ID NO: 49022 - DNA, 20 bp, Artificial Sequence
  Description of Artificial Sequence: Synthetic oligonucleotide
  Target: ATXN1; (-) strand; PAM type: NRG; PAM sequence: CAG
agggttccatctaggtcccc

SEQ ID NO: 49023 - DNA, 20 bp, Artificial Sequence
  Description of Artificial Sequence: Synthetic oligonucleotide
  Target: ATXN1; (-) strand; PAM type: NRG; PAM sequence: AGG
tttaataaagggttccatct

SEQ ID NO: 49024 - DNA, 20 bp, Artificial Sequence
  Description of Artificial Sequence: Synthetic oligonucleotide
  Target: ATXN1; (-) strand; PAM type: NRG; PAM sequence: TAG
atttaataaagggttccatc

SEQ ID NO: 49025 - DNA, 20 bp, Artificial Sequence
  Description of Artificial Sequence: Synthetic oligonucleotide
  Target: ATXN1; (-) strand; PAM type: NRG; PAM sequence: GGG
atgttccaaaatttaataaa

SEQ ID NO: 49026 - DNA, 20 bp, Artificial Sequence
  Description of Artificial Sequence: Synthetic oligonucleotide
  Target: ATXN1; (-) strand; PAM type: NRG; PAM sequence: AGG
catgttccaaaatttaataa

SEQ ID NO: 49027 - DNA, 20 bp, Artificial Sequence
  Description of Artificial Sequence: Synthetic oligonucleotide
  Target: ATXN1; (-) strand; PAM type: NRG; PAM sequence: AAG
tcatgttccaaaatttaata

SEQ ID NO: 49028 - DNA, 20 bp, Artificial Sequence
  Description of Artificial Sequence: Synthetic oligonucleotide
  Target: ATXN1; (-) strand; PAM type: NRG; PAM sequence: CAG
aatgacaagtgggtaccacc

SEQ ID NO: 49029 - DNA, 20 bp, Artificial Sequence
  Description of Artificial Sequence: Synthetic oligonucleotide
  Target: ATXN1; (-) strand; PAM type: NRG; PAM sequence: GGG
ctcacttacaaatgacaagt

SEQ ID NO: 49030 - DNA, 20 bp, Artificial Sequence
  Description of Artificial Sequence: Synthetic oligonucleotide
  Target: ATXN1; (-) strand; PAM type: NRG; PAM sequence: TGG
actcacttacaaatgacaag

SEQ ID NO: 49031 - DNA, 20 bp, Artificial Sequence
  Description of Artificial Sequence: Synthetic oligonucleotide
  Target: ATXN1; (-) strand; PAM type: NRG; PAM sequence: AAG
agcactcacttacaaatgac

SEQ ID NO: 49032 - DNA, 20 bp, Artificial Sequence
  Description of Artificial Sequence: Synthetic oligonucleotide
  Target: ATXN1; (-) strand; PAM type: NRG; PAM sequence: CAG
gtggtctgatggaaattatc

SEQ ID NO: 49033 - DNA, 20 bp, Artificial Sequence
  Description of Artificial Sequence: Synthetic oligonucleotide
  Target: ATXN1; (-) strand; PAM type: NRG; PAM sequence: TGG
atacaagcattgtggtctga

SEQ ID NO: 49034 - DNA, 20 bp, Artificial Sequence
  Description of Artificial Sequence: Synthetic oligonucleotide
  Target: ATXN1; (-) strand; PAM type: NRG; PAM sequence: TGG
aaataaagatacaagcattg

SEQ ID NO: 49035 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaataaagatac

SEQ ID NO: 49036 - DNA, 20 bp, Artificial Sequence
  Description of Artificial Sequence: Synthetic oligonucleotide
  Target: ATXN1; (-) strand; PAM type: NRG; PAM sequence: AAG
gagcaggaaaaaaaaaaata

SEQ ID NO: 49037 - DNA, 20 bp, Artificial Sequence
  Description of Artificial Sequence: Synthetic oligonucleotide
  Target: ATXN1; (-) strand; PAM type: NRG; PAM sequence: AGG
atcataggaaggcaatgagc

SEQ ID NO: 49038 - DNA, 20 bp, Artificial Sequence
  Description of Artificial Sequence: Synthetic oligonucleotide
  Target: ATXN1; (-) strand; PAM type: NRG; PAM sequence: CAG
tatcataggaaggcaatgag

SEQ ID NO: 49039 - DNA, 20 bp, Artificial Sequence
  Description of Artificial Sequence: Synthetic oligonucleotide
  Target: ATXN1; (-) strand; PAM type: NRG; PAM sequence: GAG
tagtatcataggaaggcaat

SEQ ID NO: 49040 - DNA, 20 bp, Artificial Sequence
  Description of Artificial Sequence: Synthetic oligonucleotide
  Target: ATXN1; (-) strand; PAM type: NRG; PAM sequence: AGG
cttaaattagtatcatagga

SEQ ID NO: 49041 - DNA, 20 bp, Artificial Sequence
  Description of Artificial Sequence: Synthetic oligonucleotide
  Target: ATXN1; (-) strand; PAM type: NRG; PAM sequence: AAG
tcttaaattagtatcatagg

SEQ ID NO: 49042 - DNA, 20 bp, Artificial Sequence
  Description of Artificial Sequence: Synthetic oligonucleotide
  Target: ATXN1; (-) strand; PAM type: NRG; PAM sequence: AGG
aactcttaaattagtatcat

SEQ ID NO: 49043 - DNA, 20 bp, Artificial Sequence
  Description of Artificial Sequence: Synthetic oligonucleotide
  Target: ATXN1; (-) strand; PAM type: NRG; PAM sequence: TAG
gaactcttaaattagtatca

SEQ ID NO: 49044 - DNA, 20 bp, Artificial Sequence
  Description of Artificial Sequence: Synthetic oligonucleotide
  Target: ATXN1; (-) strand; PAM type: NRG; PAM sequence: TAG
gtttgaaagaactcttaaat

SEQ ID NO: 49045 - DNA, 20 bp, Artificial Sequence
  Description of Artificial Sequence: Synthetic oligonucleotide
  Target: ATXN1; (-) strand; PAM type: NRG; PAM sequence: AAG
agagctaaatttgggtttga

SEQ ID NO: 49046 - DNA, 20 bp, Artificial Sequence
  Description of Artificial Sequence: Synthetic oligonucleotide
  Target: ATXN1; (-) strand; PAM type: NRG; PAM sequence: GGG
gggcacacagagctaaattt

SEQ ID NO: 49047 - DNA, 20 bp, Artificial Sequence
  Description of Artificial Sequence: Synthetic oligonucleotide
  Target: ATXN1; (-) strand; PAM type: NRG; PAM sequence: TGG
tgggcacacagagctaaatt

SEQ ID NO: 49048 - DNA, 20 bp, Artificial Sequence
  Description of Artificial Sequence: Synthetic oligonucleotide
  Target: ATXN1; (-) strand; PAM type: NRG; PAM sequence: GAG
gcaatctaggtgggcacaca

SEQ ID NO: 49049 - DNA, 20 bp, Artificial Sequence
  Description of Artificial Sequence: Synthetic oligonucleotide
  Target: ATXN1; (-) strand; PAM type: NRG; PAM sequence: CAG
gagcaatctaggtgggcaca

SEQ ID NO: 49050 - DNA, 20 bp, Artificial Sequence
  Description of Artificial Sequence: Synthetic oligonucleotide
  Target: ATXN1; (-) strand; PAM type: NRG; PAM sequence: GGG
attcccagagcaatctaggt

SEQ ID NO: 49051 - DNA, 20 bp, Artificial Sequence
  Description of Artificial Sequence: Synthetic oligonucleotide
  Target: ATXN1; (-) strand; PAM type: NRG; PAM sequence: TGG
aattcccagagcaatctagg

SEQ ID NO: 49052 - DNA, 20 bp, Artificial Sequence
  Description of Artificial Sequence: Synthetic oligonucleotide
  Target: ATXN1; (-) strand; PAM type: NRG; PAM sequence: AGG
ttcaattcccagagcaatct

SEQ ID NO: 49053 - DNA, 20 bp, Artificial Sequence
  Description of Artificial Sequence: Synthetic oligonucleotide
  Target: ATXN1; (-) strand; PAM type: NRG; PAM sequence: TAG
tttcaattcccagagcaatc

SEQ ID NO: 49054 - DNA, 20 bp, Artificial Sequence
  Description of Artificial Sequence: Synthetic oligonucleotide
  Target: ATXN1; (-) strand; PAM type: NRG; PAM sequence: GAG
ttggactatttcaattccca

SEQ ID NO: 49055 - DNA, 20 bp, Artificial Sequence
  Description of Artificial Sequence: Synthetic oligonucleotide
  Target: ATXN1; (-) strand; PAM type: NRG; PAM sequence: CAG
gcttggactatttcaattcc

SEQ ID NO: 49056 - DNA, 20 bp, Artificial Sequence
  Description of Artificial Sequence: Synthetic oligonucleotide
  Target: ATXN1; (-) strand; PAM type: NRG; PAM sequence: TGG
attttccaaagcaaatagct

SEQ ID NO: 49057 - DNA, 20 bp, Artificial Sequence
  Description of Artificial Sequence: Synthetic oligonucleotide
  Target: ATXN1; (-) strand; PAM type: NRG; PAM sequence: TAG
agtatattttccaaagcaaa

SEQ ID NO: 49058 - DNA, 20 bp, Artificial Sequence
  Description of Artificial Sequence: Synthetic oligonucleotide
  Target: ATXN1; (-) strand; PAM type: NRG; PAM sequence: AAG
acaatggagtatattttcca

SEQ ID NO: 49059 - DNA, 20 bp, Artificial Sequence
  Description of Artificial Sequence: Synthetic oligonucleotide
  Target: ATXN1; (-) strand; PAM type: NRG; PAM sequence: GAG
taggcctttcattcacaatg

SEQ ID NO: 49060 - DNA, 20 bp, Artificial Sequence
  Description of Artificial Sequence: Synthetic oligonucleotide
  Target: ATXN1; (-) strand; PAM type: NRG; PAM sequence: TGG
cataggcctttcattcacaa

SEQ ID NO: 49061 - DNA, 20 bp, Artificial Sequence
  Description of Artificial Sequence: Synthetic oligonucleotide
  Target: ATXN1; (-) strand; PAM type: NRG; PAM sequence: AGG
gaaggaaacaccttggccat

SEQ ID NO: 49062 - DNA, 20 bp, Artificial Sequence
  Description of Artificial Sequence: Synthetic oligonucleotide
  Target: ATXN1; (-) strand; PAM type: NRG; PAM sequence: TAG
agaaggaaacaccttggcca

SEQ ID NO: 49063 - DNA, 20 bp, Artificial Sequence
  Description of Artificial Sequence: Synthetic oligonucleotide
  Target: ATXN1; (-) strand; PAM type: NRG; PAM sequence: TGG
tgtgccagaaggaaacacct

SEQ ID NO: 49064 - DNA, 20 bp, Artificial Sequence
  Description of Artificial Sequence: Synthetic oligonucleotide
  Target: ATXN1; (-) strand; PAM type: NRG; PAM sequence: AGG
ttctcttttcttgtgccaga

SEQ ID NO: 49065 - DNA, 20 bp, Artificial Sequence
  Description of Artificial Sequence: Synthetic oligonucleotide
  Target: ATXN1; (-) strand; PAM type: NRG; PAM sequence: AAG
tttctcttttcttgtgccag

SEQ ID NO: 49066 - DNA, 20 bp, Artificial Sequence
  Description of Artificial Sequence: Synthetic oligonucleotide
  Target: ATXN1; (-) strand; PAM type: NRG; PAM sequence: CAG
tcttttctcttttcttgtgc

SEQ ID NO: 49067 - DNA, 20 bp, Artificial Sequence
  Description of Artificial Sequence: Synthetic oligonucleotide
  Target: ATXN1; (-) strand; PAM type: NRG; PAM sequence: CAG
aacagatagtccatttttat

SEQ ID NO: 49068 - DNA, 20 bp, Artificial Sequence
  Description of Artificial Sequence: Synthetic oligonucleotide
  Target: ATXN1; (-) strand; PAM type: NRG; PAM sequence: TAG
tctgtaggtaattgaacaga

SEQ ID NO: 49069 - DNA, 20 bp, Artificial Sequence
  Description of Artificial Sequence: Synthetic oligonucleotide
  Target: ATXN1; (-) strand; PAM type: NRG; PAM sequence: CAG
gaaatctgtaggtaattgaa

SEQ ID NO: 49070 - DNA, 20 bp, Artificial Sequence
  Description of Artificial Sequence: Synthetic oligonucleotide
  Target: ATXN1; (-) strand; PAM type: NRG; PAM sequence: AGG
aagcccagtgggaaatctgt

SEQ ID NO: 49071 - DNA, 20 bp, Artificial Sequence
  Description of Artificial Sequence: Synthetic oligonucleotide
  Target: ATXN1; (-) strand; PAM type: NRG; PAM sequence: TAG
aaagcccagtgggaaatctg

SEQ ID NO: 49072 - DNA, 20 bp, Artificial Sequence
  Description of Artificial Sequence: Synthetic oligonucleotide
  Target: ATXN1; (-) strand; PAM type: NRG; PAM sequence: GGG
tttctaaagtaaagcccagt

SEQ ID NO: 49073 - DNA, 20 bp, Artificial Sequence
  Description of Artificial Sequence: Synthetic oligonucleotide
  Target: ATXN1; (-) strand; PAM type: NRG; PAM sequence: TGG
ctttctaaagtaaagcccag

SEQ ID NO: 49074 - DNA, 20 bp, Artificial Sequence
  Description of Artificial Sequence: Synthetic oligonucleotide
  Target: ATXN1; (-) strand; PAM type: NRG; PAM sequence: CAG
caactttctaaagtaaagcc

SEQ ID NO: 49075 - DNA, 20 bp, Artificial Sequence
  Description of Artificial Sequence: Synthetic oligonucleotide
  Target: ATXN1; (-) strand; PAM type: NRG; PAM sequence: AAG
ctgtacaactttctaaagta

SEQ ID NO: 49076 - DNA, 20 bp, Artificial Sequence
  Description of Artificial Sequence: Synthetic oligonucleotide
  Target: ATXN1; (-) strand; PAM type: NRG; PAM sequence: AAG
ttaacctgtacaactttcta

SEQ ID NO: 49077 - DNA, 20 bp, Artificial Sequence
  Description of Artificial Sequence: Synthetic oligonucleotide
  Target: ATXN1; (-) strand; PAM type: NRG; PAM sequence: TAG
cagtgcccagggcttgtgga

SEQ ID NO: 49078 - DNA, 20 bp, Artificial Sequence
  Description of Artificial Sequence: Synthetic oligonucleotide
  Target: ATXN1; (-) strand; PAM type: NRG; PAM sequence: TGG
gcaccagtgcccagggcttg

SEQ ID NO: 49079 - DNA, 20 bp, Artificial Sequence
  Description of Artificial Sequence: Synthetic oligonucleotide
  Target: ATXN1; (-) strand; PAM type: NRG; PAM sequence: GGG
ccatggggcaccagtgccca

SEQ ID NO: 49080 - DNA, 20 bp, Artificial Sequence
  Description of Artificial Sequence: Synthetic oligonucleotide
  Target: ATXN1; (-) strand; PAM type: NRG; PAM sequence: AGG
gccatggggcaccagtgccc

SEQ ID NO: 49081 - DNA, 20 bp, Artificial Sequence
  Description of Artificial Sequence: Synthetic oligonucleotide
  Target: ATXN1; (-) strand; PAM type: NRG; PAM sequence: CAG
tgccatggggcaccagtgcc

SEQ ID NO: 49082 - DNA, 20 bp, Artificial Sequence
  Description of Artificial Sequence: Synthetic oligonucleotide
  Target: ATXN1; (-) strand; PAM type: NRG; PAM sequence: CAG
gcagctgtgccatggggcac

SEQ ID NO: 49083 - DNA, 20 bp, Artificial Sequence
  Description of Artificial Sequence: Synthetic oligonucleotide
  Target: ATXN1; (-) strand; PAM type: NRG; PAM sequence: GGG
ccgcaggcagctgtgccatg

SEQ ID NO: 49084 - DNA, 20 bp, Artificial Sequence
  Description of Artificial Sequence: Synthetic oligonucleotide
  Target: ATXN1; (-) strand; PAM type: NRG; PAM sequence: GGG
cccgcaggcagctgtgccat

SEQ ID NO: 49085 - DNA, 20 bp, Artificial Sequence
  Description of Artificial Sequence: Synthetic oligonucleotide
  Target: ATXN1; (-) strand; PAM type: NRG; PAM sequence: TGG
tcccgcaggcagctgtgcca

SEQ ID NO: 49086 - DNA, 20 bp, Artificial Sequence
  Description of Artificial Sequence: Synthetic oligonucleotide
  Target: ATXN1; (-) strand; PAM type: NRG; PAM sequence: CAG
accatgtgccatcccgcagg

SEQ ID NO: 49087 - DNA, 20 bp, Artificial Sequence
  Description of Artificial Sequence: Synthetic oligonucleotide
  Target: ATXN1; (-) strand; PAM type: NRG; PAM sequence: AGG
tgtaccatgtgccatcccgc

SEQ ID NO: 49088 - DNA, 20 bp, Artificial Sequence
  Description of Artificial Sequence: Synthetic oligonucleotide
  Target: ATXN1; (-) strand; PAM type: NRG; PAM sequence: CAG
gtgtaccatgtgccatcccg

SEQ ID NO: 49089 - DNA, 20 bp, Artificial Sequence
  Description of Artificial Sequence: Synthetic oligonucleotide
  Target: ATXN1; (-) strand; PAM type: NRG; PAM sequence: TAG
tctaataataagtgtgctat

SEQ ID NO: 49090 - DNA, 20 bp, Artificial Sequence
  Description of Artificial Sequence: Synthetic oligonucleotide
  Target: ATXN1; (-) strand; PAM type: NRG; PAM sequence: AAG
catgcagaaaatctaataat

SEQ ID NO: 49091 - DNA, 20 bp, Artificial Sequence
  Description of Artificial Sequence: Synthetic oligonucleotide
  Target: ATXN1; (-) strand; PAM type: NRG; PAM sequence: CAG
tgtaggcttatgtaaccatg

SEQ ID NO: 49092 - DNA, 20 bp, Artificial Sequence
  Description of Artificial Sequence: Synthetic oligonucleotide
  Target: ATXN1; (-) strand; PAM type: NRG; PAM sequence: AGG
tttacatttttcccttttgt

SEQ ID NO: 49093 - DNA, 20 bp, Artificial Sequence
  Description of Artificial Sequence: Synthetic oligonucleotide
  Target: ATXN1; (-) strand; PAM type: NRG; PAM sequence: TAG
atttacatttttcccttttg

SEQ ID NO: 49094 - DNA, 20 bp, Artificial Sequence
  Description of Artificial Sequence: Synthetic oligonucleotide
  Target: ATXN1; (-) strand; PAM type: NRG; PAM sequence: AAG
gatttcatgagaaccgcatg

SEQ ID NO: 49095 - DNA, 20 bp, Artificial Sequence
  Description of Artificial Sequence: Synthetic oligonucleotide
  Target: ATXN1; (-) strand; PAM type: NRG; PAM sequence: GAG
taagatattaaagatttcat

SEQ ID NO: 49096 - DNA, 20 bp, Artificial Sequence
  Description of Artificial Sequence: Synthetic oligonucleotide
  Target: ATXN1; (-) strand; PAM type: NRG; PAM sequence: AAG
tcctaagtcttaagatatta

SEQ ID NO: 49097 - DNA, 20 bp, Artificial Sequence
  Description of Artificial Sequence: Synthetic oligonucleotide
  Target: ATXN1; (-) strand; PAM type: NRG; PAM sequence: AAG
gagagttcttcctaagtctt

SEQ ID NO: 49098 - DNA, 20 bp, Artificial Sequence
  Description of Artificial Sequence: Synthetic oligonucleotide
  Target: ATXN1; (-) strand; PAM type: NRG; PAM sequence: AAG
ttgccaggagagttcttcct

SEQ ID NO: 49099 - DNA, 20 bp, Artificial Sequence
  Description of Artificial Sequence: Synthetic oligonucleotide
  Target: ATXN1; (-) strand; PAM type: NRG; PAM sequence: GAG
ttgatcgtatcttgccagga

SEQ ID NO: 49100 - DNA, 20 bp, Artificial Sequence
  Description of Artificial Sequence: Synthetic oligonucleotide
  Target: ATXN1; (-) strand; PAM type: NRG; PAM sequence: GAG
aattgatcgtatcttgccag

SEQ ID NO: 49101 - DNA, 20 bp, Artificial Sequence
  Description of Artificial Sequence: Synthetic oligonucleotide
  Target: ATXN1; (-) strand; PAM type: NRG; PAM sequence: AGG
aaaattgatcgtatcttgcc

SEQ ID NO: 49102 - DNA, 20 bp, Artificial Sequence
  Description of Artificial Sequence: Synthetic oligonucleotide
  Target: ATXN1; (-) strand; PAM type: NRG; PAM sequence: CAG
gaaaattgatcgtatcttgc

SEQ ID NO: 49103 - DNA, 20 bp, Artificial Sequence
  Description of Artificial Sequence: Synthetic oligonucleotide
  Target: ATXN1; (-) strand; PAM type: NRG; PAM sequence: AAG
aaagggcttttttcctaatg

SEQ ID NO: 49104 - DNA, 20 bp, Artificial Sequence
  Description of Artificial Sequence: Synthetic oligonucleotide
  Target: ATXN1; (-) strand; PAM type: NRG; PAM sequence: GGG
tttctgtaacattactgaaa

SEQ ID NO: 49105 - DNA, 20 bp, Artificial Sequence
  Description of Artificial Sequence: Synthetic oligonucleotide
  Target: ATXN1; (-) strand; PAM type: NRG; PAM sequence: AGG
atttctgtaacattactgaa

SEQ ID NO: 49106 - DNA, 20 bp, Artificial Sequence
  Description of Artificial Sequence: Synthetic oligonucleotide
  Target: ATXN1; (-) strand; PAM type: NRG; PAM sequence: AAG
catttctgtaacattactga

SEQ ID NO: 49107 - DNA, 20 bp, Artificial Sequence
  Description of Artificial Sequence: Synthetic oligonucleotide
  Target: ATXN1; (-) strand; PAM type: NRG; PAM sequence: TAG
ttttttctctcttttgccta

SEQ ID NO: 49108 - DNA, 20 bp, Artificial Sequence
  Description of Artificial Sequence: Synthetic oligonucleotide
  Target: ATXN1; (-) strand; PAM type: NRG; PAM sequence: GAG
ttggggttttgttcagtcca

SEQ ID NO: 49109 - DNA, 20 bp, Artificial Sequence
  Description of Artificial Sequence: Synthetic oligonucleotide
  Target: ATXN1; (-) strand; PAM type: NRG; PAM sequence: CAG
ccttggggttttgttcagtc

SEQ ID NO: 49110 - DNA, 20 bp, Artificial Sequence
  Description of Artificial Sequence: Synthetic oligonucleotide
  Target: ATXN1; (-) strand; PAM type: NRG; PAM sequence: CAG
aagtgccttggggttttgtt

SEQ ID NO: 49111 - DNA, 20 bp, Artificial Sequence
  Description of Artificial Sequence: Synthetic oligonucleotide
  Target: ATXN1; (-) strand; PAM type: NRG; PAM sequence: GGG
atttagtccaaagtgccttg

SEQ ID NO: 49112 - DNA, 20 bp, Artificial Sequence
  Description of Artificial Sequence: Synthetic oligonucleotide
  Target: ATXN1; (-) strand; PAM type: NRG; PAM sequence: GGG
gatttagtccaaagtgcctt

SEQ ID NO: 49113 - DNA, 20 bp, Artificial Sequence
  Description of Artificial Sequence: Synthetic oligonucleotide
  Target: ATXN1; (-) strand; PAM type: NRG; PAM sequence: TGG
ggatttagtccaaagtgcct

SEQ ID NO: 49114 - DNA, 20 bp, Artificial Sequence
  Description of Artificial Sequence: Synthetic oligonucleotide
  Target: ATXN1; (-) strand; PAM type: NRG; PAM sequence: AAG
caaagaaaggatttagtcca

SEQ ID NO: 49115 - DNA, 20 bp, Artificial Sequence
  Description of Artificial Sequence: Synthetic oligonucleotide
  Target: ATXN1; (-) strand; PAM type: NRG; PAM sequence: TAG
gtgggtacaaagaaaggatt

SEQ ID NO: 49116 - DNA, 20 bp, Artificial Sequence
  Description of Artificial Sequence: Synthetic oligonucleotide
  Target: ATXN1; (-) strand; PAM type: NRG; PAM sequence: AGG
tatgctgtgggtacaaagaa

SEQ ID NO: 49117 - DNA, 20 bp, Artificial Sequence
  Description of Artificial Sequence: Synthetic oligonucleotide
  Target: ATXN1; (-) strand; PAM type: NRG; PAM sequence: AAG
atatgctgtgggtacaaaga

SEQ ID NO: 49118 - DNA, 20 bp, Artificial Sequence
  Description of Artificial Sequence: Synthetic oligonucleotide
  Target: ATXN1; (-) strand; PAM type: NRG; PAM sequence: AAG
tcagatatgctgtgggtaca

SEQ ID NO: 49119 - DNA, 20 bp, Artificial Sequence
  Description of Artificial Sequence: Synthetic oligonucleotide
  Target: ATXN1; (-) strand; PAM type: NRG; PAM sequence: GGG
tctcctttcagatatgctgt

SEQ ID NO: 49120 - DNA, 20 bp, Artificial Sequence
  Description of Artificial Sequence: Synthetic oligonucleotide
  Target: ATXN1; (-) strand; PAM type: NRG; PAM sequence: TGG
ttctcctttcagatatgctg

SEQ ID NO: 49121 - DNA, 20 bp, Artificial Sequence
  Description of Artificial Sequence: Synthetic oligonucleotide
  Target: ATXN1; (-) strand; PAM type: NRG; PAM sequence: CAG
gtgagcattgcttctccttt

SEQ ID NO: 49122 - DNA, 20 bp, Artificial Sequence
  Description of Artificial Sequence: Synthetic oligonucleotide
  Target: ATXN1; (-) strand; PAM type: NRG; PAM sequence: GAG
aatccccacacaccccaagt

SEQ ID NO: 49123 - DNA, 20 bp, Artificial Sequence
  Description of Artificial Sequence: Synthetic oligonucleotide
  Target: ATXN1; (-) strand; PAM type: NRG; PAM sequence: AAG
atacaatccccacacacccc

SEQ ID NO: 49124 - DNA, 20 bp, Artificial Sequence
  Description of Artificial Sequence: Synthetic oligonucleotide
  Target: ATXN1; (-) strand; PAM type: NRG; PAM sequence: TAG
aattctgtgggtagacaggc

SEQ ID NO: 49125 - DNA, 20 bp, Artificial Sequence
  Description of Artificial Sequence: Synthetic oligonucleotide
  Target: ATXN1; (-) strand; PAM type: NRG; PAM sequence: AGG
atgaaattctgtgggtagac

SEQ ID NO: 49126 - DNA, 20 bp, Artificial Sequence
  Description of Artificial Sequence: Synthetic oligonucleotide
  Target: ATXN1; (-) strand; PAM type: NRG; PAM sequence: CAG
aatgaaattctgtgggtaga

SEQ ID NO: 49127 - DNA, 20 bp, Artificial Sequence
  Description of Artificial Sequence: Synthetic oligonucleotide
  Target: ATXN1; (-) strand; PAM type: NRG; PAM sequence: TAG
attaaatgaaattctgtggg

SEQ ID NO: 49128 - DNA, 20 bp, Artificial Sequence
  Description of Artificial Sequence: Synthetic oligonucleotide
  Target: ATXN1; (-) strand; PAM type: NRG; PAM sequence: GGG
tagattaaatgaaattctgt

SEQ ID NO: 49129 - DNA, 20 bp, Artificial Sequence
  Description of Artificial Sequence: Synthetic oligonucleotide
  Target: ATXN1; (-) strand; PAM type: NRG; PAM sequence: TGG
ctagattaaatgaaattctg

SEQ ID NO: 49130 - DNA, 20 bp, Artificial Sequence
  Description of Artificial Sequence: Synthetic oligonucleotide
  Target: ATXN1; (-) strand; PAM type: NRG; PAM sequence: TAG
agattgataacaactccacc

SEQ ID NO: 49131 - DNA, 20 bp, Artificial Sequence
  Description of Artificial Sequence: Synthetic oligonucleotide
  Target: ATXN1; (-) strand; PAM type: NRG; PAM sequence: CAG
caaatttgtgaaagactaaa

SEQ ID NO: 49132 - DNA, 20 bp, Artificial Sequence
  Description of Artificial Sequence: Synthetic oligonucleotide
  Target: ATXN1; (-) strand; PAM type: NRG; PAM sequence: AAG
cagtcccttcaaatttgtga

SEQ ID NO: 49133 - DNA, 20 bp, Artificial Sequence
  Description of Artificial Sequence: Synthetic oligonucleotide
  Target: ATXN1; (-) strand; PAM type: NRG; PAM sequence: CAG
gtgattgttggtttaagcta

SEQ ID NO: 49134 - DNA, 20 bp, Artificial Sequence
  Description of Artificial Sequence: Synthetic oligonucleotide
  Target: ATXN1; (-) strand; PAM type: NRG; PAM sequence: AAG
ttgagggtgattgttggttt

SEQ ID NO: 49135 - DNA, 20 bp, Artificial Sequence
  Description of Artificial Sequence: Synthetic oligonucleotide
  Target: ATXN1; (-) strand; PAM type: NRG; PAM sequence: TGG
aatgctttgagggtgattgt

SEQ ID NO: 49136 - DNA, 20 bp, Artificial Sequence
  Description of Artificial Sequence: Synthetic oligonucleotide
  Target: ATXN1; (-) strand; PAM type: NRG; PAM sequence: GGG
atatcattgcaatgctttga

SEQ ID NO: 49137 - DNA, 20 bp, Artificial Sequence
  Description of Artificial Sequence: Synthetic oligonucleotide
  Target: ATXN1; (-) strand; PAM type: NRG; PAM sequence: AGG
catatcattgcaatgctttg

SEQ ID NO: 49138 - DNA, 20 bp, Artificial Sequence
  Description of Artificial Sequence: Synthetic oligonucleotide
  Target: ATXN1; (-) strand; PAM type: NRG; PAM sequence: GAG
tcatatcattgcaatgcttt

SEQ ID NO: 49139 - DNA, 20 bp, Artificial Sequence
  Description of Artificial Sequence: Synthetic oligonucleotide
  Target: ATXN1; (-) strand; PAM type: NRG; PAM sequence: CAG
cacctccacaggccccatgt

SEQ ID NO: 49140 - DNA, 20 bp, Artificial Sequence
  Description of Artificial Sequence: Synthetic oligonucleotide
  Target: ATXN1; (-) strand; PAM type: NRG; PAM sequence: AGG
caccattttcccacctccac

SEQ ID NO: 49141 - DNA, 20 bp, Artificial Sequence
  Description of Artificial Sequence: Synthetic oligonucleotide
  Target: ATXN1; (-) strand; PAM type: NRG; PAM sequence: CAG
ccaccattttcccacctcca

SEQ ID NO: 49142 - DNA, 20 bp, Artificial Sequence
  Description of Artificial Sequence: Synthetic oligonucleotide
  Target: ATXN1; (-) strand; PAM type: NRG; PAM sequence: TGG
tgcagaaattcaagtgtata

SEQ ID NO: 49143 - DNA, 20 bp, Artificial Sequence
  Description of Artificial Sequence: Synthetic oligonucleotide
  Target: ATXN1; (-) strand; PAM type: NRG; PAM sequence: AAG
ctctgcctttgcagaaattc

SEQ ID NO: 49144 - DNA, 20 bp, Artificial Sequence
  Description of Artificial Sequence: Synthetic oligonucleotide
  Target: ATXN1; (-) strand; PAM type: NRG; PAM sequence: CAG
ataatttgcctctgcctttg

SEQ ID NO: 49145 - DNA, 20 bp, Artificial Sequence
  Description of Artificial Sequence: Synthetic oligonucleotide
  Target: ATXN1; (-) strand; PAM type: NRG; PAM sequence: AGG
aaatgaaaaggaaagcggga

SEQ ID NO: 49146 - DNA, 20 bp, Artificial Sequence
  Description of Artificial Sequence: Synthetic oligonucleotide
  Target: ATXN1; (-) strand; PAM type: NRG; PAM sequence: AAG
taaatgaaaaggaaagcggg

SEQ ID NO: 49147 - DNA, 20 bp, Artificial Sequence
  Description of Artificial Sequence: Synthetic oligonucleotide
  Target: ATXN1; (-) strand; PAM type: NRG; PAM sequence: GGG
ttttaaatgaaaaggaaagc

SEQ ID NO: 49148 - DNA, 20 bp, Artificial Sequence
  Description of Artificial Sequence: Synthetic oligonucleotide
  Target: ATXN1; (-) strand; PAM type: NRG; PAM sequence: CGG
attttaaatgaaaaggaaag

SEQ ID NO: 49149 - DNA, 20 bp, Artificial Sequence
  Description of Artificial Sequence: Synthetic oligonucleotide
  Target: ATXN1; (-) strand; PAM type: NRG; PAM sequence: AAG
tagattttaaatgaaaagga

SEQ ID NO: 49150 - DNA, 20 bp, Artificial Sequence
  Description of Artificial Sequence: Synthetic oligonucleotide
  Target: ATXN1; (-) strand; PAM type: NRG; PAM sequence: AGG
gctgtagattttaaatgaaa

SEQ ID NO: 49151 - DNA, 20 bp, Artificial Sequence
  Description of Artificial Sequence: Synthetic oligonucleotide
  Target: ATXN1; (-) strand; PAM type: NRG; PAM sequence: AAG
agctgtagattttaaatgaa

SEQ ID NO: 49152 - DNA, 20 bp, Artificial Sequence
  Description of Artificial Sequence: Synthetic oligonucleotide
  Target: ATXN1; (-) strand; PAM type: NRG; PAM sequence: TAG
gaaattgtcttgaaaagctg

SEQ ID NO: 49153 - DNA, 20 bp, Artificial Sequence
  Description of Artificial Sequence: Synthetic oligonucleotide
  Target: ATXN1; (-) strand; PAM type: NRG; PAM sequence: AAG
taaagggaaattgtcttgaa

SEQ ID NO: 49154 - DNA, 20 bp, Artificial Sequence
  Description of Artificial Sequence: Synthetic oligonucleotide
  Target: ATXN1; (-) strand; PAM type: NRG; PAM sequence: GGG
ctcgattctcctgaaataaa

SEQ ID NO: 49155 - DNA, 20 bp, Artificial Sequence
  Description of Artificial Sequence: Synthetic oligonucleotide
  Target: ATXN1; (-) strand; PAM type: NRG; PAM sequence: AGG
tctcgattctcctgaaataa

SEQ ID NO: 49156 - DNA, 20 bp, Artificial Sequence
  Description of Artificial Sequence: Synthetic oligonucleotide
  Target: ATXN1; (-) strand; PAM type: NRG; PAM sequence: AAG
ttctcgattctcctgaaata

SEQ ID NO: 49157 - DNA, 20 bp, Artificial Sequence
  Description of Artificial Sequence: Synthetic oligonucleotide
  Target: ATXN1; (-) strand; PAM type: NRG; PAM sequence: AAG
ataatgtaaatgatgtgctt

SEQ ID NO: 49158 - DNA, 20 bp, Artificial Sequence
  Description of Artificial Sequence: Synthetic oligonucleotide
  Target: ATXN1; (-) strand; PAM type: NRG; PAM sequence: CAG
tttgtcaactattcaagtgt

SEQ ID NO: 49159 - DNA, 20 bp, Artificial Sequence
  Description of Artificial Sequence: Synthetic oligonucleotide
  Target: ATXN1; (-) strand; PAM type: NRG; PAM sequence: AAG
tcagagtttgtcaactattc

SEQ ID NO: 49160 - DNA, 20 bp, Artificial Sequence
  Description of Artificial Sequence: Synthetic oligonucleotide
  Target: ATXN1; (-) strand; PAM type: NRG; PAM sequence: GAG
gtttaaaagaagtgatttca

SEQ ID NO: 49161 - DNA, 20 bp, Artificial Sequence
  Description of Artificial Sequence: Synthetic oligonucleotide
  Target: ATXN1; (-) strand; PAM type: NRG; PAM sequence: CAG
aggtttaaaagaagtgattt

SEQ ID NO: 49162 - DNA, 20 bp, Artificial Sequence
  Description of Artificial Sequence: Synthetic oligonucleotide
  Target: ATXN1; (-) strand; PAM type: NRG; PAM sequence: AAG
atcaacattaggtttaaaag

SEQ ID NO: 49163 - DNA, 20 bp, Artificial Sequence
  Description of Artificial Sequence: Synthetic oligonucleotide
  Target: ATXN1; (-) strand; PAM type: NRG; PAM sequence: AAG
ggtatcaacattaggtttaa

SEQ ID NO: 49164 - DNA, 20 bp, Artificial Sequence
  Description of Artificial Sequence: Synthetic oligonucleotide
  Target: ATXN1; (-) strand; PAM type: NRG; PAM sequence: AGG
tagaatttggtatcaacatt

SEQ ID NO: 49165 - DNA, 20 bp, Artificial Sequence
  Description of Artificial Sequence: Synthetic oligonucleotide
  Target: ATXN1; (-) strand; PAM type: NRG; PAM sequence: TAG
gtagaatttggtatcaacat

SEQ ID NO: 49166 - DNA, 20 bp, Artificial Sequence
  Description of Artificial Sequence: Synthetic oligonucleotide
  Target: ATXN1; (-) strand; PAM type: NRG; PAM sequence: TGG
tgagtccaaaaagtagaatt

SEQ ID NO: 49167 - DNA, 20 bp, Artificial Sequence
  Description of Artificial Sequence: Synthetic oligonucleotide
  Target: ATXN1; (-) strand; PAM type: NRG; PAM sequence: TAG
gtttttttgagtccaaaaag

SEQ ID NO: 49168 - DNA, 20 bp, Artificial Sequence
  Description of Artificial Sequence: Synthetic oligonucleotide
  Target: ATXN1; (-) strand; PAM type: NRG; PAM sequence: AAG
actgtttttttgagtccaaa

SEQ ID NO: 49169 - DNA, 20 bp, Artificial Sequence
  Description of Artificial Sequence: Synthetic oligonucleotide
  Target: ATXN1; (-) strand; PAM type: NRG; PAM sequence: GAG
attctaaagactgttttttt

SEQ ID NO: 49170 - DNA, 20 bp, Artificial Sequence
  Description of Artificial Sequence: Synthetic oligonucleotide
  Target: ATXN1; (-) strand; PAM type: NRG; PAM sequence: AAG
ttttaaattgaacaattcta

SEQ ID NO: 49171 - DNA, 20 bp, Artificial Sequence
  Description of Artificial Sequence: Synthetic oligonucleotide
  Target: ATXN1; (-) strand; PAM type: NRG; PAM sequence: AGG
tatataactacagtatgaca

SEQ ID NO: 49172 - DNA, 20 bp, Artificial Sequence
  Description of Artificial Sequence: Synthetic oligonucleotide
  Target: ATXN1; (-) strand; PAM type: NRG; PAM sequence: AAG
atatataactacagtatgac

SEQ ID NO: 49173 - DNA, 20 bp, Artificial Sequence
  Description of Artificial Sequence: Synthetic oligonucleotide
  Target: ATXN1; (-) strand; PAM type: NRG; PAM sequence: CAG
tccttgagtatatataacta

SEQ ID NO: 49174 - DNA, 20 bp, Artificial Sequence
  Description of Artificial Sequence: Synthetic oligonucleotide
  Target: ATXN1; (-) strand; PAM type: NRG; PAM sequence: GAG
ctgcatacaataacttcctt

SEQ ID NO: 49175 - DNA, 20 bp, Artificial Sequence
  Description of Artificial Sequence: Synthetic oligonucleotide
  Target: ATXN1; (-) strand; PAM type: NRG; PAM sequence: CAG
ttacctttcaagaatgtctg

SEQ ID NO: 49176 - DNA, 20 bp, Artificial Sequence
  Description of Artificial Sequence: Synthetic oligonucleotide
  Target: ATXN1; (-) strand; PAM type: NRG; PAM sequence: AAG
ttgtatactccttacctttc

SEQ ID NO: 49177 - DNA, 20 bp, Artificial Sequence
  Description of Artificial Sequence: Synthetic oligonucleotide
  Target: ATXN1; (-) strand; PAM type: NRG; PAM sequence: AGG
ctagattgctaggttcctgc

SEQ ID NO: 49178 - DNA, 20 bp, Artificial Sequence
  Description of Artificial Sequence: Synthetic oligonucleotide
  Target: ATXN1; (-) strand; PAM type: NRG; PAM sequence: CAG
gctagattgctaggttcctg

SEQ ID NO: 49179 - DNA, 20 bp, Artificial Sequence
  Description of Artificial Sequence: Synthetic oligonucleotide
  Target: ATXN1; (-) strand; PAM type: NRG; PAM sequence: AGG
cattttgaagctagattgct

SEQ ID NO: 49180 - DNA, 20 bp, Artificial Sequence
  Description of Artificial Sequence: Synthetic oligonucleotide
  Target: ATXN1; (-) strand; PAM type: NRG; PAM sequence: TAG
ccattttgaagctagattgc

SEQ ID NO: 49181 - DNA, 20 bp, Artificial Sequence
  Description of Artificial Sequence: Synthetic oligonucleotide
  Target: ATXN1; (-) strand; PAM type: NRG; PAM sequence: TAG
gaatgaaaccattttgaagc

SEQ ID NO: 49182 - DNA, 20 bp, Artificial Sequence
  Description of Artificial Sequence: Synthetic oligonucleotide
  Target: ATXN1; (-) strand; PAM type: NRG; PAM sequence: AAG
gaatgaatgaaaccattttg

SEQ ID NO: 49183 - DNA, 20 bp, Artificial Sequence
  Description of Artificial Sequence: Synthetic oligonucleotide
  Target: ATXN1; (-) strand; PAM type: NRG; PAM sequence: AAG
tactgaaagtaaattgatgg

SEQ ID NO: 49184 - DNA, 20 bp, Artificial Sequence
  Description of Artificial Sequence: Synthetic oligonucleotide
  Target: ATXN1; (-) strand; PAM type: NRG; PAM sequence: TGG
ggatactgaaagtaaattga

SEQ ID NO: 49185 - DNA, 20 bp, Artificial Sequence
  Description of Artificial Sequence: Synthetic oligonucleotide
  Target: ATXN1; (-) strand; PAM type: NRG; PAM sequence: AAG
ccatatatgagggatactga

SEQ ID NO: 49186 - DNA, 20 bp, Artificial Sequence
  Description of Artificial Sequence: Synthetic oligonucleotide
  Target: ATXN1; (-) strand; PAM type: NRG; PAM sequence: GGG
ggcactaatcccatatatga

SEQ ID NO: 49187 - DNA, 20 bp, Artificial Sequence
  Description of Artificial Sequence: Synthetic oligonucleotide
  Target: ATXN1; (-) strand; PAM type: NRG; PAM sequence: AGG
gggcactaatcccatatatg

SEQ ID NO: 49188 - DNA, 20 bp, Artificial Sequence
  Description of Artificial Sequence: Synthetic oligonucleotide
  Target: ATXN1; (-) strand; PAM type: NRG; PAM sequence: GAG
tgggcactaatcccatatat

SEQ ID NO: 49189 - DNA, 20 bp, Artificial Sequence
  Description of Artificial Sequence: Synthetic oligonucleotide
  Target: ATXN1; (-) strand; PAM type: NRG; PAM sequence: GGG
ctctggggtcccttatagat

SEQ ID NO: 49190 - DNA, 20 bp, Artificial Sequence
  Description of Artificial Sequence: Synthetic oligonucleotide
  Target: ATXN1; (-) strand; PAM type: NRG; PAM sequence: TGG
tctctggggtcccttataga

SEQ ID NO: 49191 - DNA, 20 bp, Artificial Sequence
  Description of Artificial Sequence: Synthetic oligonucleotide
  Target: ATXN1; (-) strand; PAM type: NRG; PAM sequence: TAG
tcgctctctggggtccctta

SEQ ID NO: 49192 - DNA, 20 bp, Artificial Sequence
  Description of Artificial Sequence: Synthetic oligonucleotide
  Target: ATXN1; (-) strand; PAM type: NRG; PAM sequence: GGG
aggagcaaggtcgctctctg

SEQ ID NO: 49193 - DNA, 20 bp, Artificial Sequence
  Description of Artificial Sequence: Synthetic oligonucleotide
  Target: ATXN1; (-) strand; PAM type: NRG; PAM sequence: GGG
aaggagcaaggtcgctctct

SEQ ID NO: 49194 - DNA, 20 bp, Artificial Sequence
  Description of Artificial Sequence: Synthetic oligonucleotide
  Target: ATXN1; (-) strand; PAM type: NRG; PAM sequence: TGG
gaaggagcaaggtcgctctc

SEQ ID NO: 49195 - DNA, 20 bp, Artificial Sequence
  Description of Artificial Sequence: Synthetic oligonucleotide
  Target: ATXN1; (-) strand; PAM type: NRG; PAM sequence: AGG
ctcacatggtggaaggagca

SEQ ID NO: 49196 - DNA, 20 bp, Artificial Sequence
  Description of Artificial Sequence: Synthetic oligonucleotide
  Target: ATXN1; (-) strand; PAM type: NRG; PAM sequence: AAG
cctcacatggtggaaggagc

SEQ ID NO: 49197 - DNA, 20 bp, Artificial Sequence
  Description of Artificial Sequence: Synthetic oligonucleotide
  Target: ATXN1; (-) strand; PAM type: NRG; PAM sequence: GAG
gtgtcctcacatggtggaag

SEQ ID NO: 49198 - DNA, 20 bp, Artificial Sequence
  Description of Artificial Sequence: Synthetic oligonucleotide
  Target: ATXN1; (-) strand; PAM type: NRG; PAM sequence: AGG
gtgtgtcctcacatggtgga

SEQ ID NO: 49199 - DNA, 20 bp, Artificial Sequence
  Description of Artificial Sequence: Synthetic oligonucleotide
  Target: ATXN1; (-) strand; PAM type: NRG; PAM sequence: AAG
ggtgtgtcctcacatggtgg

SEQ ID NO: 49200 - DNA, 20 bp, Artificial Sequence
  Description of Artificial Sequence: Synthetic oligonucleotide
  Target: ATXN1; (-) strand; PAM type: NRG; PAM sequence: TGG
cttggtgtgtcctcacatgg

SEQ ID NO: 49201 - DNA, 20 bp, Artificial Sequence
  Description of Artificial Sequence: Synthetic oligonucleotide
  Target: ATXN1; (-) strand; PAM type: NRG; PAM sequence: TGG
cttcttggtgtgtcctcaca

SEQ ID NO: 49202 - DNA, 20 bp, Artificial Sequence
  Description of Artificial Sequence: Synthetic oligonucleotide
  Target: ATXN1; (-) strand; PAM type: NRG; PAM sequence: TGG
gttcatagatgacaccttct

SEQ ID NO: 49203 - DNA, 20 bp, Artificial Sequence
  Description of Artificial Sequence: Synthetic oligonucleotide
  Target: ATXN1; (-) strand; PAM type: NRG; PAM sequence: TAG
ggtttgatttttttggttca

SEQ ID NO: 49204 - DNA, 20 bp, Artificial Sequence
  Description of Artificial Sequence: Synthetic oligonucleotide
  Target: ATXN1; (-) strand; PAM type: NRG; PAM sequence: TGG
ttggtgaggtttgatttttt

SEQ ID NO: 49205 - DNA, 20 bp, Artificial Sequence
  Description of Artificial Sequence: Synthetic oligonucleotide
  Target: ATXN1; (-) strand; PAM type: NRG; PAM sequence: AGG
agcagcttcaggatttggtg

SEQ ID NO: 49206 - DNA, 20 bp, Artificial Sequence
  Description of Artificial Sequence: Synthetic oligonucleotide
  Target: ATXN1; (-) strand; PAM type: NRG; PAM sequence: GAG
cagcagcttcaggatttggt

SEQ ID NO: 49207 - DNA, 20 bp, Artificial Sequence
  Description of Artificial Sequence: Synthetic oligonucleotide
  Target: ATXN1; (-) strand; PAM type: NRG; PAM sequence: TGG
gtgccagcagcttcaggatt

SEQ ID NO: 49208 - DNA, 20 bp, Artificial Sequence
  Description of Artificial Sequence: Synthetic oligonucleotide
  Target: ATXN1; (-) strand; PAM type: NRG; PAM sequence: AGG
atcaaggtgccagcagcttc

SEQ ID NO: 49209 - DNA, 20 bp, Artificial Sequence
  Description of Artificial Sequence: Synthetic oligonucleotide
  Target: ATXN1; (-) strand; PAM type: NRG; PAM sequence: CAG
gatcaaggtgccagcagctt

SEQ ID NO: 49210 - DNA, 20 bp, Artificial Sequence
  Description of Artificial Sequence: Synthetic oligonucleotide
  Target: ATXN1; (-) strand; PAM type: NRG; PAM sequence: CAG
gtccaagatcaaggtgccag

SEQ ID NO: 49211 - DNA, 20 bp, Artificial Sequence
  Description of Artificial Sequence: Synthetic oligonucleotide
  Target: ATXN1; (-) strand; PAM type: NRG; PAM sequence: CAG
gaagtccaagatcaaggtgc

SEQ ID NO: 49212 - DNA, 20 bp, Artificial Sequence
  Description of Artificial Sequence: Synthetic oligonucleotide
  Target: ATXN1; (-) strand; PAM type: NRG; PAM sequence: AGG
ggctgggaagtccaagatca

SEQ ID NO: 49213 - DNA, 20 bp, Artificial Sequence
  Description of Artificial Sequence: Synthetic oligonucleotide
  Target: ATXN1; (-) strand; PAM type: NRG; PAM sequence: AAG
tggctgggaagtccaagatc

SEQ ID NO: 49214 - DNA, 20 bp, Artificial Sequence
  Description of Artificial Sequence: Synthetic oligonucleotide
  Target: ATXN1; (-) strand; PAM type: NRG; PAM sequence: AAG
tgctggtggctgggaagtcc

SEQ ID NO: 49215 - DNA, 20 bp, Artificial Sequence
  Description of Artificial Sequence: Synthetic oligonucleotide
  Target: ATXN1; (-) strand; PAM type: NRG; PAM sequence: AAG
tcacagtgctggtggctggg

SEQ ID NO: 49216 - DNA, 20 bp, Artificial Sequence
  Description of Artificial Sequence: Synthetic oligonucleotide
  Target: ATXN1; (-) strand; PAM type: NRG; PAM sequence: GGG
ttctcacagtgctggtggct

SEQ ID NO: 49217 - DNA, 20 bp, Artificial Sequence
  Description of Artificial Sequence: Synthetic oligonucleotide
  Target: ATXN1; (-) strand; PAM type: NRG; PAM sequence: TGG
tttctcacagtgctggtggc

SEQ ID NO: 49218 - DNA, 20 bp, Artificial Sequence
  Description of Artificial Sequence: Synthetic oligonucleotide
  Target: ATXN1; (-) strand; PAM type: NRG; PAM sequence: TGG
tacatttctcacagtgctgg

SEQ ID NO: 49219 - DNA, 20 bp, Artificial Sequence
  Description of Artificial Sequence: Synthetic oligonucleotide
  Target: ATXN1; (-) strand; PAM type: NRG; PAM sequence: TGG
aaatacatttctcacagtgc

SEQ ID NO: 49220 - DNA, 20 bp, Artificial Sequence
  Description of Artificial Sequence: Synthetic oligonucleotide
  Target: ATXN1; (-) strand; PAM type: NRG; PAM sequence: CAG
caacagaaatacatttctca

SEQ ID NO: 49221 - DNA, 20 bp, Artificial Sequence
  Description of Artificial Sequence: Synthetic oligonucleotide
  Target: ATXN1; (-) strand; PAM type: NRG; PAM sequence: CAG
taccgtaaacttataaacaa

SEQ ID NO: 49222 - DNA, 20 bp, Artificial Sequence
  Description of Artificial Sequence: Synthetic oligonucleotide
  Target: ATXN1; (-) strand; PAM type: NRG; PAM sequence: AAG
cttagtccatttggactgct

SEQ ID NO: 49223 - DNA, 20 bp, Artificial Sequence
  Description of Artificial Sequence: Synthetic oligonucleotide
  Target: ATXN1; (-) strand; PAM type: NRG; PAM sequence: TGG
tggcagtgtcttagtccatt

SEQ ID NO: 49224 - DNA, 20 bp, Artificial Sequence
  Description of Artificial Sequence: Synthetic oligonucleotide
  Target: ATXN1; (-) strand; PAM type: NRG; PAM sequence: TAG
tttggcttttggcagtgtct

SEQ ID NO: 49225 - DNA, 20 bp, Artificial Sequence
  Description of Artificial Sequence: Synthetic oligonucleotide
  Target: ATXN1; (-) strand; PAM type: NRG; PAM sequence: CAG
gatgtatttttggcttttgg

SEQ ID NO: 49226 - DNA, 20 bp, Artificial Sequence
  Description of Artificial Sequence: Synthetic oligonucleotide
  Target: ATXN1; (-) strand; PAM type: NRG; PAM sequence: TGG
gtggatgtatttttggcttt

SEQ ID NO: 49227 - DNA, 20 bp, Artificial Sequence
  Description of Artificial Sequence: Synthetic oligonucleotide
  Target: ATXN1; (-) strand; PAM type: NRG; PAM sequence: TGG
ctttgaggtggatgtatttt

SEQ ID NO: 49228 - DNA, 20 bp, Artificial Sequence
  Description of Artificial Sequence: Synthetic oligonucleotide
  Target: ATXN1; (-) strand; PAM type: NRG; PAM sequence: TGG
aaacttttcttcctttgagg

SEQ ID NO: 49229 - DNA, 20 bp, Artificial Sequence
  Description of Artificial Sequence: Synthetic oligonucleotide
  Target: ATXN1; (-) strand; PAM type: NRG; PAM sequence: AGG
ttcaaacttttcttcctttg

SEQ ID NO: 49230 - DNA, 20 bp, Artificial Sequence
  Description of Artificial Sequence: Synthetic oligonucleotide
  Target: ATXN1; (-) strand; PAM type: NRG; PAM sequence: GAG
tttcaaacttttcttccttt

SEQ ID NO: 49231 - DNA, 20 bp, Artificial Sequence
  Description of Artificial Sequence: Synthetic oligonucleotide
  Target: ATXN1; (-) strand; PAM type: NRG; PAM sequence: TGG
ccacattcactccagttgaa

SEQ ID NO: 49232 - DNA, 20 bp, Artificial Sequence
  Description of Artificial Sequence: Synthetic oligonucleotide
  Target: ATXN1; (-) strand; PAM type: NRG; PAM sequence: CAG
agagtgtgccacattcactc

SEQ ID NO: 49233 - DNA, 20 bp, Artificial Sequence
  Description of Artificial Sequence: Synthetic oligonucleotide
  Target: ATXN1; (-) strand; PAM type: NRG; PAM sequence: GAG
ttctcccaggcagagaacaa

SEQ ID NO: 49234 - DNA, 20 bp, Artificial Sequence
  Description of Artificial Sequence: Synthetic oligonucleotide
  Target: ATXN1; (-) strand; PAM type: NRG; PAM sequence: AAG
tgttctcccaggcagagaac

SEQ ID NO: 49235 - DNA, 20 bp, Artificial Sequence
  Description of Artificial Sequence: Synthetic oligonucleotide
  Target: ATXN1; (-) strand; PAM type: NRG; PAM sequence: GAG
ctgacttgttctcccaggca

SEQ ID NO: 49236 - DNA, 20 bp, Artificial Sequence
  Description of Artificial Sequence: Synthetic oligonucleotide
  Target: ATXN1; (-) strand; PAM type: NRG; PAM sequence: CAG
agctgacttgttctcccagg

SEQ ID NO: 49237 - DNA, 20 bp, Artificial Sequence
  Description of Artificial Sequence: Synthetic oligonucleotide
  Target: ATXN1; (-) strand; PAM type: NRG; PAM sequence: AGG
atcagctgacttgttctccc

SEQ ID NO: 49238 - DNA, 20 bp, Artificial Sequence
  Description of Artificial Sequence: Synthetic oligonucleotide
  Target: ATXN1; (-) strand; PAM type: NRG; PAM sequence: CAG
tatcagctgacttgttctcc

SEQ ID NO: 49239 - DNA, 20 bp, Artificial Sequence
  Description of Artificial Sequence: Synthetic oligonucleotide
  Target: ATXN1; (-) strand; PAM type: NRG; PAM sequence: CAG
acagaaaagcaggctcatat

SEQ ID NO: 49240 - DNA, 20 bp, Artificial Sequence
  Description of Artificial Sequence: Synthetic oligonucleotide
  Target: ATXN1; (-) strand; PAM type: NRG; PAM sequence: AGG
cattcttcacacagaaaagc

SEQ ID NO: 49241 - DNA, 20 bp, Artificial Sequence
  Description of Artificial Sequence: Synthetic oligonucleotide
  Target: ATXN1; (-) strand; PAM type: NRG; PAM sequence: CAG
acattcttcacacagaaaag

SEQ ID NO: 49242 - DNA, 20 bp, Artificial Sequence
  Description of Artificial Sequence: Synthetic oligonucleotide
  Target: ATXN1; (-) strand; PAM type: NRG; PAM sequence: AAG
tgtacattcttcacacagaa

SEQ ID NO: 49243 - DNA, 20 bp, Artificial Sequence
  Description of Artificial Sequence: Synthetic oligonucleotide
  Target: ATXN1; (-) strand; PAM type: NRG; PAM sequence: CAG
aactctgtacattcttcaca

SEQ ID NO: 49244 - DNA, 20 bp, Artificial Sequence
  Description of Artificial Sequence: Synthetic oligonucleotide
  Target: ATXN1; (-) strand; PAM type: NRG; PAM sequence: AGG
ggaaggatgagggaagaaga

SEQ ID NO: 49245 - DNA, 20 bp, Artificial Sequence
  Description of Artificial Sequence: Synthetic oligonucleotide
  Target: ATXN1; (-) strand; PAM type: NRG; PAM sequence: AAG
gggaaggatgagggaagaag

SEQ ID NO: 49246 - DNA, 20 bp, Artificial Sequence
  Description of Artificial Sequence: Synthetic oligonucleotide
  Target: ATXN1; (-) strand; PAM type: NRG; PAM sequence: AAG
aatgggaaggatgagggaag

SEQ ID NO: 49247 - DNA, 20 bp, Artificial Sequence
  Description of Artificial Sequence: Synthetic oligonucleotide
  Target: ATXN1; (-) strand; PAM type: NRG; PAM sequence: AAG
agcaatgggaaggatgaggg

SEQ ID NO: 49248 - DNA, 20 bp, Artificial Sequence
  Description of Artificial Sequence: Synthetic oligonucleotide
  Target: ATXN1; (-) strand; PAM type: NRG; PAM sequence: GGG
cacagcaatgggaaggatga

SEQ ID NO: 49249 - DNA, 20 bp, Artificial Sequence
  Description of Artificial Sequence: Synthetic oligonucleotide
  Target: ATXN1; (-) strand; PAM type: NRG; PAM sequence: AGG
gcacagcaatgggaaggatg

SEQ ID NO: 49250 - DNA, 20 bp, Artificial Sequence
  Description of Artificial Sequence: Synthetic oligonucleotide
  Target: ATXN1; (-) strand; PAM type: NRG; PAM sequence: GAG
tgcacagcaatgggaaggat

SEQ ID NO: 49251 - DNA, 20 bp, Artificial Sequence
  Description of Artificial Sequence: Synthetic oligonucleotide
  Target: ATXN1; (-) strand; PAM type: NRG; PAM sequence: AGG
gaaggtgcacagcaatggga

SEQ ID NO: 49252 - DNA, 20 bp, Artificial Sequence
  Description of Artificial Sequence: Synthetic oligonucleotide
  Target: ATXN1; (-) strand; PAM type: NRG; PAM sequence: AAG
tgaaggtgcacagcaatggg

SEQ ID NO: 49253 - DNA, 20 bp, Artificial Sequence
  Description of Artificial Sequence: Synthetic oligonucleotide
  Target: ATXN1; (-) strand; PAM type: NRG; PAM sequence: GGG
ccatgaaggtgcacagcaat

SEQ ID NO: 49254 - DNA, 20 bp, Artificial Sequence
  Description of Artificial Sequence: Synthetic oligonucleotide
  Target: ATXN1; (-) strand; PAM type: NRG; PAM sequence: TGG
cccatgaaggtgcacagcaa

SEQ ID NO: 49255 - DNA, 20 bp, Artificial Sequence
  Description of Artificial Sequence: Synthetic oligonucleotide
  Target: ATXN1; (-) strand; PAM type: NRG; PAM sequence: CAG
gtatgacccatgaaggtgca

SEQ ID NO: 49256 - DNA, 20 bp, Artificial Sequence
  Description of Artificial Sequence: Synthetic oligonucleotide
  Target: ATXN1; (-) strand; PAM type: NRG; PAM sequence: AGG
ataacctgtatgacccatga

SEQ ID NO: 49257 - DNA, 20 bp, Artificial Sequence
  Description of Artificial Sequence: Synthetic oligonucleotide
  Target: ATXN1; (-) strand; PAM type: NRG; PAM sequence: AAG
tataacctgtatgacccatg

SEQ ID NO: 49258 - DNA, 20 bp, Artificial Sequence
  Description of Artificial Sequence: Synthetic oligonucleotide
  Target: ATXN1; (-) strand; PAM type: NRG; PAM sequence: CGG
cctgttcagctctgaccctc

SEQ ID NO: 49259 - DNA, 20 bp, Artificial Sequence
  Description of Artificial Sequence: Synthetic oligonucleotide
  Target: ATXN1; (-) strand; PAM type: NRG; PAM sequence: CAG
aacagcggctgtagcctgtt

SEQ ID NO: 49260 - DNA, 20 bp, Artificial Sequence
  Description of Artificial Sequence: Synthetic oligonucleotide
  Target: ATXN1; (-) strand; PAM type: NRG; PAM sequence: TAG
ctcttggtgaacagcggctg

SEQ ID NO: 49261 - DNA, 20 bp, Artificial Sequence
  Description of Artificial Sequence: Synthetic oligonucleotide
  Target: ATXN1; (-) strand; PAM type: NRG; PAM sequence: CGG
catgggctcttggtgaacag

SEQ ID NO: 49262 - DNA, 20 bp, Artificial Sequence
  Description of Artificial Sequence: Synthetic oligonucleotide
  Target: ATXN1; (-) strand; PAM type: NRG; PAM sequence: CAG
gaccatgggctcttggtgaa

SEQ ID NO: 49263 - DNA, 20 bp, Artificial Sequence
  Description of Artificial Sequence: Synthetic oligonucleotide
  Target: ATXN1; (-) strand; PAM type: NRG; PAM sequence: TGG
cccgcgagaccatgggctct

SEQ ID NO: 49264 - DNA, 20 bp, Artificial Sequence
  Description of Artificial Sequence: Synthetic oligonucleotide
  Target: ATXN1; (-) strand; PAM type: NRG; PAM sequence: GGG
ctgtctccccgcgagaccat

SEQ ID NO: 49265 - DNA, 20 bp, Artificial Sequence
  Description of Artificial Sequence: Synthetic oligonucleotide
  Target: ATXN1; (-) strand; PAM type: NRG; PAM sequence: TGG
tctgtctccccgcgagacca

SEQ ID NO: 49266 - DNA, 20 bp, Artificial Sequence
  Description of Artificial Sequence: Synthetic oligonucleotide
  Target: ATXN1; (-) strand; PAM type: NRG; PAM sequence: GAG
cttggtgtctgtctccccgc

SEQ ID NO: 49267 - DNA, 20 bp, Artificial Sequence
  Description of Artificial Sequence: Synthetic oligonucleotide
  Target: ATXN1; (-) strand; PAM type: NRG; PAM sequence: TGG
agtgagctgtgatggtttct

SEQ ID NO: 49268 - DNA, 20 bp, Artificial Sequence
  Description of Artificial Sequence: Synthetic oligonucleotide
  Target: ATXN1; (-) strand; PAM type: NRG; PAM sequence: TGG
ctaatcccagtgagctgtga

SEQ ID NO: 49269 - DNA, 20 bp, Artificial Sequence
  Description of Artificial Sequence: Synthetic oligonucleotide
  Target: ATXN1; (-) strand; PAM type: NRG; PAM sequence: GAG
agtggagcactaatcccagt

SEQ ID NO: 49270 - DNA, 20 bp, Artificial Sequence
  Description of Artificial Sequence: Synthetic oligonucleotide
  Target: ATXN1; (-) strand; PAM type: NRG; PAM sequence: CAG
ccccagtggagcactaatcc

SEQ ID NO: 49271 - DNA, 20 bp, Artificial Sequence
  Description of Artificial Sequence: Synthetic oligonucleotide
  Target: ATXN1; (-) strand; PAM type: NRG; PAM sequence: GAG
ccattcagctacccccagtg

SEQ ID NO: 49272 - DNA, 20 bp, Artificial Sequence
  Description of Artificial Sequence: Synthetic oligonucleotide
  Target: ATXN1; (-) strand; PAM type: NRG; PAM sequence: TGG
caccattcagctacccccag

SEQ ID NO: 49273 - DNA, 20 bp, Artificial Sequence
  Description of Artificial Sequence: Synthetic oligonucleotide
  Target: ATXN1; (-) strand; PAM type: NRG; PAM sequence: CAG
gagcaccattcagctacccc

SEQ ID NO: 49274 - DNA, 20 bp, Artificial Sequence
  Description of Artificial Sequence: Synthetic oligonucleotide
  Target: ATXN1; (-) strand; PAM type: NRG; PAM sequence: CAG
tctgctcttagagcaccatt

SEQ ID NO: 49275 - DNA, 20 bp, Artificial Sequence
  Description of Artificial Sequence: Synthetic oligonucleotide
  Target: ATXN1; (-) strand; PAM type: NRG; PAM sequence: GAG
cttgttcctctctgctctta

SEQ ID NO: 49276 - DNA, 20 bp, Artificial Sequence
  Description of Artificial Sequence: Synthetic oligonucleotide
  Target: ATXN1; (-) strand; PAM type: NRG; PAM sequence: TAG
gtcttgttcctctctgctct

SEQ ID NO: 49277 - DNA, 20 bp, Artificial Sequence
  Description of Artificial Sequence: Synthetic oligonucleotide
  Target: ATXN1; (-) strand; PAM type: NRG; PAM sequence: TAG
tgcacacaggcgtacagaga

SEQ ID NO: 49278 - DNA, 20 bp, Artificial Sequence
  Description of Artificial Sequence: Synthetic oligonucleotide
  Target: ATXN1; (-) strand; PAM type: NRG; PAM sequence: GAG
cctgtgcacacaggcgtaca

SEQ ID NO: 49279 - DNA, 20 bp, Artificial Sequence
  Description of Artificial Sequence: Synthetic oligonucleotide
  Target: ATXN1; (-) strand; PAM type: NRG; PAM sequence: CAG
ctcctgtgcacacaggcgta

SEQ ID NO: 49280 - DNA, 20 bp, Artificial Sequence
  Description of Artificial Sequence: Synthetic oligonucleotide
  Target: ATXN1; (-) strand; PAM type: NRG; PAM sequence: AGG
ccacccgctcctgtgcacac

SEQ ID NO: 49281 - DNA, 20 bp, Artificial Sequence
  Description of Artificial Sequence: Synthetic oligonucleotide
  Target: ATXN1; (-) strand; PAM type: NRG; PAM sequence: CAG
accacccgctcctgtgcaca

SEQ ID NO: 49282 - DNA, 20 bp, Artificial Sequence
  Description of Artificial Sequence: Synthetic oligonucleotide
  Target: ATXN1; (-) strand; PAM type: NRG; PAM sequence: CAG
ctgtgccacattcctgtcag

SEQ ID NO: 49283 - DNA, 20 bp, Artificial Sequence
  Description of Artificial Sequence: Synthetic oligonucleotide
  Target: ATXN1; (-) strand; PAM type: NRG; PAM sequence: CAG
tctctgtgccacattcctgt

SEQ ID NO: 49284 - DNA, 20 bp, Artificial Sequence
  Description of Artificial Sequence: Synthetic oligonucleotide
  Target: ATXN1; (-) strand; PAM type: NRG; PAM sequence: CAG
tttgctcatctttcaggatt

SEQ ID NO: 49285 - DNA, 20 bp, Artificial Sequence
  Description of Artificial Sequence: Synthetic oligonucleotide
  Target: ATXN1; (-) strand; PAM type: NRG; PAM sequence: AGG
aactgctttgctcatctttc

SEQ ID NO: 49286 - DNA, 20 bp, Artificial Sequence
  Description of Artificial Sequence: Synthetic oligonucleotide
  Target: ATXN1; (-) strand; PAM type: NRG; PAM sequence: CAG
taactgctttgctcatcttt

SEQ ID NO: 49287 - DNA, 20 bp, Artificial Sequence
  Description of Artificial Sequence: Synthetic oligonucleotide
  Target: ATXN1; (-) strand; PAM type: NRG; PAM sequence: TGG
aaatgctgcccttctgtctt

SEQ ID NO: 49288 - DNA, 20 bp, Artificial Sequence
  Description of Artificial Sequence: Synthetic oligonucleotide
  Target: ATXN1; (-) strand; PAM type: NRG; PAM sequence: CAG
atagttttacaagcattttt

SEQ ID NO: 49289 - DNA, 20 bp, Artificial Sequence
  Description of Artificial Sequence: Synthetic oligonucleotide
  Target: ATXN1; (-) strand; PAM type: NRG; PAM sequence: AAG
ctatgccgccatagttttac

SEQ ID NO: 49290 - DNA, 20 bp, Artificial Sequence
  Description of Artificial Sequence: Synthetic oligonucleotide
  Target: ATXN1; (-) strand; PAM type: NRG; PAM sequence: TAG
gtgcttatgctatgccgcca

SEQ ID NO: 49291 - DNA, 20 bp, Artificial Sequence
  Description of Artificial Sequence: Synthetic oligonucleotide
  Target: ATXN1; (-) strand; PAM type: NRG; PAM sequence: TGG
gtggagccttagcaaatcac

SEQ ID NO: 49292 - DNA, 20 bp, Artificial Sequence
  Description of Artificial Sequence: Synthetic oligonucleotide
  Target: ATXN1; (-) strand; PAM type: NRG; PAM sequence: TAG
tgaaagacctggtggagcct

SEQ ID NO: 49293 - DNA, 20 bp, Artificial Sequence
  Description of Artificial Sequence: Synthetic oligonucleotide
  Target: ATXN1; (-) strand; PAM type: NRG; PAM sequence: GAG
taaccctgaaagacctggtg

SEQ ID NO: 49294 - DNA, 20 bp, Artificial Sequence
  Description of Artificial Sequence: Synthetic oligonucleotide
  Target: ATXN1; (-) strand; PAM type: NRG; PAM sequence: TGG
tctaaccctgaaagacctgg

SEQ ID NO: 49295 - DNA, 20 bp, Artificial Sequence
  Description of Artificial Sequence: Synthetic oligonucleotide
  Target: ATXN1; (-) strand; PAM type: NRG; PAM sequence: TGG
tgttctaaccctgaaagacc

SEQ ID NO: 49296 - DNA, 20 bp, Artificial Sequence
  Description of Artificial Sequence: Synthetic oligonucleotide
  Target: ATXN1; (-) strand; PAM type: NRG; PAM sequence: AAG
atgctctgttctaaccctga

SEQ ID NO: 49297 - DNA, 20 bp, Artificial Sequence
  Description of Artificial Sequence: Synthetic oligonucleotide
  Target: ATXN1; (-) strand; PAM type: NRG; PAM sequence: GAG
gagctctagtttcccaaatg

SEQ ID NO: 49298 - DNA, 20 bp, Artificial Sequence
  Description of Artificial Sequence: Synthetic oligonucleotide
  Target: ATXN1; (-) strand; PAM type: NRG; PAM sequence: TGG
tagagctctagtttcccaaa

SEQ ID NO: 49299 - DNA, 20 bp, Artificial Sequence
  Description of Artificial Sequence: Synthetic oligonucleotide
  Target: ATXN1; (-) strand; PAM type: NRG; PAM sequence: TAG
gcagaaggcgcttagagctc

SEQ ID NO: 49300 - DNA, 20 bp, Artificial Sequence
  Description of Artificial Sequence: Synthetic oligonucleotide
  Target: ATXN1; (-) strand; PAM type: NRG; PAM sequence: GAG
aagtaggcagaaggcgctta

SEQ ID NO: 49301 - DNA, 20 bp, Artificial Sequence
  Description of Artificial Sequence: Synthetic oligonucleotide
  Target: ATXN1; (-) strand; PAM type: NRG; PAM sequence: TAG
tgaagtaggcagaaggcgct

SEQ ID NO: 49302 - DNA, 20 bp, Artificial Sequence
  Description of Artificial Sequence: Synthetic oligonucleotide
  Target: ATXN1; (-) strand; PAM type: NRG; PAM sequence: AGG
cttgccatgaagtaggcaga

SEQ ID NO: 49303 - DNA, 20 bp, Artificial Sequence
  Description of Artificial Sequence: Synthetic oligonucleotide
  Target: ATXN1; (-) strand; PAM type: NRG; PAM sequence: AAG
ccttgccatgaagtaggcag

SEQ ID NO: 49304 - DNA, 20 bp, Artificial Sequence
  Description of Artificial Sequence: Synthetic oligonucleotide
  Target: ATXN1; (-) strand; PAM type: NRG; PAM sequence: CAG
cctccttgccatgaagtagg

SEQ ID NO: 49305 - DNA, 20 bp, Artificial Sequence
  Description of Artificial Sequence: Synthetic oligonucleotide
  Target: ATXN1; (-) strand; PAM type: NRG; PAM sequence: AGG
ggccctccttgccatgaagt

SEQ ID NO: 49306 - DNA, 20 bp, Artificial Sequence
  Description of Artificial Sequence: Synthetic oligonucleotide
  Target: ATXN1; (-) strand; PAM type: NRG; PAM sequence: TAG
tggccctccttgccatgaag

SEQ ID NO: 49307 - DNA, 20 bp, Artificial Sequence
  Description of Artificial Sequence: Synthetic oligonucleotide
  Target: ATXN1; (-) strand; PAM type: NRG; PAM sequence: AAG
agatggccctccttgccatg

SEQ ID NO: 49308 - DNA, 20 bp, Artificial Sequence
  Description of Artificial Sequence: Synthetic oligonucleotide
  Target: ATXN1; (-) strand; PAM type: NRG; PAM sequence: TGG
agggctggtggtgcccgaga

SEQ ID NO: 49309 - DNA, 20 bp, Artificial Sequence
  Description of Artificial Sequence: Synthetic oligonucleotide
  Target: ATXN1; (-) strand; PAM type: NRG; PAM sequence: GAG
atagagggctggtggtgccc

SEQ ID NO: 49310 - DNA, 20 bp, Artificial Sequence
  Description of Artificial Sequence: Synthetic oligonucleotide
  Target: ATXN1; (-) strand; PAM type: NRG; PAM sequence: TGG
tggctgccatagagggctgg

SEQ ID NO: 49311 - DNA, 20 bp, Artificial Sequence
  Description of Artificial Sequence: Synthetic oligonucleotide
  Target: ATXN1; (-) strand; PAM type: NRG; PAM sequence: TGG
ccatggctgccatagagggc

SEQ ID NO: 49312 - DNA, 20 bp, Artificial Sequence
  Description of Artificial Sequence: Synthetic oligonucleotide
  Target: ATXN1; (-) strand; PAM type: NRG; PAM sequence: GGG
agccccatggctgccataga

SEQ ID NO: 49313 - DNA, 20 bp, Artificial Sequence
  Description of Artificial Sequence: Synthetic oligonucleotide
  Target: ATXN1; (-) strand; PAM type: NRG; PAM sequence: AGG
gagccccatggctgccatag

SEQ ID NO: 49314 - DNA, 20 bp, Artificial Sequence
  Description of Artificial Sequence: Synthetic oligonucleotide
  Target: ATXN1; (-) strand; PAM type: NRG; PAM sequence: GAG
cgagccccatggctgccata

SEQ ID NO: 49315 - DNA, 20 bp, Artificial Sequence
  Description of Artificial Sequence: Synthetic oligonucleotide
  Target: ATXN1; (-) strand; PAM type: NRG; PAM sequence: TAG
aacgagccccatggctgcca

SEQ ID NO: 49316 - DNA, 20 bp, Artificial Sequence
  Description of Artificial Sequence: Synthetic oligonucleotide
  Target: ATXN1; (-) strand; PAM type: NRG; PAM sequence: TGG
gaggatatgaacgagcccca

SEQ ID NO: 49317 - DNA, 20 bp, Artificial Sequence
  Description of Artificial Sequence: Synthetic oligonucleotide
  Target: ATXN1; (-) strand; PAM type: NRG; PAM sequence: GAG
tgggccaggaggatatgaac

SEQ ID NO: 49318 - DNA, 20 bp, Artificial Sequence
  Description of Artificial Sequence: Synthetic oligonucleotide
  Target: ATXN1; (-) strand; PAM type: NRG; PAM sequence: AGG
acaggttgtggtgggccagg

SEQ ID NO: 49319 - DNA, 20 bp, Artificial Sequence
  Description of Artificial Sequence: Synthetic oligonucleotide
  Target: ATXN1; (-) strand; PAM type: NRG; PAM sequence: GAG
cacaggttgtggtgggccag

SEQ ID NO: 49320 - DNA, 20 bp, Artificial Sequence
  Description of Artificial Sequence: Synthetic oligonucleotide
  Target: ATXN1; (-) strand; PAM type: NRG; PAM sequence: AGG
cacacaggttgtggtgggcc

SEQ ID NO: 49321 - DNA, 20 bp, Artificial Sequence
  Description of Artificial Sequence: Synthetic oligonucleotide
  Target: ATXN1; (-) strand; PAM type: NRG; PAM sequence: CAG
gcacacaggttgtggtgggc

SEQ ID NO: 49322 - DNA, 20 bp, Artificial Sequence
  Description of Artificial Sequence: Synthetic oligonucleotide
  Target: ATXN1; (-) strand; PAM type: NRG; PAM sequence: GGG
acctgcacacaggttgtggt

SEQ ID NO: 49323 - DNA, 20 bp, Artificial Sequence
  Description of Artificial Sequence: Synthetic oligonucleotide
  Target: ATXN1; (-) strand; PAM type: NRG; PAM sequence: TGG
tacctgcacacaggttgtgg

SEQ ID NO: 49324 - DNA, 20 bp, Artificial Sequence
  Description of Artificial Sequence: Synthetic oligonucleotide
  Target: ATXN1; (-) strand; PAM type: NRG; PAM sequence: TGG
gagtacctgcacacaggttg

SEQ ID NO: 49325 - DNA, 20 bp, Artificial Sequence
  Description of Artificial Sequence: Synthetic oligonucleotide
  Target: ATXN1; (-) strand; PAM type: NRG; PAM sequence: AGG
tggcctgagtacctgcacac

SEQ ID NO: 49326 - DNA, 20 bp, Artificial Sequence
  Description of Artificial Sequence: Synthetic oligonucleotide
  Target: ATXN1; (-) strand; PAM type: NRG; PAM sequence: CAG
gtggcctgagtacctgcaca

SEQ ID NO: 49327 - DNA, 20 bp, Artificial Sequence
  Description of Artificial Sequence: Synthetic oligonucleotide
  Target: ATXN1; (-) strand; PAM type: NRG; PAM sequence: GAG
aaagggaagcagtgtggcct

SEQ ID NO: 49328 - DNA, 20 bp, Artificial Sequence
  Description of Artificial Sequence: Synthetic oligonucleotide
  Target: ATXN1; (-) strand; PAM type: NRG; PAM sequence: TGG
atagacaaagggaagcagtg

SEQ ID NO: 49329 - DNA, 20 bp, Artificial Sequence
  Description of Artificial Sequence: Synthetic oligonucleotide
  Target: ATXN1; (-) strand; PAM type: NRG; PAM sequence: CAG
ctggcatagacaaagggaag

SEQ ID NO: 49330 - DNA, 20 bp, Artificial Sequence
  Description of Artificial Sequence: Synthetic oligonucleotide
  Target: ATXN1; (-) strand; PAM type: NRG; PAM sequence: AAG
cacctggcatagacaaaggg

SEQ ID NO: 49331 - DNA, 20 bp, Artificial Sequence
  Description of Artificial Sequence: Synthetic oligonucleotide
  Target: ATXN1; (-) strand; PAM type: NRG; PAM sequence: GGG
ggccacctggcatagacaaa

SEQ ID NO: 49332 - DNA, 20 bp, Artificial Sequence
  Description of Artificial Sequence: Synthetic oligonucleotide
  Target: ATXN1; (-) strand; PAM type: NRG; PAM sequence: AGG
aggccacctggcatagacaa

SEQ ID NO: 49333 - DNA, 20 bp, Artificial Sequence
  Description of Artificial Sequence: Synthetic oligonucleotide
  Target: ATXN1; (-) strand; PAM type: NRG; PAM sequence: AAG
aaggccacctggcatagaca

SEQ ID NO: 49334 - DNA, 20 bp, Artificial Sequence
  Description of Artificial Sequence: Synthetic oligonucleotide
  Target: ATXN1; (-) strand; PAM type: NRG; PAM sequence: TAG
aagaataaggccacctggca

SEQ ID NO: 49335 - DNA, 20 bp, Artificial Sequence
  Description of Artificial Sequence: Synthetic oligonucleotide
  Target: ATXN1; (-) strand; PAM type: NRG; PAM sequence: TGG
ctttgaagaataaggccacc

SEQ ID NO: 49336 - DNA, 20 bp, Artificial Sequence
  Description of Artificial Sequence: Synthetic oligonucleotide
  Target: ATXN1; (-) strand; PAM type: NRG; PAM sequence: AGG
ggccagagctttgaagaata

SEQ ID NO: 49337 - DNA, 20 bp, Artificial Sequence
  Description of Artificial Sequence: Synthetic oligonucleotide
  Target: ATXN1; (-) strand; PAM type: NRG; PAM sequence: AAG
tggccagagctttgaagaat

SEQ ID NO: 49338 - DNA, 20 bp, Artificial Sequence
  Description of Artificial Sequence: Synthetic oligonucleotide
  Target: ATXN1; (-) strand; PAM type: NRG; PAM sequence: AAG
agaacttggccagagctttg

SEQ ID NO: 49339 - DNA, 20 bp, Artificial Sequence
  Description of Artificial Sequence: Synthetic oligonucleotide
  Target: ATXN1; (-) strand; PAM type: NRG; PAM sequence: GAG
caagaattagaacttggcca

SEQ ID NO: 49340 - DNA, 20 bp, Artificial Sequence
  Description of Artificial Sequence: Synthetic oligonucleotide
  Target: ATXN1; (-) strand; PAM type: NRG; PAM sequence: CAG
tgcaagaattagaacttggc

SEQ ID NO: 49341 - DNA, 20 bp, Artificial Sequence
  Description of Artificial Sequence: Synthetic oligonucleotide
  Target: ATXN1; (-) strand; PAM type: NRG; PAM sequence: TGG
cacgtgcaagaattagaact

SEQ ID NO: 49342 - DNA, 20 bp, Artificial Sequence
  Description of Artificial Sequence: Synthetic oligonucleotide
  Target: ATXN1; (-) strand; PAM type: NRG; PAM sequence: TAG
agtaaggcacgtgcaagaat

SEQ ID NO: 49343 - DNA, 20 bp, Artificial Sequence
  Description of Artificial Sequence: Synthetic oligonucleotide
  Target: ATXN1; (-) strand; PAM type: NRG; PAM sequence: AAG
ttagcaagtaaggcacgtgc

SEQ ID NO: 49344 - DNA, 20 bp, Artificial Sequence
  Description of Artificial Sequence: Synthetic oligonucleotide
  Target: ATXN1; (-) strand; PAM type: NRG; PAM sequence: AGG
tgggtaggagttagcaagta

SEQ ID NO: 49345 - DNA, 20 bp, Artificial Sequence
  Description of Artificial Sequence: Synthetic oligonucleotide
  Target: ATXN1; (-) strand; PAM type: NRG; PAM sequence: AAG
ctgggtaggagttagcaagt

SEQ ID NO: 49346 - DNA, 20 bp, Artificial Sequence
  Description of Artificial Sequence: Synthetic oligonucleotide
  Target: ATXN1; (-) strand; PAM type: NRG; PAM sequence: AAG
gttgctgggtaggagttagc

SEQ ID NO: 49347 - DNA, 20 bp, Artificial Sequence
  Description of Artificial Sequence: Synthetic oligonucleotide
  Target: ATXN1; (-) strand; PAM type: NRG; PAM sequence: TAG
ctgagttgctgggtaggagt

SEQ ID NO: 49348 - DNA, 20 bp, Artificial Sequence
  Description of Artificial Sequence: Synthetic oligonucleotide
  Target: ATXN1; (-) strand; PAM type: NRG; PAM sequence: GAG
tgttctgagttgctgggtag

SEQ ID NO: 49349 - DNA, 20 bp, Artificial Sequence
  Description of Artificial Sequence: Synthetic oligonucleotide
  Target: ATXN1; (-) strand; PAM type: NRG; PAM sequence: AGG
aatgttctgagttgctgggt

SEQ ID NO: 49350 - DNA, 20 bp, Artificial Sequence
  Description of Artificial Sequence: Synthetic oligonucleotide
  Target: ATXN1; (-) strand; PAM type: NRG; PAM sequence: TAG
taatgttctgagttgctggg

SEQ ID NO: 49351 - DNA, 20 bp, Artificial Sequence
  Description of Artificial Sequence: Synthetic oligonucleotide
  Target: ATXN1; (-) strand; PAM type: NRG; PAM sequence: GGG
agttaatgttctgagttgct

SEQ ID NO: 49352 - DNA, 20 bp, Artificial Sequence
  Description of Artificial Sequence: Synthetic oligonucleotide
  Target: ATXN1; (-) strand; PAM type: NRG; PAM sequence: TGG
cagttaatgttctgagttgc

SEQ ID NO: 49353 - DNA, 20 bp, Artificial Sequence
  Description of Artificial Sequence: Synthetic oligonucleotide
  Target: ATXN1; (-) strand; PAM type: NRG; PAM sequence: GAG
gtacaatcagttaatgttct

SEQ ID NO: 49354 - DNA, 20 bp, Artificial Sequence
  Description of Artificial Sequence: Synthetic oligonucleotide
  Target: ATXN1; (-) strand; PAM type: NRG; PAM sequence: CAG
gaccaggggagtggtacaat

SEQ ID NO: 49355 - DNA, 20 bp, Artificial Sequence
  Description of Artificial Sequence: Synthetic oligonucleotide
  Target: ATXN1; (-) strand; PAM type: NRG; PAM sequence: TGG
gttaggacagaccaggggag

SEQ ID NO: 49356 - DNA, 20 bp, Artificial Sequence
  Description of Artificial Sequence: Synthetic oligonucleotide
  Target: ATXN1; (-) strand; PAM type: NRG; PAM sequence: GAG
tgagttaggacagaccaggg

SEQ ID NO: 49357 - DNA, 20 bp, Artificial Sequence
  Description of Artificial Sequence: Synthetic oligonucleotide
  Target: ATXN1; (-) strand; PAM type: NRG; PAM sequence: GGG
tctgagttaggacagaccag

SEQ ID NO: 49358 - DNA, 20 bp, Artificial Sequence
  Description of Artificial Sequence: Synthetic oligonucleotide
  Target: ATXN1; (-) strand; PAM type: NRG; PAM sequence: GGG
atctgagttaggacagacca

SEQ ID NO: 49359 - DNA, 20 bp, Artificial Sequence
  Description of Artificial Sequence: Synthetic oligonucleotide
  Target: ATXN1; (-) strand; PAM type: NRG; PAM sequence: AGG
tatctgagttaggacagacc

SEQ ID NO: 49360 - DNA, 20 bp, Artificial Sequence
  Description of Artificial Sequence: Synthetic oligonucleotide
  Target: ATXN1; (-) strand; PAM type: NRG; PAM sequence: CAG
gtatctgagttaggacagac

SEQ ID NO: 49361 - DNA, 20 bp, Artificial Sequence
  Description of Artificial Sequence: Synthetic oligonucleotide
  Target: ATXN1; (-) strand; PAM type: NRG; PAM sequence: CAG
aggcagtatctgagttagga

SEQ ID NO: 49362 - DNA, 20 bp, Artificial Sequence
  Description of Artificial Sequence: Synthetic oligonucleotide
  Target: ATXN1; (-) strand; PAM type: NRG; PAM sequence: AGG
cacaaggcagtatctgagtt

SEQ ID NO: 49363 - DNA, 20 bp, Artificial Sequence
  Description of Artificial Sequence: Synthetic oligonucleotide
  Target: ATXN1; (-) strand; PAM type: NRG; PAM sequence: TAG
acacaaggcagtatctgagt

SEQ ID NO: 49364 - DNA, 20 bp, Artificial Sequence
  Description of Artificial Sequence: Synthetic oligonucleotide
  Target: ATXN1; (-) strand; PAM type: NRG; PAM sequence: GAG
tatgacacaaggcagtatct

SEQ ID NO: 49365 - DNA, 20 bp, Artificial Sequence
  Description of Artificial Sequence: Synthetic oligonucleotide
  Target: ATXN1; (-) strand; PAM type: NRG; PAM sequence: CAG
gttgcttttatgacacaagg

SEQ ID NO: 49366 - DNA, 20 bp, Artificial Sequence
  Description of Artificial Sequence: Synthetic oligonucleotide
  Target: ATXN1; (-) strand; PAM type: NRG; PAM sequence: AGG
tatgttgcttttatgacaca

SEQ ID NO: 49367 - DNA, 20 bp, Artificial Sequence
  Description of Artificial Sequence: Synthetic oligonucleotide
  Target: ATXN1; (-) strand; PAM type: NRG; PAM sequence: AAG
gtatgttgcttttatgacac

SEQ ID NO: 49368 - DNA, 20 bp, Artificial Sequence
  Description of Artificial Sequence: Synthetic oligonucleotide
  Target: ATXN1; (-) strand; PAM type: NRG; PAM sequence: AGG
tagcatggtatctaaatcta

SEQ ID NO: 49369 - DNA, 20 bp, Artificial Sequence
  Description of Artificial Sequence: Synthetic oligonucleotide
  Target: ATXN1; (-) strand; PAM type: NRG; PAM sequence: AAG
atagcatggtatctaaatct

SEQ ID NO: 49370 - DNA, 20 bp, Artificial Sequence
  Description of Artificial Sequence: Synthetic oligonucleotide
  Target: ATXN1; (-) strand; PAM type: NRG; PAM sequence: TGG
gtgcttggtaagtcatagca

SEQ ID NO: 49371 - DNA, 20 bp, Artificial Sequence
  Description of Artificial Sequence: Synthetic oligonucleotide
  Target: ATXN1; (-) strand; PAM type: NRG; PAM sequence: TAG
ataaagtgcttggtaagtca

SEQ ID NO: 49372 - DNA, 20 bp, Artificial Sequence
  Description of Artificial Sequence: Synthetic oligonucleotide
  Target: ATXN1; (-) strand; PAM type: NRG; PAM sequence: AAG
tatattataaagtgcttggt

SEQ ID NO: 49373 - DNA, 20 bp, Artificial Sequence
  Description of Artificial Sequence: Synthetic oligonucleotide
  Target: ATXN1; (-) strand; PAM type: NRG; PAM sequence: TGG
aatgtatattataaagtgct

SEQ ID NO: 49374 - DNA, 20 bp, Artificial Sequence
  Description of Artificial Sequence: Synthetic oligonucleotide
  Target: ATXN1; (-) strand; PAM type: NRG; PAM sequence: AAG
agggtataatgtatattata

SEQ ID NO: 49375 - DNA, 20 bp, Artificial Sequence
  Description of Artificial Sequence: Synthetic oligonucleotide
  Target: ATXN1; (-) strand; PAM type: NRG; PAM sequence: GGG
agaattactggggatattaa

SEQ ID NO: 49376 - DNA, 20 bp, Artificial Sequence
  Description of Artificial Sequence: Synthetic oligonucleotide
  Target: ATXN1; (-) strand; PAM type: NRG; PAM sequence: AGG
aagaattactggggatatta

SEQ ID NO: 49377 - DNA, 20 bp, Artificial Sequence
  Description of Artificial Sequence: Synthetic oligonucleotide
  Target: ATXN1; (-) strand; PAM type: NRG; PAM sequence: AAG
aaagaattactggggatatt

SEQ ID NO: 49378 - DNA, 20 bp, Artificial Sequence
  Description of Artificial Sequence: Synthetic oligonucleotide
  Target: ATXN1; (-) strand; PAM type: NRG; PAM sequence: GGG
cctatctgaaagaattactg

SEQ ID NO: 49379 - DNA, 20 bp, Artificial Sequence
  Description of Artificial Sequence: Synthetic oligonucleotide
  Target: ATXN1; (-) strand; PAM type: NRG; PAM sequence: GGG
gcctatctgaaagaattact

SEQ ID NO: 49380 - DNA, 20 bp, Artificial Sequence
  Description of Artificial Sequence: Synthetic oligonucleotide
  Target: ATXN1; (-) strand; PAM type: NRG; PAM sequence: TGG
cgcctatctgaaagaattac

SEQ ID NO: 49381 - DNA, 20 bp, Artificial Sequence
  Description of Artificial Sequence: Synthetic oligonucleotide
  Target: ATXN1; (-) strand; PAM type: NRG; PAM sequence: AAG
tgggcctaacgcctatctga

SEQ ID NO: 49382 - DNA, 20 bp, Artificial Sequence
  Description of Artificial Sequence: Synthetic oligonucleotide
  Target: ATXN1; (-) strand; PAM type: NRG; PAM sequence: GGG
agtttactgatctaaaaagt

SEQ ID NO: 49383 - DNA, 20 bp, Artificial Sequence
  Description of Artificial Sequence: Synthetic oligonucleotide
  Target: ATXN1; (-) strand; PAM type: NRG; PAM sequence: TGG
gagtttactgatctaaaaag

SEQ ID NO: 49384 - DNA, 20 bp, Artificial Sequence
  Description of Artificial Sequence: Synthetic oligonucleotide
  Target: ATXN1; (-) strand; PAM type: NRG; PAM sequence: AAG
cctgagtttactgatctaaa

SEQ ID NO: 49385 - DNA, 20 bp, Artificial Sequence
  Description of Artificial Sequence: Synthetic oligonucleotide
  Target: ATXN1; (-) strand; PAM type: NRG; PAM sequence: GAG
cccttaacctacatgagcct

SEQ ID NO: 49386 - DNA, 20 bp, Artificial Sequence
  Description of Artificial Sequence: Synthetic oligonucleotide
  Target: ATXN1; (-) strand; PAM type: NRG; PAM sequence: GAG
gaacttcccttaacctacat

SEQ ID NO: 49387 - DNA, 20 bp, Artificial Sequence
  Description of Artificial Sequence: Synthetic oligonucleotide
  Target: ATXN1; (-) strand; PAM type: NRG; PAM sequence: GGG
gttacatattctgtgctcct

SEQ ID NO: 49388 - DNA, 20 bp, Artificial Sequence
  Description of Artificial Sequence: Synthetic oligonucleotide
  Target: ATXN1; (-) strand; PAM type: NRG; PAM sequence: TGG
agttacatattctgtgctcc

SEQ ID NO: 49389 - DNA, 20 bp, Artificial Sequence
  Description of Artificial Sequence: Synthetic oligonucleotide
  Target: ATXN1; (-) strand; PAM type: NRG; PAM sequence: AAG
ttttctagtcctggctccac

SEQ ID NO: 49390 - DNA, 20 bp, Artificial Sequence
  Description of Artificial Sequence: Synthetic oligonucleotide
  Target: ATXN1; (-) strand; PAM type: NRG; PAM sequence: TGG
gtagatttgttttctagtcc

SEQ ID NO: 49391 - DNA, 20 bp, Artificial Sequence
  Description of Artificial Sequence: Synthetic oligonucleotide
  Target: ATXN1; (-) strand; PAM type: NRG; PAM sequence: TAG
gaatctgtagatttgttttc

SEQ ID NO: 49392 - DNA, 20 bp, Artificial Sequence
  Description of Artificial Sequence: Synthetic oligonucleotide
  Target: ATXN1; (-) strand; PAM type: NRG; PAM sequence: TAG
agcactgttcatagaatctg

SEQ ID NO: 49393 - DNA, 20 bp, Artificial Sequence
  Description of Artificial Sequence: Synthetic oligonucleotide
  Target: ATXN1; (-) strand; PAM type: NRG; PAM sequence: TAG
taatggaagagcactgttca

SEQ ID NO: 49394 - DNA, 20 bp, Artificial Sequence
  Description of Artificial Sequence: Synthetic oligonucleotide
  Target: ATXN1; (-) strand; PAM type: NRG; PAM sequence: GAG
ggcccagtggtgtaatggaa

SEQ ID NO: 49395 - DNA, 20 bp, Artificial Sequence
  Description of Artificial Sequence: Synthetic oligonucleotide
  Target: ATXN1; (-) strand; PAM type: NRG; PAM sequence: AAG
ggggcccagtggtgtaatgg

SEQ ID NO: 49396 - DNA, 20 bp, Artificial Sequence
  Description of Artificial Sequence: Synthetic oligonucleotide
  Target: ATXN1; (-) strand; PAM type: NRG; PAM sequence: TGG
agaggggcccagtggtgtaa

SEQ ID NO: 49397 - DNA, 20 bp, Artificial Sequence
  Description of Artificial Sequence: Synthetic oligonucleotide
  Target: ATXN1; (-) strand; PAM type: NRG; PAM sequence: TGG
aagtcaagagaggggcccag

SEQ ID NO: 49398 - DNA, 20 bp, Artificial Sequence
  Description of Artificial Sequence: Synthetic oligonucleotide
  Target: ATXN1; (-) strand; PAM type: NRG; PAM sequence: CAG
ataaagtcaagagaggggcc

SEQ ID NO: 49399 - DNA, 20 bp, Artificial Sequence
  Description of Artificial Sequence: Synthetic oligonucleotide
  Target: ATXN1; (-) strand; PAM type: NRG; PAM sequence: GGG
aataaataaagtcaagagag

SEQ ID NO: 49400 - DNA, 20 bp, Artificial Sequence
  Description of Artificial Sequence: Synthetic oligonucleotide
  Target: ATXN1; (-) strand; PAM type: NRG; PAM sequence: GGG
aaataaataaagtcaagaga

SEQ ID NO: 49401 - DNA, 20 bp, Artificial Sequence
  Description of Artificial Sequence: Synthetic oligonucleotide
  Target: ATXN1; (-) strand; PAM type: NRG; PAM sequence: AGG
taaataaataaagtcaagag

SEQ ID NO: 49402 - DNA, 20 bp, Artificial Sequence
  Description of Artificial Sequence: Synthetic oligonucleotide
  Target: ATXN1; (-) strand; PAM type: NRG; PAM sequence: GAG
ataaataaataaagtcaaga

SEQ ID NO: 49403 - DNA, 20 bp, Artificial Sequence
  Description of Artificial Sequence: Synthetic oligonucleotide
  Target: ATXN1; (-) strand; PAM type: NRG; PAM sequence: GAG
aaataaataaataaagtcaa

SEQ ID NO: 49404 - DNA, 20 bp, Artificial Sequence
  Description of Artificial Sequence: Synthetic oligonucleotide
  Target: ATXN1; (-) strand; PAM type: NRG; PAM sequence: AAG
ataaataaataaataaagtc

SEQ ID NO: 49405 - DNA, 20 bp, Artificial Sequence
  Description of Artificial Sequence: Synthetic oligonucleotide
  Target: ATXN1; (-) strand; PAM type: NRG; PAM sequence: AAG
aataaataaataaataaata

SEQ ID NO: 49406 - DNA, 20 bp, Artificial Sequence
  Description of Artificial Sequence: Synthetic oligonucleotide
  Target: ATXN1; (-) strand; PAM type: NRG; PAM sequence: GAG
tccagcctcggtgacagagt

SEQ ID NO: 49407 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctcggtgaca

SEQ ID NO: 49408 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctcggtga

SEQ ID NO: 49409 - DNA, 20 bp, Artificial Sequence
  Description of Artificial Sequence: Synthetic oligonucleotide
  Target: ATXN1; (-) strand; PAM type: NRG; PAM sequence: CGG
gcaccactgcactccagcct

SEQ ID NO: 49410 - DNA, 20 bp, Artificial Sequence
  Description of Artificial Sequence: Synthetic oligonucleotide
  Target: ATXN1; (-) strand; PAM type: NRG; PAM sequence: CAG
gtgattgcaccactgcactc

SEQ ID NO: 49411 - DNA, 20 bp, Artificial Sequence
  Description of Artificial Sequence: Synthetic oligonucleotide
  Target: ATXN1; (-) strand; PAM type: NRG; PAM sequence: GAG
agggcagtcaaggctgcggt

SEQ ID NO: 49412 - DNA, 20 bp, Artificial Sequence
  Description of Artificial Sequence: Synthetic oligonucleotide
  Target: ATXN1; (-) strand; PAM type: NRG; PAM sequence: CGG
agccagggcagtcaaggctg

SEQ ID NO: 49413 - DNA, 20 bp, Artificial Sequence
  Description of Artificial Sequence: Synthetic oligonucleotide
  Target: ATXN1; (-) strand; PAM type: NRG; PAM sequence: AGG
tatttcagccagggcagtca

SEQ ID NO: 49414 - DNA, 20 bp, Artificial Sequence
  Description of Artificial Sequence: Synthetic oligonucleotide
  Target: ATXN1; (-) strand; PAM type: NRG; PAM sequence: AAG
atatttcagccagggcagtc

SEQ ID NO: 49415 - DNA, 20 bp, Artificial Sequence
  Description of Artificial Sequence: Synthetic oligonucleotide
  Target: ATXN1; (-) strand; PAM type: NRG; PAM sequence: CAG
ggaggatatttcagccaggg

SEQ ID NO: 49416 - DNA, 20 bp, Artificial Sequence
  Description of Artificial Sequence: Synthetic oligonucleotide
  Target: ATXN1; (-) strand; PAM type: NRG; PAM sequence: GGG
gtgggaggatatttcagcca

SEQ ID NO: 49417 - DNA, 20 bp, Artificial Sequence
  Description of Artificial Sequence: Synthetic oligonucleotide
  Target: ATXN1; (-) strand; PAM type: NRG; PAM sequence: AGG
ggtgggaggatatttcagcc

SEQ ID NO: 49418 - DNA, 20 bp, Artificial Sequence
  Description of Artificial Sequence: Synthetic oligonucleotide
  Target: ATXN1; (-) strand; PAM type: NRG; PAM sequence: CAG
aggtgggaggatatttcagc

SEQ ID NO: 49419 - DNA, 20 bp, Artificial Sequence
  Description of Artificial Sequence: Synthetic oligonucleotide
  Target: ATXN1; (-) strand; PAM type: NRG; PAM sequence: CAG
gctgaggtgggaggatattt

SEQ ID NO: 49420 - DNA, 20 bp, Artificial Sequence
  Description of Artificial Sequence: Synthetic oligonucleotide
  Target: ATXN1; (-) strand; PAM type: NRG; PAM sequence: AGG
actcaggaggctgaggtggg

SEQ ID NO: 49421 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggtgg

SEQ ID NO: 49422 - DNA, 20 bp, Artificial Sequence
  Description of Artificial Sequence: Synthetic oligonucleotide
  Target: ATXN1; (-) strand; PAM type: NRG; PAM sequence: GGG
gctactcaggaggctgaggt

SEQ ID NO: 49423 - DNA, 20 bp, Artificial Sequence
  Description of Artificial Sequence: Synthetic oligonucleotide
  Target: ATXN1; (-) strand; PAM type: NRG; PAM sequence: TGG
agctactcaggaggctgagg

SEQ ID NO: 49424 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 49425 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 49426 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctactcagg

SEQ ID NO: 49427 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctactcag

SEQ ID NO: 49428 - DNA, 20 bp, Artificial Sequence
  Description of Artificial Sequence: Synthetic oligonucleotide
  Target: ATXN1; (-) strand; PAM type: NRG; PAM sequence: AGG
acctgtagtcccagctactc

SEQ ID NO: 49429 - DNA, 20 bp, Artificial Sequence
  Description of Artificial Sequence: Synthetic oligonucleotide
  Target: ATXN1; (-) strand; PAM type: NRG; PAM sequence: CAG
cacctgtagtcccagctact

SEQ ID NO: 49430 - DNA, 20 bp, Artificial Sequence
  Description of Artificial Sequence: Synthetic oligonucleotide
  Target: ATXN1; (-) strand; PAM type: NRG; PAM sequence: CAG
gtggtgtgcacctgtagtcc

SEQ ID NO: 49431 - DNA, 20 bp, Artificial Sequence
  Description of Artificial Sequence: Synthetic oligonucleotide
  Target: ATXN1; (-) strand; PAM type: NRG; PAM sequence: TAG
ggggtggtggtgtgcacctg

SEQ ID NO: 49432 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggggtgg

SEQ ID NO: 49433 - DNA, 20 bp, Artificial Sequence
  Description of Artificial Sequence: Synthetic oligonucleotide
  Target: ATXN1; (-) strand; PAM type: NRG; PAM sequence: TGG
gttaaaaaattagccagggg

SEQ ID NO: 49434 - DNA, 20 bp, Artificial Sequence
  Description of Artificial Sequence: Synthetic oligonucleotide
  Target: ATXN1; (-) strand; PAM type: NRG; PAM sequence: GGG
aaagttaaaaaattagccag

SEQ ID NO: 49435 - DNA, 20 bp, Artificial Sequence
  Description of Artificial Sequence: Synthetic oligonucleotide
  Target: ATXN1; (-) strand; PAM type: NRG; PAM sequence: GGG
aaaagttaaaaaattagcca

SEQ ID NO: 49436 - DNA, 20 bp, Artificial Sequence
  Description of Artificial Sequence: Synthetic oligonucleotide
  Target: ATXN1; (-) strand; PAM type: NRG; PAM sequence: AGG
aaaaagttaaaaaattagcc

SEQ ID NO: 49437 - DNA, 20 bp, Artificial Sequence
  Description of Artificial Sequence: Synthetic oligonucleotide
  Target: ATXN1; (-) strand; PAM type: NRG; PAM sequence: CAG
aaaaaagttaaaaaattagc

SEQ ID NO: 49438 - DNA, 20 bp, Artificial Sequence
  Description of Artificial Sequence: Synthetic oligonucleotide
  Target: ATXN1; (-) strand; PAM type: NRG; PAM sequence: TAG
ttacaaaaaagttaaaaaat

SEQ ID NO: 49439 - DNA, 20 bp, Artificial Sequence
  Description of Artificial Sequence: Synthetic oligonucleotide
  Target: ATXN1; (-) strand; PAM type: NRG; PAM sequence: AAG
gagactttgtctttacaaaa

SEQ ID NO: 49440 - DNA, 20 bp, Artificial Sequence
  Description of Artificial Sequence: Synthetic oligonucleotide
  Target: ATXN1; (-) strand; PAM type: NRG; PAM sequence: GAG
accagcctgggaaatatagt

SEQ ID NO: 49441 - DNA, 20 bp, Artificial Sequence
  Description of Artificial Sequence: Synthetic oligonucleotide
  Target: ATXN1; (-) strand; PAM type: NRG; PAM sequence: TAG
tgagaccagcctgggaaata

SEQ ID NO: 49442 - DNA, 20 bp, Artificial Sequence
  Description of Artificial Sequence: Synthetic oligonucleotide
  Target: ATXN1; (-) strand; PAM type: NRG; PAM sequence: GGG
caggagtttgagaccagcct

SEQ ID NO: 49443 - DNA, 20 bp, Artificial Sequence
  Description of Artificial Sequence: Synthetic oligonucleotide
  Target: ATXN1; (-) strand; PAM type: NRG; PAM sequence: TGG
ccaggagtttgagaccagcc

SEQ ID NO: 49444 - DNA, 20 bp, Artificial Sequence
  Description of Artificial Sequence: Synthetic oligonucleotide
  Target: ATXN1; (-) strand; PAM type: NRG; PAM sequence: CAG
tgaacccaggagtttgagac

SEQ ID NO: 49445 - DNA, 20 bp, Artificial Sequence
  Description of Artificial Sequence: Synthetic oligonucleotide
  Target: ATXN1; (-) strand; PAM type: NRG; PAM sequence: GAG
ctgcttgaacccaggagttt

SEQ ID NO: 49446 - DNA, 20 bp, Artificial Sequence
  Description of Artificial Sequence: Synthetic oligonucleotide
  Target: ATXN1; (-) strand; PAM type: NRG; PAM sequence: GAG
ggaggactgcttgaacccag

SEQ ID NO: 49447 - DNA, 20 bp, Artificial Sequence
  Description of Artificial Sequence: Synthetic oligonucleotide
  Target: ATXN1; (-) strand; PAM type: NRG; PAM sequence: AGG
tgggaggactgcttgaaccc

SEQ ID NO: 49448 - DNA, 20 bp, Artificial Sequence
  Description of Artificial Sequence: Synthetic oligonucleotide
  Target: ATXN1; (-) strand; PAM type: NRG; PAM sequence: CAG
gtgggaggactgcttgaacc

SEQ ID NO: 49449 - DNA, 20 bp, Artificial Sequence
  Description of Artificial Sequence: Synthetic oligonucleotide
  Target: ATXN1; (-) strand; PAM type: NRG; PAM sequence: AGG
ttttgggaagctgaggtggg

SEQ ID NO: 49450 - DNA, 20 bp, Artificial Sequence
  Description of Artificial Sequence: Synthetic oligonucleotide
  Target: ATXN1; (-) strand; PAM type: NRG; PAM sequence: GAG
attttgggaagctgaggtgg

SEQ ID NO: 49451 - DNA, 20 bp, Artificial Sequence
  Description of Artificial Sequence: Synthetic oligonucleotide
  Target: ATXN1; (-) strand; PAM type: NRG; PAM sequence: GGG
gcattttgggaagctgaggt

SEQ ID NO: 49452 - DNA, 20 bp, Artificial Sequence
  Description of Artificial Sequence: Synthetic oligonucleotide
  Target: ATXN1; (-) strand; PAM type: NRG; PAM sequence: TGG
agcattttgggaagctgagg

SEQ ID NO: 49453 - DNA, 20 bp, Artificial Sequence
  Description of Artificial Sequence: Synthetic oligonucleotide
  Target: ATXN1; (-) strand; PAM type: NRG; PAM sequence: AGG
cccagcattttgggaagctg

SEQ ID NO: 49454 - DNA, 20 bp, Artificial Sequence
  Description of Artificial Sequence: Synthetic oligonucleotide
  Target: ATXN1; (-) strand; PAM type: NRG; PAM sequence: GAG
tcccagcattttgggaagct

SEQ ID NO: 49455 - DNA, 20 bp, Artificial Sequence
  Description of Artificial Sequence: Synthetic oligonucleotide
  Target: ATXN1; (-) strand; PAM type: NRG; PAM sequence: AAG
tatactcccagcattttggg

SEQ ID NO: 49456 - DNA, 20 bp, Artificial Sequence
  Description of Artificial Sequence: Synthetic oligonucleotide
  Target: ATXN1; (-) strand; PAM type: NRG; PAM sequence: GGG
gcctatactcccagcatttt

SEQ ID NO: 49457 - DNA, 20 bp, Artificial Sequence
  Description of Artificial Sequence: Synthetic oligonucleotide
  Target: ATXN1; (-) strand; PAM type: NRG; PAM sequence: TGG
tgcctatactcccagcattt

SEQ ID NO: 49458 - DNA, 20 bp, Artificial Sequence
  Description of Artificial Sequence: Synthetic oligonucleotide
  Target: ATXN1; (-) strand; PAM type: NRG; PAM sequence: CAG
tgtgctcatgcctatactcc

SEQ ID NO: 49459 - DNA, 20 bp, Artificial Sequence
  Description of Artificial Sequence: Synthetic oligonucleotide
  Target: ATXN1; (-) strand; PAM type: NRG; PAM sequence: GGG
aataagtcaagaggaggtct

SEQ ID NO: 49460 - DNA, 20 bp, Artificial Sequence
  Description of Artificial Sequence: Synthetic oligonucleotide
  Target: ATXN1; (-) strand; PAM type: NRG; PAM sequence: TGG
taataagtcaagaggaggtc

SEQ ID NO: 49461 - DNA, 20 bp, Artificial Sequence
  Description of Artificial Sequence: Synthetic oligonucleotide
  Target: ATXN1; (-) strand; PAM type: NRG; PAM sequence: AGG
taacttaataagtcaagagg

SEQ ID NO: 49462 - DNA, 20 bp, Artificial Sequence
  Description of Artificial Sequence: Synthetic oligonucleotide
  Target: ATXN1; (-) strand; PAM type: NRG; PAM sequence: GAG
ataacttaataagtcaagag

SEQ ID NO: 49463 - DNA, 20 bp, Artificial Sequence
  Description of Artificial Sequence: Synthetic oligonucleotide
  Target: ATXN1; (-) strand; PAM type: NRG; PAM sequence: AGG
taataacttaataagtcaag

SEQ ID NO: 49464 - DNA, 20 bp, Artificial Sequence
  Description of Artificial Sequence: Synthetic oligonucleotide
  Target: ATXN1; (-) strand; PAM type: NRG; PAM sequence: GAG
ataataacttaataagtcaa

SEQ ID NO: 49465 - DNA, 20 bp, Artificial Sequence
  Description of Artificial Sequence: Synthetic oligonucleotide
  Target: ATXN1; (-) strand; PAM type: NRG; PAM sequence: AAG
tcataataacttaataagtc

SEQ ID NO: 49466 - DNA, 20 bp, Artificial Sequence
  Description of Artificial Sequence: Synthetic oligonucleotide
  Target: ATXN1; (-) strand; PAM type: NRG; PAM sequence: AAG
cggcatcataataacttaat

SEQ ID NO: 49467 - DNA, 20 bp, Artificial Sequence
  Description of Artificial Sequence: Synthetic oligonucleotide
  Target: ATXN1; (-) strand; PAM type: NRG; PAM sequence: CGG
cagtagtgggcttgctgaat

SEQ ID NO: 49468 - DNA, 20 bp, Artificial Sequence
  Description of Artificial Sequence: Synthetic oligonucleotide
  Target: ATXN1; (-) strand; PAM type: NRG; PAM sequence: GGG
ctgggtagatacccagtagt

SEQ ID NO: 49469 - DNA, 20 bp, Artificial Sequence
  Description of Artificial Sequence: Synthetic oligonucleotide
  Target: ATXN1; (-) strand; PAM type: NRG; PAM sequence: TGG
tctgggtagatacccagtag

SEQ ID NO: 49470 - DNA, 20 bp, Artificial Sequence
  Description of Artificial Sequence: Synthetic oligonucleotide
  Target: ATXN1; (-) strand; PAM type: NRG; PAM sequence: TAG
tcctctgggtagatacccag

SEQ ID NO: 49471 - DNA, 20 bp, Artificial Sequence
  Description of Artificial Sequence: Synthetic oligonucleotide
  Target: ATXN1; (-) strand; PAM type: NRG; PAM sequence: CAG
ttttcctctgggtagatacc

SEQ ID NO: 49472 - DNA, 20 bp, Artificial Sequence
  Description of Artificial Sequence: Synthetic oligonucleotide
  Target: ATXN1; (-) strand; PAM type: NRG; PAM sequence: TAG
atgacttattttcctctggg

SEQ ID NO: 49473 - DNA, 20 bp, Artificial Sequence
  Description of Artificial Sequence: Synthetic oligonucleotide
  Target: ATXN1; (-) strand; PAM type: NRG; PAM sequence: GGG
ataatgacttattttcctct

SEQ ID NO: 49474 - DNA, 20 bp, Artificial Sequence
  Description of Artificial Sequence: Synthetic oligonucleotide
  Target: ATXN1; (-) strand; PAM type: NRG; PAM sequence: TGG
aataatgacttattttcctc

SEQ ID NO: 49475 - DNA, 20 bp, Artificial Sequence
  Description of Artificial Sequence: Synthetic oligonucleotide
  Target: ATXN1; (-) strand; PAM type: NRG; PAM sequence: AAG
tgctataaacatgcgtgtgc

SEQ ID NO: 49476 - DNA, 20 bp, Artificial Sequence
  Description of Artificial Sequence: Synthetic oligonucleotide
  Target: ATXN1; (-) strand; PAM type: NRG; PAM sequence: TGG
caattgatgggcatttgggt

SEQ ID NO: 49477 - DNA, 20 bp, Artificial Sequence
  Description of Artificial Sequence: Synthetic oligonucleotide
  Target: ATXN1; (-) strand; PAM type: NRG; PAM sequence: GGG
cactcaattgatgggcattt

SEQ ID NO: 49478 - DNA, 20 bp, Artificial Sequence
  Description of Artificial Sequence: Synthetic oligonucleotide
  Target: ATXN1; (-) strand; PAM type: NRG; PAM sequence: TGG
ccactcaattgatgggcatt

SEQ ID NO: 49479 - DNA, 20 bp, Artificial Sequence
  Description of Artificial Sequence: Synthetic oligonucleotide
  Target: ATXN1; (-) strand; PAM type: NRG; PAM sequence: GGG
cctttatccactcaattgat

SEQ ID NO: 49480 - DNA, 20 bp, Artificial Sequence
  Description of Artificial Sequence: Synthetic oligonucleotide
  Target: ATXN1; (-) strand; PAM type: NRG; PAM sequence: TGG
tcctttatccactcaattga

SEQ ID NO: 49481 - DNA, 20 bp, Artificial Sequence
  Description of Artificial Sequence: Synthetic oligonucleotide
  Target: ATXN1; (-) strand; PAM type: NRG; PAM sequence: CAG
tccatcatatatatgtacca

SEQ ID NO: 49482 - DNA, 20 bp, Artificial Sequence
  Description of Artificial Sequence: Synthetic oligonucleotide
  Target: ATXN1; (-) strand; PAM type: NRG; PAM sequence: TAG
cattcctttttatggctgag

SEQ ID NO: 49483 - DNA, 20 bp, Artificial Sequence
  Description of Artificial Sequence: Synthetic oligonucleotide
  Target: ATXN1; (-) strand; PAM type: NRG; PAM sequence: GAG
attcattcctttttatggct

SEQ ID NO: 49484 - DNA, 20 bp, Artificial Sequence
  Description of Artificial Sequence: Synthetic oligonucleotide
  Target: ATXN1; (-) strand; PAM type: NRG; PAM sequence: TGG
tgttaattcattccttttta

SEQ ID NO: 49485 - DNA, 20 bp, Artificial Sequence
  Description of Artificial Sequence: Synthetic oligonucleotide
  Target: ATXN1; (-) strand; PAM type: NRG; PAM sequence: AGG
aatagtctccaatctcatcc

SEQ ID NO: 49486 - DNA, 20 bp, Artificial Sequence
  Description of Artificial Sequence: Synthetic oligonucleotide
  Target: ATXN1; (-) strand; PAM type: NRG; PAM sequence: CAG
taatagtctccaatctcatc

SEQ ID NO: 49487 - DNA, 20 bp, Artificial Sequence
  Description of Artificial Sequence: Synthetic oligonucleotide
  Target: ATXN1; (-) strand; PAM type: NRG; PAM sequence: TAG
agttacttcacttagaataa

SEQ ID NO: 49488 - DNA, 20 bp, Artificial Sequence
  Description of Artificial Sequence: Synthetic oligonucleotide
  Target: ATXN1; (-) strand; PAM type: NRG; PAM sequence: TAG
cattcttgagttacttcact

SEQ ID NO: 49489 - DNA, 20 bp, Artificial Sequence
  Description of Artificial Sequence: Synthetic oligonucleotide
  Target: ATXN1; (-) strand; PAM type: NRG; PAM sequence: GAG
atgtttggttttccattctt

SEQ ID NO: 49490 - DNA, 20 bp, Artificial Sequence
  Description of Artificial Sequence: Synthetic oligonucleotide
  Target: ATXN1; (-) strand; PAM type: NRG; PAM sequence: TGG
cagtgagaacatatgatgtt

SEQ ID NO: 49491 - DNA, 20 bp, Artificial Sequence
  Description of Artificial Sequence: Synthetic oligonucleotide
  Target: ATXN1; (-) strand; PAM type: NRG; PAM sequence: GAG
cttagctctcacatatcagt

SEQ ID NO: 49492 - DNA, 20 bp, Artificial Sequence
  Description of Artificial Sequence: Synthetic oligonucleotide
  Target: ATXN1; (-) strand; PAM type: NRG; PAM sequence: CAG
atagcttagctctcacatat

SEQ ID NO: 49493 - DNA, 20 bp, Artificial Sequence
  Description of Artificial Sequence: Synthetic oligonucleotide
  Target: ATXN1; (-) strand; PAM type: NRG; PAM sequence: TAG
gcctttgcatcctcatagct

SEQ ID NO: 49494 - DNA, 20 bp, Artificial Sequence
  Description of Artificial Sequence: Synthetic oligonucleotide
  Target: ATXN1; (-) strand; PAM type: NRG; PAM sequence: TAG
cttatgcctttgcatcctca

SEQ ID NO: 49495 - DNA, 20 bp, Artificial Sequence
  Description of Artificial Sequence: Synthetic oligonucleotide
  Target: ATXN1; (-) strand; PAM type: NRG; PAM sequence: AAG
ctcttccccctaagtgccca

SEQ ID NO: 49496 - DNA, 20 bp, Artificial Sequence
  Description of Artificial Sequence: Synthetic oligonucleotide
  Target: ATXN1; (-) strand; PAM type: NRG; PAM sequence: AAG
ccactcccactcttccccct

SEQ ID NO: 49497 - DNA, 20 bp, Artificial Sequence
  Description of Artificial Sequence: Synthetic oligonucleotide
  Target: ATXN1; (-) strand; PAM type: NRG; PAM sequence: CAG
tatacactgcaccatatttg

SEQ ID NO: 49498 - DNA, 20 bp, Artificial Sequence
  Description of Artificial Sequence: Synthetic oligonucleotide
  Target: ATXN1; (-) strand; PAM type: NRG; PAM sequence: CAG
tggtgcacccatcacctgag

SEQ ID NO: 49499 - DNA, 20 bp, Artificial Sequence
  Description of Artificial Sequence: Synthetic oligonucleotide
  Target: ATXN1; (-) strand; PAM type: NRG; PAM sequence: GAG
ttttggtgcacccatcacct

SEQ ID NO: 49500 - DNA, 20 bp, Artificial Sequence
  Description of Artificial Sequence: Synthetic oligonucleotide
  Target: ATXN1; (-) strand; PAM type: NRG; PAM sequence: TGG
agtggcgatttgtgagattt

SEQ ID NO: 49501 - DNA, 20 bp, Artificial Sequence
  Description of Artificial Sequence: Synthetic oligonucleotide
  Target: ATXN1; (-) strand; PAM type: NRG; PAM sequence: GAG
gttctttagtggcgatttgt

SEQ ID NO: 49502 - DNA, 20 bp, Artificial Sequence
  Description of Artificial Sequence: Synthetic oligonucleotide
  Target: ATXN1; (-) strand; PAM type: NRG; PAM sequence: TGG
tggttacataagttctttag

SEQ ID NO: 49503 - DNA, 20 bp, Artificial Sequence
  Description of Artificial Sequence: Synthetic oligonucleotide
  Target: ATXN1; (-) strand; PAM type: NRG; PAM sequence: TAG
atttggttacataagttctt

SEQ ID NO: 49504 - DNA, 20 bp, Artificial Sequence
  Description of Artificial Sequence: Synthetic oligonucleotide
  Target: ATXN1; (-) strand; PAM type: NRG; PAM sequence: AAG
caggtggtatttggttacat

SEQ ID NO: 49505 - DNA, 20 bp, Artificial Sequence
  Description of Artificial Sequence: Synthetic oligonucleotide
  Target: ATXN1; (-) strand; PAM type: NRG; PAM sequence: TGG
attgggatacaggtggtatt

SEQ ID NO: 49506 - DNA, 20 bp, Artificial Sequence
  Description of Artificial Sequence: Synthetic oligonucleotide
  Target: ATXN1; (-) strand; PAM type: NRG; PAM sequence: TGG
gtaagttattgggatacagg

SEQ ID NO: 49507 - DNA, 20 bp, Artificial Sequence
  Description of Artificial Sequence: Synthetic oligonucleotide
  Target: ATXN1; (-) strand; PAM type: NRG; PAM sequence: AGG
tccgtaagttattgggatac

SEQ ID NO: 49508 - DNA, 20 bp, Artificial Sequence
  Description of Artificial Sequence: Synthetic oligonucleotide
  Target: ATXN1; (-) strand; PAM type: NRG; PAM sequence: CAG
ttccgtaagttattgggata

SEQ ID NO: 49509 - DNA, 20 bp, Artificial Sequence
  Description of Artificial Sequence: Synthetic oligonucleotide
  Target: ATXN1; (-) strand; PAM type: NRG; PAM sequence: GGG
ttatttttccgtaagttatt

SEQ ID NO: 49510 - DNA, 20 bp, Artificial Sequence
  Description of Artificial Sequence: Synthetic oligonucleotide
  Target: ATXN1; (-) strand; PAM type: NRG; PAM sequence: TGG
tttatttttccgtaagttat

SEQ ID NO: 49511 - DNA, 20 bp, Artificial Sequence
  Description of Artificial Sequence: Synthetic oligonucleotide
  Target: ATXN1; (-) strand; PAM type: NRG; PAM sequence: AAG
tttttattttatttttccgt

SEQ ID NO: 49512 - DNA, 20 bp, Artificial Sequence
  Description of Artificial Sequence: Synthetic oligonucleotide
  Target: ATXN1; (-) strand; PAM type: NRG; PAM sequence: TGG
gtgtacttattcaaaataag

SEQ ID NO: 49513 - DNA, 20 bp, Artificial Sequence
  Description of Artificial Sequence: Synthetic oligonucleotide
  Target: ATXN1; (-) strand; PAM type: NRG; PAM sequence: AAG
aacgtgtacttattcaaaat

SEQ ID NO: 49514 - DNA, 20 bp, Artificial Sequence
  Description of Artificial Sequence: Synthetic oligonucleotide
  Target: ATXN1; (-) strand; PAM type: NRG; PAM sequence: GGG
tcagttgcgttgcatcacaa

SEQ ID NO: 49515 - DNA, 20 bp, Artificial Sequence
  Description of Artificial Sequence: Synthetic oligonucleotide
  Target: ATXN1; (-) strand; PAM type: NRG; PAM sequence: AGG
ttcagttgcgttgcatcaca

SEQ ID NO: 49516 - DNA, 20 bp, Artificial Sequence
  Description of Artificial Sequence: Synthetic oligonucleotide
  Target: ATXN1; (-) strand; PAM type: NRG; PAM sequence: AAG
cttcagttgcgttgcatcac

SEQ ID NO: 49517 - DNA, 20 bp, Artificial Sequence
  Description of Artificial Sequence: Synthetic oligonucleotide
  Target: ATXN1; (-) strand; PAM type: NRG; PAM sequence: CAG
attgatagtaggtcattctt

SEQ ID NO: 49518 - DNA, 20 bp, Artificial Sequence
  Description of Artificial Sequence: Synthetic oligonucleotide
  Target: ATXN1; (-) strand; PAM type: NRG; PAM sequence: AGG
aaaggaatagaattgatagt

SEQ ID NO: 49519 - DNA, 20 bp, Artificial Sequence
  Description of Artificial Sequence: Synthetic oligonucleotide
  Target: ATXN1; (-) strand; PAM type: NRG; PAM sequence: TAG
caaaggaatagaattgatag

SEQ ID NO: 49520 - DNA, 20 bp, Artificial Sequence
  Description of Artificial Sequence: Synthetic oligonucleotide
  Target: ATXN1; (-) strand; PAM type: NRG; PAM sequence: TAG
acacaaaggaatagaattga

SEQ ID NO: 49521 - DNA, 20 bp, Artificial Sequence
  Description of Artificial Sequence: Synthetic oligonucleotide
  Target: ATXN1; (-) strand; PAM type: NRG; PAM sequence: TAG
tcatggaggacacaaaggaa

SEQ ID NO: 49522 - DNA, 20 bp, Artificial Sequence
  Description of Artificial Sequence: Synthetic oligonucleotide
  Target: ATXN1; (-) strand; PAM type: NRG; PAM sequence: AGG
gagtgtcatggaggacacaa

SEQ ID NO: 49523 - DNA, 20 bp, Artificial Sequence
  Description of Artificial Sequence: Synthetic oligonucleotide
  Target: ATXN1; (-) strand; PAM type: NRG; PAM sequence: AAG
agagtgtcatggaggacaca

SEQ ID NO: 49524 - DNA, 20 bp, Artificial Sequence
  Description of Artificial Sequence: Synthetic oligonucleotide
  Target: ATXN1; (-) strand; PAM type: NRG; PAM sequence: AGG
actgttctagagtgtcatgg

SEQ ID NO: 49525 - DNA, 20 bp, Artificial Sequence
  Description of Artificial Sequence: Synthetic oligonucleotide
  Target: ATXN1; (-) strand; PAM type: NRG; PAM sequence: GAG
cactgttctagagtgtcatg

SEQ ID NO: 49526 - DNA, 20 bp, Artificial Sequence
  Description of Artificial Sequence: Synthetic oligonucleotide
  Target: ATXN1; (-) strand; PAM type: NRG; PAM sequence: TGG
agcactgttctagagtgtca

SEQ ID NO: 49527 - DNA, 20 bp, Artificial Sequence
  Description of Artificial Sequence: Synthetic oligonucleotide
  Target: ATXN1; (-) strand; PAM type: NRG; PAM sequence: GAG
gcttgcatagcactgttcta

SEQ ID NO: 49528 - DNA, 20 bp, Artificial Sequence
  Description of Artificial Sequence: Synthetic oligonucleotide
  Target: ATXN1; (-) strand; PAM type: NRG; PAM sequence: TAG
ctgcttgcatagcactgttc

SEQ ID NO: 49529 - DNA, 20 bp, Artificial Sequence
  Description of Artificial Sequence: Synthetic oligonucleotide
  Target: ATXN1; (-) strand; PAM type: NRG; PAM sequence: TAG
gctgttactttctgcttgca

SEQ ID NO: 49530 - DNA, 20 bp, Artificial Sequence
  Description of Artificial Sequence: Synthetic oligonucleotide
  Target: ATXN1; (-) strand; PAM type: NRG; PAM sequence: AAG
tattgaatgaatgaatgaat

SEQ ID NO: 49531 - DNA, 20 bp, Artificial Sequence
  Description of Artificial Sequence: Synthetic oligonucleotide
  Target: ATXN1; (-) strand; PAM type: NRG; PAM sequence: TGG
cttcctggatgttcagtgta

SEQ ID NO: 49532 - DNA, 20 bp, Artificial Sequence
  Description of Artificial Sequence: Synthetic oligonucleotide
  Target: ATXN1; (-) strand; PAM type: NRG; PAM sequence: CAG
gttagcacttcctggatgtt

SEQ ID NO: 49533 - DNA, 20 bp, Artificial Sequence
  Description of Artificial Sequence: Synthetic oligonucleotide
  Target: ATXN1; (-) strand; PAM type: NRG; PAM sequence: TGG
agtacctggttagcacttcc

SEQ ID NO: 49534 - DNA, 20 bp, Artificial Sequence
  Description of Artificial Sequence: Synthetic oligonucleotide
  Target: ATXN1; (-) strand; PAM type: NRG; PAM sequence: TAG
tacctagtgcagtacctggt

SEQ ID NO: 49535 - DNA, 20 bp, Artificial Sequence
  Description of Artificial Sequence: Synthetic oligonucleotide
  Target: ATXN1; (-) strand; PAM type: NRG; PAM sequence: TGG
ctaatacctagtgcagtacc

SEQ ID NO: 49536 - DNA, 20 bp, Artificial Sequence
  Description of Artificial Sequence: Synthetic oligonucleotide
  Target: ATXN1; (-) strand; PAM type: NRG; PAM sequence: CAG
tgtttccctaatacctagtg

SEQ ID NO: 49537 - DNA, 20 bp, Artificial Sequence
  Description of Artificial Sequence: Synthetic oligonucleotide
  Target: ATXN1; (-) strand; PAM type: NRG; PAM sequence: TAG
atctctgtttccctaatacc

SEQ ID NO: 49538 - DNA, 20 bp, Artificial Sequence
  Description of Artificial Sequence: Synthetic oligonucleotide
  Target: ATXN1; (-) strand; PAM type: NRG; PAM sequence: GAG
ctggttcccaacaagacatg

SEQ ID NO: 49539 - DNA, 20 bp, Artificial Sequence
  Description of Artificial Sequence: Synthetic oligonucleotide
  Target: ATXN1; (-) strand; PAM type: NRG; PAM sequence: TGG
gcctggttcccaacaagaca

SEQ ID NO: 49540 - DNA, 20 bp, Artificial Sequence
  Description of Artificial Sequence: Synthetic oligonucleotide
  Target: ATXN1; (-) strand; PAM type: NRG; PAM sequence: AAG
acacgtgcctggttcccaac

SEQ ID NO: 49541 - DNA, 20 bp, Artificial Sequence
  Description of Artificial Sequence: Synthetic oligonucleotide
  Target: ATXN1; (-) strand; PAM type: NRG; PAM sequence: TGG
gagtgacctctacacgtgcc

SEQ ID NO: 49542 - DNA, 20 bp, Artificial Sequence
  Description of Artificial Sequence: Synthetic oligonucleotide
  Target: ATXN1; (-) strand; PAM type: NRG; PAM sequence: GAG
gtcatttattacctgcgtaa

SEQ ID NO: 49543 - DNA, 20 bp, Artificial Sequence
  Description of Artificial Sequence: Synthetic oligonucleotide
  Target: ATXN1; (-) strand; PAM type: NRG; PAM sequence: AAG
gagtcatttattacctgcgt

SEQ ID NO: 49544 - DNA, 20 bp, Artificial Sequence
  Description of Artificial Sequence: Synthetic oligonucleotide
  Target: ATXN1; (-) strand; PAM type: NRG; PAM sequence: GAG
gtcttgctgatgcctctgta

SEQ ID NO: 49545 - DNA, 20 bp, Artificial Sequence
  Description of Artificial Sequence: Synthetic oligonucleotide
  Target: ATXN1; (-) strand; PAM type: NRG; PAM sequence: TAG
gcgtcttgctgatgcctctg

SEQ ID NO: 49546 - DNA, 20 bp, Artificial Sequence
  Description of Artificial Sequence: Synthetic oligonucleotide
  Target: ATXN1; (-) strand; PAM type: NRG; PAM sequence: CAG
tgctgacttatttctccttc

SEQ ID NO: 49547 - DNA, 20 bp, Artificial Sequence
  Description of Artificial Sequence: Synthetic oligonucleotide
  Target: ATXN1; (-) strand; PAM type: NRG; PAM sequence: GAG
tgtacacttctttgcagagt

SEQ ID NO: 49548 - DNA, 20 bp, Artificial Sequence
  Description of Artificial Sequence: Synthetic oligonucleotide
  Target: ATXN1; (-) strand; PAM type: NRG; PAM sequence: GAG
ttcctgtacacttctttgca

SEQ ID NO: 49549 - DNA, 20 bp, Artificial Sequence
  Description of Artificial Sequence: Synthetic oligonucleotide
  Target: ATXN1; (-) strand; PAM type: NRG; PAM sequence: CAG
gcttcctgtacacttctttg

SEQ ID NO: 49550 - DNA, 20 bp, Artificial Sequence
  Description of Artificial Sequence: Synthetic oligonucleotide
  Target: ATXN1; (-) strand; PAM type: NRG; PAM sequence: GAG
gttcaaaaatgacccatcta

SEQ ID NO: 49551 - DNA, 20 bp, Artificial Sequence
  Description of Artificial Sequence: Synthetic oligonucleotide
  Target: ATXN1; (-) strand; PAM type: NRG; PAM sequence: TAG
atgttcaaaaatgacccatc

SEQ ID NO: 49552 - DNA, 20 bp, Artificial Sequence
  Description of Artificial Sequence: Synthetic oligonucleotide
  Target: ATXN1; (-) strand; PAM type: NRG; PAM sequence: AGG
tcctttcaaaactcatcttg

SEQ ID NO: 49553 - DNA, 20 bp, Artificial Sequence
  Description of Artificial Sequence: Synthetic oligonucleotide
  Target: ATXN1; (-) strand; PAM type: NRG; PAM sequence: GAG
atcctttcaaaactcatctt

SEQ ID NO: 49554 - DNA, 20 bp, Artificial Sequence
  Description of Artificial Sequence: Synthetic oligonucleotide
  Target: ATXN1; (-) strand; PAM type: NRG; PAM sequence: GAG
tactttttaagccacttatt

SEQ ID NO: 49555 - DNA, 20 bp, Artificial Sequence
  Description of Artificial Sequence: Synthetic oligonucleotide
  Target: ATXN1; (-) strand; PAM type: NRG; PAM sequence: AAG
ttcctcttttcttacttttt

SEQ ID NO: 49556 - DNA, 20 bp, Artificial Sequence
  Description of Artificial Sequence: Synthetic oligonucleotide
  Target: ATXN1; (-) strand; PAM type: NRG; PAM sequence: AAG
cagtccatgtggacccacct

SEQ ID NO: 49557 - DNA, 20 bp, Artificial Sequence
  Description of Artificial Sequence: Synthetic oligonucleotide
  Target: ATXN1; (-) strand; PAM type: NRG; PAM sequence: TGG
gtggatgtgtacagtccatg

SEQ ID NO: 49558 - DNA, 20 bp, Artificial Sequence
  Description of Artificial Sequence: Synthetic oligonucleotide
  Target: ATXN1; (-) strand; PAM type: NRG; PAM sequence: CAG
gcctgctgggtggatgtgta

SEQ ID NO: 49559 - DNA, 20 bp, Artificial Sequence
  Description of Artificial Sequence: Synthetic oligonucleotide
  Target: ATXN1; (-) strand; PAM type: NRG; PAM sequence: TGG
acattctatagcctgctggg

SEQ ID NO: 49560 - DNA, 20 bp, Artificial Sequence
  Description of Artificial Sequence: Synthetic oligonucleotide
  Target: ATXN1; (-) strand; PAM type: NRG; PAM sequence: GGG
gaaacattctatagcctgct

SEQ ID NO: 49561 - DNA, 20 bp, Artificial Sequence
  Description of Artificial Sequence: Synthetic oligonucleotide
  Target: ATXN1; (-) strand; PAM type: NRG; PAM sequence: TGG
agaaacattctatagcctgc

SEQ ID NO: 49562 - DNA, 20 bp, Artificial Sequence
  Description of Artificial Sequence: Synthetic oligonucleotide
  Target: ATXN1; (-) strand; PAM type: NRG; PAM sequence: TAG
cttgggagagaaacattcta

SEQ ID NO: 49563 - DNA, 20 bp, Artificial Sequence
  Description of Artificial Sequence: Synthetic oligonucleotide
  Target: ATXN1; (-) strand; PAM type: NRG; PAM sequence: GAG
ccaattcattgcccttggga

SEQ ID NO: 49564 - DNA, 20 bp, Artificial Sequence
  Description of Artificial Sequence: Synthetic oligonucleotide
  Target: ATXN1; (-) strand; PAM type: NRG; PAM sequence: GAG
aaccaattcattgcccttgg

SEQ ID NO: 49565 - DNA, 20 bp, Artificial Sequence
  Description of Artificial Sequence: Synthetic oligonucleotide
  Target: ATXN1; (-) strand; PAM type: NRG; PAM sequence: GGG
taaaccaattcattgccctt

SEQ ID NO: 49566 - DNA, 20 bp, Artificial Sequence
  Description of Artificial Sequence: Synthetic oligonucleotide
  Target: ATXN1; (-) strand; PAM type: NRG; PAM sequence: TGG
ctaaaccaattcattgccct

SEQ ID NO: 49567 - DNA, 20 bp, Artificial Sequence
  Description of Artificial Sequence: Synthetic oligonucleotide
  Target: ATXN1; (-) strand; PAM type: NRG; PAM sequence: TGG
ctcctttgaagaaaatcctg

SEQ ID NO: 49568 - DNA, 20 bp, Artificial Sequence
  Description of Artificial Sequence: Synthetic oligonucleotide
  Target: ATXN1; (-) strand; PAM type: NRG; PAM sequence: AAG
catgttgaggacctcctttg

SEQ ID NO: 49569 - DNA, 20 bp, Artificial Sequence
  Description of Artificial Sequence: Synthetic oligonucleotide
  Target: ATXN1; (-) strand; PAM type: NRG; PAM sequence: AGG
aagtacccgctggcatgttg

SEQ ID NO: 49570 - DNA, 20 bp, Artificial Sequence
  Description of Artificial Sequence: Synthetic oligonucleotide
  Target: ATXN1; (-) strand; PAM type: NRG; PAM sequence: GAG
gaagtacccgctggcatgtt

SEQ ID NO: 49571 - DNA, 20 bp, Artificial Sequence
  Description of Artificial Sequence: Synthetic oligonucleotide
  Target: ATXN1; (-) strand; PAM type: NRG; PAM sequence: TGG
aaaatcagggaagtacccgc

SEQ ID NO: 49572 - DNA, 20 bp, Artificial Sequence
  Description of Artificial Sequence: Synthetic oligonucleotide
  Target: ATXN1; (-) strand; PAM type: NRG; PAM sequence: AAG
catcctgaccaaaatcaggg

SEQ ID NO: 49573 - DNA, 20 bp, Artificial Sequence
  Description of Artificial Sequence: Synthetic oligonucleotide
  Target: ATXN1; (-) strand; PAM type: NRG; PAM sequence: GGG
ttgcatcctgaccaaaatca

SEQ ID NO: 49574 - DNA, 20 bp, Artificial Sequence
  Description of Artificial Sequence: Synthetic oligonucleotide
  Target: ATXN1; (-) strand; PAM type: NRG; PAM sequence: AGG
attgcatcctgaccaaaatc

SEQ ID NO: 49575 - DNA, 20 bp, Artificial Sequence
  Description of Artificial Sequence: Synthetic oligonucleotide
  Target: ATXN1; (-) strand; PAM type: NRG; PAM sequence: CAG
gattgcatcctgaccaaaat

SEQ ID NO: 49576 - DNA, 20 bp, Artificial Sequence
  Description of Artificial Sequence: Synthetic oligonucleotide
  Target: ATXN1; (-) strand; PAM type: NRG; PAM sequence: TGG
acaagccagtgatgtacacc

SEQ ID NO: 49577 - DNA, 20 bp, Artificial Sequence
  Description of Artificial Sequence: Synthetic oligonucleotide
  Target: ATXN1; (-) strand; PAM type: NRG; PAM sequence: CAG
agattacagatgtcacaagc

SEQ ID NO: 49578 - DNA, 20 bp, Artificial Sequence
  Description of Artificial Sequence: Synthetic oligonucleotide
  Target: ATXN1; (-) strand; PAM type: NRG; PAM sequence: AAG
gggcagattacagatgtcac

SEQ ID NO: 49579 - DNA, 20 bp, Artificial Sequence
  Description of Artificial Sequence: Synthetic oligonucleotide
  Target: ATXN1; (-) strand; PAM type: NRG; PAM sequence: CAG
tctgtgatctgggcagatta

SEQ ID NO: 49580 - DNA, 20 bp, Artificial Sequence
  Description of Artificial Sequence: Synthetic oligonucleotide
  Target: ATXN1; (-) strand; PAM type: NRG; PAM sequence: CAG
ctgcgcatctgtgatctggg

SEQ ID NO: 49581 - DNA, 20 bp, Artificial Sequence
  Description of Artificial Sequence: Synthetic oligonucleotide
  Target: ATXN1; (-) strand; PAM type: NRG; PAM sequence: GGG
tttctgcgcatctgtgatct

SEQ ID NO: 49582 - DNA, 20 bp, Artificial Sequence
  Description of Artificial Sequence: Synthetic oligonucleotide
  Target: ATXN1; (-) strand; PAM type: NRG; PAM sequence: TGG
gtttctgcgcatctgtgatc

SEQ ID NO: 49583 - DNA, 20 bp, Artificial Sequence
  Description of Artificial Sequence: Synthetic oligonucleotide
  Target: ATXN1; (-) strand; PAM type: NRG; PAM sequence: GGG
tggcttctgttctaagcaga

SEQ ID NO: 49584 - DNA, 20 bp, Artificial Sequence
  Description of Artificial Sequence: Synthetic oligonucleotide
  Target: ATXN1; (-) strand; PAM type: NRG; PAM sequence: AGG
ctggcttctgttctaagcag

SEQ ID NO: 49585 - DNA, 20 bp, Artificial Sequence
  Description of Artificial Sequence: Synthetic oligonucleotide
  Target: ATXN1; (-) strand; PAM type: NRG; PAM sequence: GAG
cctggcttctgttctaagca

SEQ ID NO: 49586 - DNA, 20 bp, Artificial Sequence
  Description of Artificial Sequence: Synthetic oligonucleotide
  Target: ATXN1; (-) strand; PAM type: NRG; PAM sequence: CAG
ctcctggcttctgttctaag

SEQ ID NO: 49587 - DNA, 20 bp, Artificial Sequence
  Description of Artificial Sequence: Synthetic oligonucleotide
  Target: ATXN1; (-) strand; PAM type: NRG; PAM sequence: AAG
cttctcctggcttctgttct

SEQ ID NO: 49588 - DNA, 20 bp, Artificial Sequence
  Description of Artificial Sequence: Synthetic oligonucleotide
  Target: ATXN1; (-) strand; PAM type: NRG; PAM sequence: TGG
atgtattcagccccttctcc

SEQ ID NO: 49589 - DNA, 20 bp, Artificial Sequence
  Description of Artificial Sequence: Synthetic oligonucleotide
  Target: ATXN1; (-) strand; PAM type: NRG; PAM sequence: CAG
atcttaaagatgcatgtatt

SEQ ID NO: 49590 - DNA, 20 bp, Artificial Sequence
  Description of Artificial Sequence: Synthetic oligonucleotide
  Target: ATXN1; (-) strand; PAM type: NRG; PAM sequence: AAG
ttccgtgggtatgaatctta

SEQ ID NO: 49591 - DNA, 20 bp, Artificial Sequence
  Description of Artificial Sequence: Synthetic oligonucleotide
  Target: ATXN1; (-) strand; PAM type: NRG; PAM sequence: GGG
taggagagtctctgttccgt

SEQ ID NO: 49592 - DNA, 20 bp, Artificial Sequence
  Description of Artificial Sequence: Synthetic oligonucleotide
  Target: ATXN1; (-) strand; PAM type: NRG; PAM sequence: TGG
ctaggagagtctctgttccg

SEQ ID NO: 49593 - DNA, 20 bp, Artificial Sequence
  Description of Artificial Sequence: Synthetic oligonucleotide
  Target: ATXN1; (-) strand; PAM type: NRG; PAM sequence: GAG
ttgtgaacagatgactagga

SEQ ID NO: 49594 - DNA, 20 bp, Artificial Sequence
  Description of Artificial Sequence: Synthetic oligonucleotide
  Target: ATXN1; (-) strand; PAM type: NRG; PAM sequence: GAG
gtttgtgaacagatgactag

SEQ ID NO: 49595 - DNA, 20 bp, Artificial Sequence
  Description of Artificial Sequence: Synthetic oligonucleotide
  Target: ATXN1; (-) strand; PAM type: NRG; PAM sequence: AGG
aagtttgtgaacagatgact

SEQ ID NO: 49596 - DNA, 20 bp, Artificial Sequence
  Description of Artificial Sequence: Synthetic oligonucleotide
  Target: ATXN1; (-) strand; PAM type: NRG; PAM sequence: TAG
aaagtttgtgaacagatgac

SEQ ID NO: 49597 - DNA, 20 bp, Artificial Sequence
  Description of Artificial Sequence: Synthetic oligonucleotide
  Target: ATXN1; (-) strand; PAM type: NRG; PAM sequence: CAG
actcactgaaagtttgtgaa

SEQ ID NO: 49598 - DNA, 20 bp, Artificial Sequence
  Description of Artificial Sequence: Synthetic oligonucleotide
  Target: ATXN1; (-) strand; PAM type: NRG; PAM sequence: AAG
atatagtagacactcactga

SEQ ID NO: 49599 - DNA, 20 bp, Artificial Sequence
  Description of Artificial Sequence: Synthetic oligonucleotide
  Target: ATXN1; (-) strand; PAM type: NRG; PAM sequence: TAG
gtggtctgcctggcatatag

SEQ ID NO: 49600 - DNA, 20 bp, Artificial Sequence
  Description of Artificial Sequence: Synthetic oligonucleotide
  Target: ATXN1; (-) strand; PAM type: NRG; PAM sequence: TAG
actgtggtctgcctggcata

SEQ ID NO: 49601 - DNA, 20 bp, Artificial Sequence
  Description of Artificial Sequence: Synthetic oligonucleotide
  Target: ATXN1; (-) strand; PAM type: NRG; PAM sequence: TGG
tttttgcactgtggtctgcc

SEQ ID NO: 49602 - DNA, 20 bp, Artificial Sequence
  Description of Artificial Sequence: Synthetic oligonucleotide
  Target: ATXN1; (-) strand; PAM type: NRG; PAM sequence: TGG
aagcttaattttttgcactg

SEQ ID NO: 49603 - DNA, 20 bp, Artificial Sequence
  Description of Artificial Sequence: Synthetic oligonucleotide
  Target: ATXN1; (-) strand; PAM type: NRG; PAM sequence: AAG
aatgatatttaagggttatt

SEQ ID NO: 49604 - DNA, 20 bp, Artificial Sequence
  Description of Artificial Sequence: Synthetic oligonucleotide
  Target: ATXN1; (-) strand; PAM type: NRG; PAM sequence: GGG
aaccagagaatgatatttaa

SEQ ID NO: 49605 - DNA, 20 bp, Artificial Sequence
  Description of Artificial Sequence: Synthetic oligonucleotide
  Target: ATXN1; (-) strand; PAM type: NRG; PAM sequence: AGG
gaaccagagaatgatattta

SEQ ID NO: 49606 - DNA, 20 bp, Artificial Sequence
  Description of Artificial Sequence: Synthetic oligonucleotide
  Target: ATXN1; (-) strand; PAM type: NRG; PAM sequence: AAG
ggaaccagagaatgatattt

SEQ ID NO: 49607 - DNA, 20 bp, Artificial Sequence
  Description of Artificial Sequence: Synthetic oligonucleotide
  Target: ATXN1; (-) strand; PAM type: NRG; PAM sequence: GAG
tctgaagaggcctggaacca

SEQ ID NO: 49608 - DNA, 20 bp, Artificial Sequence
  Description of Artificial Sequence: Synthetic oligonucleotide
  Target: ATXN1; (-) strand; PAM type: NRG; PAM sequence: CAG
cttctgaagaggcctggaac

SEQ ID NO: 49609 - DNA, 20 bp, Artificial Sequence
  Description of Artificial Sequence: Synthetic oligonucleotide
  Target: ATXN1; (-) strand; PAM type: NRG; PAM sequence: TGG
gccaagcttctgaagaggcc

SEQ ID NO: 49610 - DNA, 20 bp, Artificial Sequence
  Description of Artificial Sequence: Synthetic oligonucleotide
  Target: ATXN1; (-) strand; PAM type: NRG; PAM sequence: AGG
aaatagccaagcttctgaag

SEQ ID NO: 49611 - DNA, 20 bp, Artificial Sequence
  Description of Artificial Sequence: Synthetic oligonucleotide
  Target: ATXN1; (-) strand; PAM type: NRG; PAM sequence: GAG
taaatagccaagcttctgaa

SEQ ID NO: 49612 - DNA, 20 bp, Artificial Sequence
  Description of Artificial Sequence: Synthetic oligonucleotide
  Target: ATXN1; (-) strand; PAM type: NRG; PAM sequence: AAG
aataaatagccaagcttctg

SEQ ID NO: 49613 - DNA, 20 bp, Artificial Sequence
  Description of Artificial Sequence: Synthetic oligonucleotide
  Target: ATXN1; (-) strand; PAM type: NRG; PAM sequence: AAG
atattagataataaatagcc

SEQ ID NO: 49614 - DNA, 20 bp, Artificial Sequence
  Description of Artificial Sequence: Synthetic oligonucleotide
  Target: ATXN1; (-) strand; PAM type: NRG; PAM sequence: TAG
caagaatattagataataaa

SEQ ID NO: 49615 - DNA, 20 bp, Artificial Sequence
  Description of Artificial Sequence: Synthetic oligonucleotide
  Target: ATXN1; (-) strand; PAM type: NRG; PAM sequence: TAG
acaggaactcacaagaatat

SEQ ID NO: 49616 - DNA, 20 bp, Artificial Sequence
  Description of Artificial Sequence: Synthetic oligonucleotide
  Target: ATXN1; (-) strand; PAM type: NRG; PAM sequence: AAG
atccagacacaggaactcac

SEQ ID NO: 49617 - DNA, 20 bp, Artificial Sequence
  Description of Artificial Sequence: Synthetic oligonucleotide
  Target: ATXN1; (-) strand; PAM type: NRG; PAM sequence: AGG
aaacacagaaatccagacac

SEQ ID NO: 49618 - DNA, 20 bp, Artificial Sequence
  Description of Artificial Sequence: Synthetic oligonucleotide
  Target: ATXN1; (-) strand; PAM type: NRG; PAM sequence: CAG
taaacacagaaatccagaca

SEQ ID NO: 49619 - DNA, 20 bp, Artificial Sequence
  Description of Artificial Sequence: Synthetic oligonucleotide
  Target: ATXN1; (-) strand; PAM type: NRG; PAM sequence: CAG
agagcctaaacacagaaatc

SEQ ID NO: 49620 - DNA, 20 bp, Artificial Sequence
  Description of Artificial Sequence: Synthetic oligonucleotide
  Target: ATXN1; (-) strand; PAM type: NRG; PAM sequence: CAG
tccctaaaagagcctaaaca

SEQ ID NO: 49621 - DNA, 20 bp, Artificial Sequence
  Description of Artificial Sequence: Synthetic oligonucleotide
  Target: ATXN1; (-) strand; PAM type: NRG; PAM sequence: GAG
tccttactatctccctaaaa

SEQ ID NO: 49622 - DNA, 20 bp, Artificial Sequence
  Description of Artificial Sequence: Synthetic oligonucleotide
  Target: ATXN1; (-) strand; PAM type: NRG; PAM sequence: AAG
gttccttactatctccctaa

SEQ ID NO: 49623 - DNA, 20 bp, Artificial Sequence
  Description of Artificial Sequence: Synthetic oligonucleotide
  Target: ATXN1; (-) strand; PAM type: NRG; PAM sequence: CAG
aaaaaaagtcacatggatgc

SEQ ID NO: 49624 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaaaaaaagtcaca

SEQ ID NO: 49625 - DNA, 20 bp, Artificial Sequence
  Description of Artificial Sequence: Synthetic oligonucleotide
  Target: ATXN1; (-) strand; PAM type: NRG; PAM sequence: AAG
aggcttttaaaaaaaaaaaa

SEQ ID NO: 49626 - DNA, 20 bp, Artificial Sequence
  Description of Artificial Sequence: Synthetic oligonucleotide
  Target: ATXN1; (-) strand; PAM type: NRG; PAM sequence: AGG
ctggcattttcaggcagaga

SEQ ID NO: 49627 - DNA, 20 bp, Artificial Sequence
  Description of Artificial Sequence: Synthetic oligonucleotide
  Target: ATXN1; (-) strand; PAM type: NRG; PAM sequence: AAG
tctggcattttcaggcagag

SEQ ID NO: 49628 - DNA, 20 bp, Artificial Sequence
  Description of Artificial Sequence: Synthetic oligonucleotide
  Target: ATXN1; (-) strand; PAM type: NRG; PAM sequence: GAG
gtgtctggcattttcaggca

SEQ ID NO: 49629 - DNA, 20 bp, Artificial Sequence
  Description of Artificial Sequence: Synthetic oligonucleotide
  Target: ATXN1; (-) strand; PAM type: NRG; PAM sequence: CAG
atgtgtctggcattttcagg

SEQ ID NO: 49630 - DNA, 20 bp, Artificial Sequence
  Description of Artificial Sequence: Synthetic oligonucleotide
  Target: ATXN1; (-) strand; PAM type: NRG; PAM sequence: AGG
gaaatgtgtctggcattttc

SEQ ID NO: 49631 - DNA, 20 bp, Artificial Sequence
  Description of Artificial Sequence: Synthetic oligonucleotide
  Target: ATXN1; (-) strand; PAM type: NRG; PAM sequence: CAG
tgaaatgtgtctggcatttt

SEQ ID NO: 49632 - DNA, 20 bp, Artificial Sequence
  Description of Artificial Sequence: Synthetic oligonucleotide
  Target: ATXN1; (-) strand; PAM type: NRG; PAM sequence: TGG
tttgacatctgaaatgtgtc

SEQ ID NO: 49633 - DNA, 20 bp, Artificial Sequence
  Description of Artificial Sequence: Synthetic oligonucleotide
  Target: ATXN1; (-) strand; PAM type: NRG; PAM sequence: TAG
acccaccctgaatgccacgt

SEQ ID NO: 49634 - DNA, 20 bp, Artificial Sequence
  Description of Artificial Sequence: Synthetic oligonucleotide
  Target: ATXN1; (-) strand; PAM type: NRG; PAM sequence: CAG
ttaagagcactcacatggat

SEQ ID NO: 49635 - DNA, 20 bp, Artificial Sequence
  Description of Artificial Sequence: Synthetic oligonucleotide
  Target: ATXN1; (-) strand; PAM type: NRG; PAM sequence: TGG
cccacttaagagcactcaca

SEQ ID NO: 49636 - DNA, 20 bp, Artificial Sequence
  Description of Artificial Sequence: Synthetic oligonucleotide
  Target: ATXN1; (-) strand; PAM type: NRG; PAM sequence: GAG
aggcttctacacccacttaa

SEQ ID NO: 49637 - DNA, 20 bp, Artificial Sequence
  Description of Artificial Sequence: Synthetic oligonucleotide
  Target: ATXN1; (-) strand; PAM type: NRG; PAM sequence: AAG
acaggcttctacacccactt

SEQ ID NO: 49638 - DNA, 20 bp, Artificial Sequence
  Description of Artificial Sequence: Synthetic oligonucleotide
  Target: ATXN1; (-) strand; PAM type: NRG; PAM sequence: AGG
gaaaagacaatgagccagac

SEQ ID NO: 49639 - DNA, 20 bp, Artificial Sequence
  Description of Artificial Sequence: Synthetic oligonucleotide
  Target: ATXN1; (-) strand; PAM type: NRG; PAM sequence: CAG
agaaaagacaatgagccaga

SEQ ID NO: 49640 - DNA, 20 bp, Artificial Sequence
  Description of Artificial Sequence: Synthetic oligonucleotide
  Target: ATXN1; (-) strand; PAM type: NRG; PAM sequence: CAG
gtgcagaaaagacaatgagc

SEQ ID NO: 49641 - DNA, 20 bp, Artificial Sequence
  Description of Artificial Sequence: Synthetic oligonucleotide
  Target: ATXN1; (-) strand; PAM type: NRG; PAM sequence: GAG
gcgtgtgcagaaaagacaat

SEQ ID NO: 49642 - DNA, 20 bp, Artificial Sequence
  Description of Artificial Sequence: Synthetic oligonucleotide
  Target: ATXN1; (-) strand; PAM type: NRG; PAM sequence: AAG
ttgaatgcgcgtgtgcagaa

SEQ ID NO: 49643 - DNA, 20 bp, Artificial Sequence
  Description of Artificial Sequence: Synthetic oligonucleotide
  Target: ATXN1; (-) strand; PAM type: NRG; PAM sequence: CAG
cacatttgaatgcgcgtgtg

SEQ ID NO: 49644 - DNA, 20 bp, Artificial Sequence
  Description of Artificial Sequence: Synthetic oligonucleotide
  Target: ATXN1; (-) strand; PAM type: NRG; PAM sequence: AAG
aagagctatttatggcctac

SEQ ID NO: 49645 - DNA, 20 bp, Artificial Sequence
  Description of Artificial Sequence: Synthetic oligonucleotide
  Target: ATXN1; (-) strand; PAM type: NRG; PAM sequence: TGG
actcccctaagagctattta

SEQ ID NO: 49646 - DNA, 20 bp, Artificial Sequence
  Description of Artificial Sequence: Synthetic oligonucleotide
  Target: ATXN1; (-) strand; PAM type: NRG; PAM sequence: GAG
gtaatctcacactcccctaa

SEQ ID NO: 49647 - DNA, 20 bp, Artificial Sequence
  Description of Artificial Sequence: Synthetic oligonucleotide
  Target: ATXN1; (-) strand; PAM type: NRG; PAM sequence: AAG
atgtaatctcacactcccct

SEQ ID NO: 49648 - DNA, 20 bp, Artificial Sequence
  Description of Artificial Sequence: Synthetic oligonucleotide
  Target: ATXN1; (-) strand; PAM type: NRG; PAM sequence: GAG
tgaggtaacggggccctctt

SEQ ID NO: 49649 - DNA, 20 bp, Artificial Sequence
  Description of Artificial Sequence: Synthetic oligonucleotide
  Target: ATXN1; (-) strand; PAM type: NRG; PAM sequence: GGG
ttcactgatttgaggtaacg

SEQ ID NO: 49650 - DNA, 20 bp, Artificial Sequence
  Description of Artificial Sequence: Synthetic oligonucleotide
  Target: ATXN1; (-) strand; PAM type: NRG; PAM sequence: GGG
attcactgatttgaggtaac

SEQ ID NO: 49651 - DNA, 20 bp, Artificial Sequence
  Description of Artificial Sequence: Synthetic oligonucleotide
  Target: ATXN1; (-) strand; PAM type: NRG; PAM sequence: CGG
cattcactgatttgaggtaa

SEQ ID NO: 49652 - DNA, 20 bp, Artificial Sequence
  Description of Artificial Sequence: Synthetic oligonucleotide
  Target: ATXN1; (-) strand; PAM type: NRG; PAM sequence: AGG
gtcaagcattcactgatttg

SEQ ID NO: 49653 - DNA, 20 bp, Artificial Sequence
  Description of Artificial Sequence: Synthetic oligonucleotide
  Target: ATXN1; (-) strand; PAM type: NRG; PAM sequence: GAG
tgtcaagcattcactgattt

SEQ ID NO: 49654 - DNA, 20 bp, Artificial Sequence
  Description of Artificial Sequence: Synthetic oligonucleotide
  Target: ATXN1; (-) strand; PAM type: NRG; PAM sequence: AAG
tttttggggagatgagtgtc

SEQ ID NO: 49655 - DNA, 20 bp, Artificial Sequence
  Description of Artificial Sequence: Synthetic oligonucleotide
  Target: ATXN1; (-) strand; PAM type: NRG; PAM sequence: GAG
gcatgcctttttggggagat

SEQ ID NO: 49656 - DNA, 20 bp, Artificial Sequence
  Description of Artificial Sequence: Synthetic oligonucleotide
  Target: ATXN1; (-) strand; PAM type: NRG; PAM sequence: GAG
caacagcatgcctttttggg

SEQ ID NO: 49657 - DNA, 20 bp, Artificial Sequence
  Description of Artificial Sequence: Synthetic oligonucleotide
  Target: ATXN1; (-) strand; PAM type: NRG; PAM sequence: GGG
ttcaacagcatgcctttttg

SEQ ID NO: 49658 - DNA, 20 bp, Artificial Sequence
  Description of Artificial Sequence: Synthetic oligonucleotide
  Target: ATXN1; (-) strand; PAM type: NRG; PAM sequence: GGG
tttcaacagcatgccttttt

SEQ ID NO: 49659 - DNA, 20 bp, Artificial Sequence
  Description of Artificial Sequence: Synthetic oligonucleotide
  Target: ATXN1; (-) strand; PAM type: NRG; PAM sequence: TGG
ttttcaacagcatgcctttt

SEQ ID NO: 49660 - DNA, 20 bp, Artificial Sequence
  Description of Artificial Sequence: Synthetic oligonucleotide
  Target: ATXN1; (-) strand; PAM type: NRG; PAM sequence: CAG
tctagtatctgcattttcaa

SEQ ID NO: 49661 - DNA, 20 bp, Artificial Sequence
  Description of Artificial Sequence: Synthetic oligonucleotide
  Target: ATXN1; (-) strand; PAM type: NRG; PAM sequence: TAG
tttgggggtcagggtgagtc

SEQ ID NO: 49662 - DNA, 20 bp, Artificial Sequence
  Description of Artificial Sequence: Synthetic oligonucleotide
  Target: ATXN1; (-) strand; PAM type: NRG; PAM sequence: GAG
agttttttgggggtcagggt

SEQ ID NO: 49663 - DNA, 20 bp, Artificial Sequence
  Description of Artificial Sequence: Synthetic oligonucleotide
  Target: ATXN1; (-) strand; PAM type: NRG; PAM sequence: GGG
tggtagttttttgggggtca

SEQ ID NO: 49664 - DNA, 20 bp, Artificial Sequence
  Description of Artificial Sequence: Synthetic oligonucleotide
  Target: ATXN1; (-) strand; PAM type: NRG; PAM sequence: AGG
gtggtagttttttgggggtc

SEQ ID NO: 49665 - DNA, 20 bp, Artificial Sequence
  Description of Artificial Sequence: Synthetic oligonucleotide
  Target: ATXN1; (-) strand; PAM type: NRG; PAM sequence: CAG
agtggtagttttttgggggt

SEQ ID NO: 49666 - DNA, 20 bp, Artificial Sequence
  Description of Artificial Sequence: Synthetic oligonucleotide
  Target: ATXN1; (-) strand; PAM type: NRG; PAM sequence: GGG
tgccagtggtagttttttgg

SEQ ID NO: 49667 - DNA, 20 bp, Artificial Sequence
  Description of Artificial Sequence: Synthetic oligonucleotide
  Target: ATXN1; (-) strand; PAM type: NRG; PAM sequence: GGG
ctgccagtggtagttttttg

SEQ ID NO: 49668 - DNA, 20 bp, Artificial Sequence
  Description of Artificial Sequence: Synthetic oligonucleotide
  Target: ATXN1; (-) strand; PAM type: NRG; PAM sequence: GGG
cctgccagtggtagtttttt

SEQ ID NO: 49669 - DNA, 20 bp, Artificial Sequence
  Description of Artificial Sequence: Synthetic oligonucleotide
  Target: ATXN1; (-) strand; PAM type: NRG; PAM sequence: TGG
gcctgccagtggtagttttt

SEQ ID NO: 49670 - DNA, 20 bp, Artificial Sequence
  Description of Artificial Sequence: Synthetic oligonucleotide
  Target: ATXN1; (-) strand; PAM type: NRG; PAM sequence: TAG
ataacaatgcctgccagtgg

SEQ ID NO: 49671 - DNA, 20 bp, Artificial Sequence
  Description of Artificial Sequence: Synthetic oligonucleotide
  Target: ATXN1; (-) strand; PAM type: NRG; PAM sequence: TGG
cccataacaatgcctgccag

SEQ ID NO: 49672 - DNA, 20 bp, Artificial Sequence
  Description of Artificial Sequence: Synthetic oligonucleotide
  Target: ATXN1; (-) strand; PAM type: NRG; PAM sequence: CAG
cagcccataacaatgcctgc

SEQ ID NO: 49673 - DNA, 20 bp, Artificial Sequence
  Description of Artificial Sequence: Synthetic oligonucleotide
  Target: ATXN1; (-) strand; PAM type: NRG; PAM sequence: CAG
aaatttggagggacagaatt

SEQ ID NO: 49674 - DNA, 20 bp, Artificial Sequence
  Description of Artificial Sequence: Synthetic oligonucleotide
  Target: ATXN1; (-) strand; PAM type: NRG; PAM sequence: CAG
aatatataaatttggaggga

SEQ ID NO: 49675 - DNA, 20 bp, Artificial Sequence
  Description of Artificial Sequence: Synthetic oligonucleotide
  Target: ATXN1; (-) strand; PAM type: NRG; PAM sequence: GGG
tgtcaatatataaatttgga

SEQ ID NO: 49676 - DNA, 20 bp, Artificial Sequence
  Description of Artificial Sequence: Synthetic oligonucleotide
  Target: ATXN1; (-) strand; PAM type: NRG; PAM sequence: AGG
atgtcaatatataaatttgg

SEQ ID NO: 49677 - DNA, 20 bp, Artificial Sequence
  Description of Artificial Sequence: Synthetic oligonucleotide
  Target: ATXN1; (-) strand; PAM type: NRG; PAM sequence: GAG
gatgtcaatatataaatttg

SEQ ID NO: 49678 - DNA, 20 bp, Artificial Sequence
  Description of Artificial Sequence: Synthetic oligonucleotide
  Target: ATXN1; (-) strand; PAM type: NRG; PAM sequence: TGG
aggatgtcaatatataaatt

SEQ ID NO: 49679 - DNA, 20 bp, Artificial Sequence
  Description of Artificial Sequence: Synthetic oligonucleotide
  Target: ATXN1; (-) strand; PAM type: NRG; PAM sequence: AGG
attcagaggtattaggggtc

SEQ ID NO: 49680 - DNA, 20 bp, Artificial Sequence
  Description of Artificial Sequence: Synthetic oligonucleotide
  Target: ATXN1; (-) strand; PAM type: NRG; PAM sequence: CAG
cattcagaggtattaggggt

SEQ ID NO: 49681 - DNA, 20 bp, Artificial Sequence
  Description of Artificial Sequence: Synthetic oligonucleotide
  Target: ATXN1; (-) strand; PAM type: NRG; PAM sequence: GGG
ttcacattcagaggtattag

SEQ ID NO: 49682 - DNA, 20 bp, Artificial Sequence
  Description of Artificial Sequence: Synthetic oligonucleotide
  Target: ATXN1; (-) strand; PAM type: NRG; PAM sequence: GGG
gttcacattcagaggtatta

SEQ ID NO: 49683 - DNA, 20 bp, Artificial Sequence
  Description of Artificial Sequence: Synthetic oligonucleotide
  Target: ATXN1; (-) strand; PAM type: NRG; PAM sequence: AGG
agttcacattcagaggtatt

SEQ ID NO: 49684 - DNA, 20 bp, Artificial Sequence
  Description of Artificial Sequence: Synthetic oligonucleotide
  Target: ATXN1; (-) strand; PAM type: NRG; PAM sequence: TAG
aagttcacattcagaggtat

SEQ ID NO: 49685 - DNA, 20 bp, Artificial Sequence
  Description of Artificial Sequence: Synthetic oligonucleotide
  Target: ATXN1; (-) strand; PAM type: NRG; PAM sequence: AGG
ccaagtaagttcacattcag

SEQ ID NO: 49686 - DNA, 20 bp, Artificial Sequence
  Description of Artificial Sequence: Synthetic oligonucleotide
  Target: ATXN1; (-) strand; PAM type: NRG; PAM sequence: GAG
tccaagtaagttcacattca

SEQ ID NO: 49687 - DNA, 20 bp, Artificial Sequence
  Description of Artificial Sequence: Synthetic oligonucleotide
  Target: ATXN1; (-) strand; PAM type: NRG; PAM sequence: CAG
tttccaagtaagttcacatt

SEQ ID NO: 49688 - DNA, 20 bp, Artificial Sequence
  Description of Artificial Sequence: Synthetic oligonucleotide
  Target: ATXN1; (-) strand; PAM type: NRG; PAM sequence: AAG
caacaaccctatttccaagt

SEQ ID NO: 49689 - DNA, 20 bp, Artificial Sequence
  Description of Artificial Sequence: Synthetic oligonucleotide
  Target: ATXN1; (-) strand; PAM type: NRG; PAM sequence: AAG
tctgcaacaaccctatttcc

SEQ ID NO: 49690 - DNA, 20 bp, Artificial Sequence
  Description of Artificial Sequence: Synthetic oligonucleotide
  Target: ATXN1; (-) strand; PAM type: NRG; PAM sequence: AGG
attaggaacccctctcctcc

SEQ ID NO: 49691 - DNA, 20 bp, Artificial Sequence
  Description of Artificial Sequence: Synthetic oligonucleotide
  Target: ATXN1; (-) strand; PAM type: NRG; PAM sequence: CAG
gattaggaacccctctcctc

SEQ ID NO: 49692 - DNA, 20 bp, Artificial Sequence
  Description of Artificial Sequence: Synthetic oligonucleotide
  Target: ATXN1; (-) strand; PAM type: NRG; PAM sequence: AGG
gacaccagttctgtcagatt

SEQ ID NO: 49693 - DNA, 20 bp, Artificial Sequence
  Description of Artificial Sequence: Synthetic oligonucleotide
  Target: ATXN1; (-) strand; PAM type: NRG; PAM sequence: TAG
ggacaccagttctgtcagat

SEQ ID NO: 49694 - DNA, 20 bp, Artificial Sequence
  Description of Artificial Sequence: Synthetic oligonucleotide
  Target: ATXN1; (-) strand; PAM type: NRG; PAM sequence: CAG
cacaaggacaccagttctgt

SEQ ID NO: 49695 - DNA, 20 bp, Artificial Sequence
  Description of Artificial Sequence: Synthetic oligonucleotide
  Target: ATXN1; (-) strand; PAM type: NRG; PAM sequence: CAG
tccccttttcacaaggacac

SEQ ID NO: 49696 - DNA, 20 bp, Artificial Sequence
  Description of Artificial Sequence: Synthetic oligonucleotide
  Target: ATXN1; (-) strand; PAM type: NRG; PAM sequence: AGG
ccacatttccccttttcaca

SEQ ID NO: 49697 - DNA, 20 bp, Artificial Sequence
  Description of Artificial Sequence: Synthetic oligonucleotide
  Target: ATXN1; (-) strand; PAM type: NRG; PAM sequence: AAG
cccacatttccccttttcac

SEQ ID NO: 49698 - DNA, 20 bp, Artificial Sequence
  Description of Artificial Sequence: Synthetic oligonucleotide
  Target: ATXN1; (-) strand; PAM type: NRG; PAM sequence: CAG
caggcgtgagccaccgcgcc

SEQ ID NO: 49699 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 49700 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 49701 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 49702 - DNA, 20 bp, Artificial Sequence
  Description of Artificial Sequence: Synthetic oligonucleotide
  Target: ATXN1; (-) strand; PAM type: NRG; PAM sequence: GGG
cctcgacctcccaaagtgct

SEQ ID NO: 49703 - DNA, 20 bp, Artificial Sequence
  Description of Artificial Sequence: Synthetic oligonucleotide
  Target: ATXN1; (-) strand; PAM type: NRG; PAM sequence: TGG
gcctcgacctcccaaagtgc

SEQ ID NO: 49704 - DNA, 20 bp, Artificial Sequence
  Description of Artificial Sequence: Synthetic oligonucleotide
  Target: ATXN1; (-) strand; PAM type: NRG; PAM sequence: AAG
ccgcctgcctcgacctccca

SEQ ID NO: 49705 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggctagac

SEQ ID NO: 49706 - DNA, 20 bp, Artificial Sequence
  Description of Artificial Sequence: Synthetic oligonucleotide
  Target: ATXN1; (-) strand; PAM type: NRG; PAM sequence: TAG
cagggtttcaccatgttggc

SEQ ID NO: 49707 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcaccatgt

SEQ ID NO: 49708 - DNA, 20 bp, Artificial Sequence
  Description of Artificial Sequence: Synthetic oligonucleotide
  Target: ATXN1; (-) strand; PAM type: NRG; PAM sequence: GGG
tttttgtaatagtagagaca

SEQ ID NO: 49709 - DNA, 20 bp, Artificial Sequence
  Description of Artificial Sequence: Synthetic oligonucleotide
  Target: ATXN1; (-) strand; PAM type: NRG; PAM sequence: AGG
atttttgtaatagtagagac

SEQ ID NO: 49710 - DNA, 20 bp, Artificial Sequence
  Description of Artificial Sequence: Synthetic oligonucleotide
  Target: ATXN1; (-) strand; PAM type: NRG; PAM sequence: CAG
aatttttgtaatagtagaga

SEQ ID NO: 49711 - DNA, 20 bp, Artificial Sequence
  Description of Artificial Sequence: Synthetic oligonucleotide
  Target: ATXN1; (-) strand; PAM type: NRG; PAM sequence: GAG
ggctaatttttgtaatagta

SEQ ID NO: 49712 - DNA, 20 bp, Artificial Sequence
  Description of Artificial Sequence: Synthetic oligonucleotide
  Target: ATXN1; (-) strand; PAM type: NRG; PAM sequence: TAG
caggctaatttttgtaatag

SEQ ID NO: 49713 - DNA, 20 bp, Artificial Sequence
  Description of Artificial Sequence: Synthetic oligonucleotide
  Target: ATXN1; (-) strand; PAM type: NRG; PAM sequence: TAG
cgccaggctaatttttgtaa

SEQ ID NO: 49714 - DNA, 20 bp, Artificial Sequence
  Description of Artificial Sequence: Synthetic oligonucleotide
  Target: ATXN1; (-) strand; PAM type: NRG; PAM sequence: AGG
taggcgcccgccaccacgcc

SEQ ID NO: 49715 - DNA, 20 bp, Artificial Sequence
  Description of Artificial Sequence: Synthetic oligonucleotide
  Target: ATXN1; (-) strand; PAM type: NRG; PAM sequence: CAG
ataggcgcccgccaccacgc

SEQ ID NO: 49716 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctggaattat

SEQ ID NO: 49717 - DNA, 20 bp, Artificial Sequence
  Description of Artificial Sequence: Synthetic oligonucleotide
  Target: ATXN1; (-) strand; PAM type: NRG; PAM sequence: TAG
ctcccgagtagctggaatta

SEQ ID NO: 49718 - DNA, 20 bp, Artificial Sequence
  Description of Artificial Sequence: Synthetic oligonucleotide
  Target: ATXN1; (-) strand; PAM type: NRG; PAM sequence: TGG
ccctcattctcccgagtagc

SEQ ID NO: 49719 - DNA, 20 bp, Artificial Sequence
  Description of Artificial Sequence: Synthetic oligonucleotide
  Target: ATXN1; (-) strand; PAM type: NRG; PAM sequence: TAG
tcctccctcattctcccgag

SEQ ID NO: 49720 - DNA, 20 bp, Artificial Sequence
  Description of Artificial Sequence: Synthetic oligonucleotide
  Target: ATXN1; (-) strand; PAM type: NRG; PAM sequence: GAG
ttctcctccctcattctccc

SEQ ID NO: 49721 - DNA, 20 bp, Artificial Sequence
  Description of Artificial Sequence: Synthetic oligonucleotide
  Target: ATXN1; (-) strand; PAM type: NRG; PAM sequence: GAG
cctctgcctcccaggttcaa

SEQ ID NO: 49722 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccaggttc

SEQ ID NO: 49723 - DNA, 20 bp, Artificial Sequence
  Description of Artificial Sequence: Synthetic oligonucleotide
  Target: ATXN1; (-) strand; PAM type: NRG; PAM sequence: AGG
tactgcaacctctgcctccc

SEQ ID NO: 49724 - DNA, 20 bp, Artificial Sequence
  Description of Artificial Sequence: Synthetic oligonucleotide
  Target: ATXN1; (-) strand; PAM type: NRG; PAM sequence: CAG
ttactgcaacctctgcctcc

SEQ ID NO: 49725 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggggtgcag

SEQ ID NO: 49726 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggggtg

SEQ ID NO: 49727 - DNA, 20 bp, Artificial Sequence
  Description of Artificial Sequence: Synthetic oligonucleotide
  Target: ATXN1; (-) strand; PAM type: NRG; PAM sequence: GGG
ttgctctgtcacccaggctg

SEQ ID NO: 49728 - DNA, 20 bp, Artificial Sequence
  Description of Artificial Sequence: Synthetic oligonucleotide
  Target: ATXN1; (-) strand; PAM type: NRG; PAM sequence: GGG
cttgctctgtcacccaggct

SEQ ID NO: 49729 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgtcacccaggc

SEQ ID NO: 49730 - DNA, 20 bp, Artificial Sequence
  Description of Artificial Sequence: Synthetic oligonucleotide
  Target: ATXN1; (-) strand; PAM type: NRG; PAM sequence: AGG
ggagtcttgctctgtcaccc

SEQ ID NO: 49731 - DNA, 20 bp, Artificial Sequence
  Description of Artificial Sequence: Synthetic oligonucleotide
  Target: ATXN1; (-) strand; PAM type: NRG; PAM sequence: CAG
tggagtcttgctctgtcacc

SEQ ID NO: 49732 - DNA, 20 bp, Artificial Sequence
  Description of Artificial Sequence: Synthetic oligonucleotide
  Target: ATXN1; (-) strand; PAM type: NRG; PAM sequence: GAG
cccctttttttttcatgatg

SEQ ID NO: 49733 - DNA, 20 bp, Artificial Sequence
  Description of Artificial Sequence: Synthetic oligonucleotide
  Target: ATXN1; (-) strand; PAM type: NRG; PAM sequence: TGG
tccccctttttttttcatga

SEQ ID NO: 49734 - DNA, 20 bp, Artificial Sequence
  Description of Artificial Sequence: Synthetic oligonucleotide
  Target: ATXN1; (-) strand; PAM type: NRG; PAM sequence: GAG
agcactctgcctgtgtgcct

SEQ ID NO: 49735 - DNA, 20 bp, Artificial Sequence
  Description of Artificial Sequence: Synthetic oligonucleotide
  Target: ATXN1; (-) strand; PAM type: NRG; PAM sequence: GAG
ctgtcactccagtcctcaca

SEQ ID NO: 49736 - DNA, 20 bp, Artificial Sequence
  Description of Artificial Sequence: Synthetic oligonucleotide
  Target: ATXN1; (-) strand; PAM type: NRG; PAM sequence: CAG
ctctgtcactccagtcctca

SEQ ID NO: 49737 - DNA, 20 bp, Artificial Sequence
  Description of Artificial Sequence: Synthetic oligonucleotide
  Target: ATXN1; (-) strand; PAM type: NRG; PAM sequence: CAG
agcatgtggctctgtcactc

SEQ ID NO: 49738 - DNA, 20 bp, Artificial Sequence
  Description of Artificial Sequence: Synthetic oligonucleotide
  Target: ATXN1; (-) strand; PAM type: NRG; PAM sequence: TGG
tctggtggctccttagcatg

SEQ ID NO: 49739 - DNA, 20 bp, Artificial Sequence
  Description of Artificial Sequence: Synthetic oligonucleotide
  Target: ATXN1; (-) strand; PAM type: NRG; PAM sequence: TAG
cctagcttctggtggctcct

SEQ ID NO: 49740 - DNA, 20 bp, Artificial Sequence
  Description of Artificial Sequence: Synthetic oligonucleotide
  Target: ATXN1; (-) strand; PAM type: NRG; PAM sequence: TGG
ggtcactccctagcttctgg

SEQ ID NO: 49741 - DNA, 20 bp, Artificial Sequence
  Description of Artificial Sequence: Synthetic oligonucleotide
  Target: ATXN1; (-) strand; PAM type: NRG; PAM sequence: TGG
ccaggtcactccctagcttc

SEQ ID NO: 49742 - DNA, 20 bp, Artificial Sequence
  Description of Artificial Sequence: Synthetic oligonucleotide
  Target: ATXN1; (-) strand; PAM type: NRG; PAM sequence: TAG
atctgttccaggtcactccc

SEQ ID NO: 49743 - DNA, 20 bp, Artificial Sequence
  Description of Artificial Sequence: Synthetic oligonucleotide
  Target: ATXN1; (-) strand; PAM type: NRG; PAM sequence: AGG
gctcgggaaggatctgttcc

SEQ ID NO: 49744 - DNA, 20 bp, Artificial Sequence
  Description of Artificial Sequence: Synthetic oligonucleotide
  Target: ATXN1; (-) strand; PAM type: NRG; PAM sequence: CAG
tgctcgggaaggatctgttc

SEQ ID NO: 49745 - DNA, 20 bp, Artificial Sequence
  Description of Artificial Sequence: Synthetic oligonucleotide
  Target: ATXN1; (-) strand; PAM type: NRG; PAM sequence: AGG
ccctgtgaagatgctcggga

SEQ ID NO: 49746 - DNA, 20 bp, Artificial Sequence
  Description of Artificial Sequence: Synthetic oligonucleotide
  Target: ATXN1; (-) strand; PAM type: NRG; PAM sequence: AAG
tccctgtgaagatgctcggg

SEQ ID NO: 49747 - DNA, 20 bp, Artificial Sequence
  Description of Artificial Sequence: Synthetic oligonucleotide
  Target: ATXN1; (-) strand; PAM type: NRG; PAM sequence: GGG
tgctccctgtgaagatgctc

SEQ ID NO: 49748 - DNA, 20 bp, Artificial Sequence
  Description of Artificial Sequence: Synthetic oligonucleotide
  Target: ATXN1; (-) strand; PAM type: NRG; PAM sequence: CGG
atgctccctgtgaagatgct

SEQ ID NO: 49749 - DNA, 20 bp, Artificial Sequence
  Description of Artificial Sequence: Synthetic oligonucleotide
  Target: ATXN1; (-) strand; PAM type: NRG; PAM sequence: AAG
gcagggccatgctccctgtg

SEQ ID NO: 49750 - DNA, 20 bp, Artificial Sequence
  Description of Artificial Sequence: Synthetic oligonucleotide
  Target: ATXN1; (-) strand; PAM type: NRG; PAM sequence: GGG
cagagatcaaggtgtgggca

SEQ ID NO: 49751 - DNA, 20 bp, Artificial Sequence
  Description of Artificial Sequence: Synthetic oligonucleotide
  Target: ATXN1; (-) strand; PAM type: NRG; PAM sequence: AGG
tcagagatcaaggtgtgggc

SEQ ID NO: 49752 - DNA, 20 bp, Artificial Sequence
  Description of Artificial Sequence: Synthetic oligonucleotide
  Target: ATXN1; (-) strand; PAM type: NRG; PAM sequence: CAG
gtcagagatcaaggtgtggg

SEQ ID NO: 49753 - DNA, 20 bp, Artificial Sequence
  Description of Artificial Sequence: Synthetic oligonucleotide
  Target: ATXN1; (-) strand; PAM type: NRG; PAM sequence: GGG
gaagtcagagatcaaggtgt

SEQ ID NO: 49754 - DNA, 20 bp, Artificial Sequence
  Description of Artificial Sequence: Synthetic oligonucleotide
  Target: ATXN1; (-) strand; PAM type: NRG; PAM sequence: TGG
ggaagtcagagatcaaggtg

SEQ ID NO: 49755 - DNA, 20 bp, Artificial Sequence
  Description of Artificial Sequence: Synthetic oligonucleotide
  Target: ATXN1; (-) strand; PAM type: NRG; PAM sequence: AGG
ggcctggaagtcagagatca

SEQ ID NO: 49756 - DNA, 20 bp, Artificial Sequence
  Description of Artificial Sequence: Synthetic oligonucleotide
  Target: ATXN1; (-) strand; PAM type: NRG; PAM sequence: AAG
gggcctggaagtcagagatc

SEQ ID NO: 49757 - DNA, 20 bp, Artificial Sequence
  Description of Artificial Sequence: Synthetic oligonucleotide
  Target: ATXN1; (-) strand; PAM type: NRG; PAM sequence: GAG
gctggggggcctggaagtca

SEQ ID NO: 49758 - DNA, 20 bp, Artificial Sequence
  Description of Artificial Sequence: Synthetic oligonucleotide
  Target: ATXN1; (-) strand; PAM type: NRG; PAM sequence: CAG
cagctggggggcctggaagt

SEQ ID NO: 49759 - DNA, 20 bp, Artificial Sequence
  Description of Artificial Sequence: Synthetic oligonucleotide
  Target: ATXN1; (-) strand; PAM type: NRG; PAM sequence: AAG
ctcacagctggggggcctgg

SEQ ID NO: 49760 - DNA, 20 bp, Artificial Sequence
  Description of Artificial Sequence: Synthetic oligonucleotide
  Target: ATXN1; (-) strand; PAM type: NRG; PAM sequence: TGG
tgtctcacagctggggggcc

SEQ ID NO: 49761 - DNA, 20 bp, Artificial Sequence
  Description of Artificial Sequence: Synthetic oligonucleotide
  Target: ATXN1; (-) strand; PAM type: NRG; PAM sequence: GGG
ttgagtgtctcacagctggg

SEQ ID NO: 49762 - DNA, 20 bp, Artificial Sequence
  Description of Artificial Sequence: Synthetic oligonucleotide
  Target: ATXN1; (-) strand; PAM type: NRG; PAM sequence: GGG
attgagtgtctcacagctgg

SEQ ID NO: 49763 - DNA, 20 bp, Artificial Sequence
  Description of Artificial Sequence: Synthetic oligonucleotide
  Target: ATXN1; (-) strand; PAM type: NRG; PAM sequence: GGG
cattgagtgtctcacagctg

SEQ ID NO: 49764 - DNA, 20 bp, Artificial Sequence
  Description of Artificial Sequence: Synthetic oligonucleotide
  Target: ATXN1; (-) strand; PAM type: NRG; PAM sequence: GGG
acattgagtgtctcacagct

SEQ ID NO: 49765 - DNA, 20 bp, Artificial Sequence
  Description of Artificial Sequence: Synthetic oligonucleotide
  Target: ATXN1; (-) strand; PAM type: NRG; PAM sequence: TGG
gacattgagtgtctcacagc

SEQ ID NO: 49766 - DNA, 20 bp, Artificial Sequence
  Description of Artificial Sequence: Synthetic oligonucleotide
  Target: ATXN1; (-) strand; PAM type: NRG; PAM sequence: CAG
aacagacattgagtgtctca

SEQ ID NO: 49767 - DNA, 20 bp, Artificial Sequence
  Description of Artificial Sequence: Synthetic oligonucleotide
  Target: ATXN1; (-) strand; PAM type: NRG; PAM sequence: GAG
tgggtgacttaacagacatt

SEQ ID NO: 49768 - DNA, 20 bp, Artificial Sequence
  Description of Artificial Sequence: Synthetic oligonucleotide
  Target: ATXN1; (-) strand; PAM type: NRG; PAM sequence: CAG
ccagaaactgggtgacttaa

SEQ ID NO: 49769 - DNA, 20 bp, Artificial Sequence
  Description of Artificial Sequence: Synthetic oligonucleotide
  Target: ATXN1; (-) strand; PAM type: NRG; PAM sequence: GGG
attacaaagtgccagaaact

SEQ ID NO: 49770 - DNA, 20 bp, Artificial Sequence
  Description of Artificial Sequence: Synthetic oligonucleotide
  Target: ATXN1; (-) strand; PAM type: NRG; PAM sequence: TGG
cattacaaagtgccagaaac

SEQ ID NO: 49771 - DNA, 20 bp, Artificial Sequence
  Description of Artificial Sequence: Synthetic oligonucleotide
  Target: ATXN1; (-) strand; PAM type: NRG; PAM sequence: CAG
gggctgccattacaaagtgc

SEQ ID NO: 49772 - DNA, 20 bp, Artificial Sequence
  Description of Artificial Sequence: Synthetic oligonucleotide
  Target: ATXN1; (-) strand; PAM type: NRG; PAM sequence: AAG
tttccagggctgccattaca

SEQ ID NO: 49773 - DNA, 20 bp, Artificial Sequence
  Description of Artificial Sequence: Synthetic oligonucleotide
  Target: ATXN1; (-) strand; PAM type: NRG; PAM sequence: GGG
atgcctgtaatatttttcca

SEQ ID NO: 49774 - DNA, 20 bp, Artificial Sequence
  Description of Artificial Sequence: Synthetic oligonucleotide
  Target: ATXN1; (-) strand; PAM type: NRG; PAM sequence: AGG
tatgcctgtaatatttttcc

SEQ ID NO: 49775 - DNA, 20 bp, Artificial Sequence
  Description of Artificial Sequence: Synthetic oligonucleotide
  Target: ATXN1; (-) strand; PAM type: NRG; PAM sequence: CAG
atatgcctgtaatatttttc

SEQ ID NO: 49776 - DNA, 20 bp, Artificial Sequence
  Description of Artificial Sequence: Synthetic oligonucleotide
  Target: ATXN1; (-) strand; PAM type: NRG; PAM sequence: CGG
gtcattccttcacacacaaa

SEQ ID NO: 49777 - DNA, 20 bp, Artificial Sequence
  Description of Artificial Sequence: Synthetic oligonucleotide
  Target: ATXN1; (-) strand; PAM type: NRG; PAM sequence: AAG
attccagccactggatgatg

SEQ ID NO: 49778 - DNA, 20 bp, Artificial Sequence
  Description of Artificial Sequence: Synthetic oligonucleotide
  Target: ATXN1; (-) strand; PAM type: NRG; PAM sequence: TGG
cataattaaattccagccac

SEQ ID NO: 49779 - DNA, 20 bp, Artificial Sequence
  Description of Artificial Sequence: Synthetic oligonucleotide
  Target: ATXN1; (-) strand; PAM type: NRG; PAM sequence: CAG
atcacatcataattaaattc

SEQ ID NO: 49780 - DNA, 20 bp, Artificial Sequence
  Description of Artificial Sequence: Synthetic oligonucleotide
  Target: ATXN1; (-) strand; PAM type: NRG; PAM sequence: TAG
gaggaagtgaatgttgttga

SEQ ID NO: 49781 - DNA, 20 bp, Artificial Sequence
  Description of Artificial Sequence: Synthetic oligonucleotide
  Target: ATXN1; (-) strand; PAM type: NRG; PAM sequence: AAG
gcacaatatatgtgaagagg

SEQ ID NO: 49782 - DNA, 20 bp, Artificial Sequence
  Description of Artificial Sequence: Synthetic oligonucleotide
  Target: ATXN1; (-) strand; PAM type: NRG; PAM sequence: AGG
ggggcacaatatatgtgaag

SEQ ID NO: 49783 - DNA, 20 bp, Artificial Sequence
  Description of Artificial Sequence: Synthetic oligonucleotide
  Target: ATXN1; (-) strand; PAM type: NRG; PAM sequence: GAG
aggggcacaatatatgtgaa

SEQ ID NO: 49784 - DNA, 20 bp, Artificial Sequence
  Description of Artificial Sequence: Synthetic oligonucleotide
  Target: ATXN1; (-) strand; PAM type: NRG; PAM sequence: AAG
tgaggggcacaatatatgtg

SEQ ID NO: 49785 - DNA, 20 bp, Artificial Sequence
  Description of Artificial Sequence: Synthetic oligonucleotide
  Target: ATXN1; (-) strand; PAM type: NRG; PAM sequence: GGG
gaattttgcagtcaggtgag

SEQ ID NO: 49786 - DNA, 20 bp, Artificial Sequence
  Description of Artificial Sequence: Synthetic oligonucleotide
  Target: ATXN1; (-) strand; PAM type: NRG; PAM sequence: GGG
ggaattttgcagtcaggtga

SEQ ID NO: 49787 - DNA, 20 bp, Artificial Sequence
  Description of Artificial Sequence: Synthetic oligonucleotide
  Target: ATXN1; (-) strand; PAM type: NRG; PAM sequence: AGG
gggaattttgcagtcaggtg

SEQ ID NO: 49788 - DNA, 20 bp, Artificial Sequence
  Description of Artificial Sequence: Synthetic oligonucleotide
  Target: ATXN1; (-) strand; PAM type: NRG; PAM sequence: GAG
tgggaattttgcagtcaggt

SEQ ID NO: 49789 - DNA, 20 bp, Artificial Sequence
  Description of Artificial Sequence: Synthetic oligonucleotide
  Target: ATXN1; (-) strand; PAM type: NRG; PAM sequence: AGG
gcaatgggaattttgcagtc

SEQ ID NO: 49790 - DNA, 20 bp, Artificial Sequence
  Description of Artificial Sequence: Synthetic oligonucleotide
  Target: ATXN1; (-) strand; PAM type: NRG; PAM sequence: CAG
tgcaatgggaattttgcagt

SEQ ID NO: 49791 - DNA, 20 bp, Artificial Sequence
  Description of Artificial Sequence: Synthetic oligonucleotide
  Target: ATXN1; (-) strand; PAM type: NRG; PAM sequence: CAG
aacttgcaatgggaattttg

SEQ ID NO: 49792 - DNA, 20 bp, Artificial Sequence
  Description of Artificial Sequence: Synthetic oligonucleotide
  Target: ATXN1; (-) strand; PAM type: NRG; PAM sequence: GGG
cacctgtcttaacttgcaat

SEQ ID NO: 49793 - DNA, 20 bp, Artificial Sequence
  Description of Artificial Sequence: Synthetic oligonucleotide
  Target: ATXN1; (-) strand; PAM type: NRG; PAM sequence: TGG
gcacctgtcttaacttgcaa

SEQ ID NO: 49794 - DNA, 20 bp, Artificial Sequence
  Description of Artificial Sequence: Synthetic oligonucleotide
  Target: ATXN1; (-) strand; PAM type: NRG; PAM sequence: AGG
gcagctcaggtcactgtgta

SEQ ID NO: 49795 - DNA, 20 bp, Artificial Sequence
  Description of Artificial Sequence: Synthetic oligonucleotide
  Target: ATXN1; (-) strand; PAM type: NRG; PAM sequence: AAG
ggcagctcaggtcactgtgt

SEQ ID NO: 49796 - DNA, 20 bp, Artificial Sequence
  Description of Artificial Sequence: Synthetic oligonucleotide
  Target: ATXN1; (-) strand; PAM type: NRG; PAM sequence: AGG
ttctggaagagaggcagctc

SEQ ID NO: 49797 - DNA, 20 bp, Artificial Sequence
  Description of Artificial Sequence: Synthetic oligonucleotide
  Target: ATXN1; (-) strand; PAM type: NRG; PAM sequence: CAG
cttctggaagagaggcagct

SEQ ID NO: 49798 - DNA, 20 bp, Artificial Sequence
  Description of Artificial Sequence: Synthetic oligonucleotide
  Target: ATXN1; (-) strand; PAM type: NRG; PAM sequence: CAG
tgtcccttctggaagagagg

SEQ ID NO: 49799 - DNA, 20 bp, Artificial Sequence
  Description of Artificial Sequence: Synthetic oligonucleotide
  Target: ATXN1; (-) strand; PAM type: NRG; PAM sequence: AGG
agttgtcccttctggaagag

SEQ ID NO: 49800 - DNA, 20 bp, Artificial Sequence
  Description of Artificial Sequence: Synthetic oligonucleotide
  Target: ATXN1; (-) strand; PAM type: NRG; PAM sequence: GAG
gagttgtcccttctggaaga

SEQ ID NO: 49801 - DNA, 20 bp, Artificial Sequence
  Description of Artificial Sequence: Synthetic oligonucleotide
  Target: ATXN1; (-) strand; PAM type: NRG; PAM sequence: GAG
cagagttgtcccttctggaa

SEQ ID NO: 49802 - DNA, 20 bp, Artificial Sequence
  Description of Artificial Sequence: Synthetic oligonucleotide
  Target: ATXN1; (-) strand; PAM type: NRG; PAM sequence: AAG
ggcagagttgtcccttctgg

SEQ ID NO: 49803 - DNA, 20 bp, Artificial Sequence
  Description of Artificial Sequence: Synthetic oligonucleotide
  Target: ATXN1; (-) strand; PAM type: NRG; PAM sequence: TGG
actggcagagttgtcccttc

SEQ ID NO: 49804 - DNA, 20 bp, Artificial Sequence
  Description of Artificial Sequence: Synthetic oligonucleotide
  Target: ATXN1; (-) strand; PAM type: NRG; PAM sequence: GAG
tgtggataacctgactggca

SEQ ID NO: 49805 - DNA, 20 bp, Artificial Sequence
  Description of Artificial Sequence: Synthetic oligonucleotide
  Target: ATXN1; (-) strand; PAM type: NRG; PAM sequence: CAG
actgtggataacctgactgg

SEQ ID NO: 49806 - DNA, 20 bp, Artificial Sequence
  Description of Artificial Sequence: Synthetic oligonucleotide
  Target: ATXN1; (-) strand; PAM type: NRG; PAM sequence: TGG
ttcactgtggataacctgac

SEQ ID NO: 49807 - DNA, 20 bp, Artificial Sequence
  Description of Artificial Sequence: Synthetic oligonucleotide
  Target: ATXN1; (-) strand; PAM type: NRG; PAM sequence: TGG
gtctgctgtaatgttcactg

SEQ ID NO: 49808 - DNA, 20 bp, Artificial Sequence
  Description of Artificial Sequence: Synthetic oligonucleotide
  Target: ATXN1; (-) strand; PAM type: NRG; PAM sequence: GAG
tagatacctgagaaatagtg

SEQ ID NO: 49809 - DNA, 20 bp, Artificial Sequence
  Description of Artificial Sequence: Synthetic oligonucleotide
  Target: ATXN1; (-) strand; PAM type: NRG; PAM sequence: TGG
cgtagatacctgagaaatag

SEQ ID NO: 49810 - DNA, 20 bp, Artificial Sequence
  Description of Artificial Sequence: Synthetic oligonucleotide
  Target: ATXN1; (-) strand; PAM type: NRG; PAM sequence: TAG
aaacgtagatacctgagaaa

SEQ ID NO: 49811 - DNA, 20 bp, Artificial Sequence
  Description of Artificial Sequence: Synthetic oligonucleotide
  Target: ATXN1; (-) strand; PAM type: NRG; PAM sequence: GAG
tctaccaaacgtagatacct

SEQ ID NO: 49812 - DNA, 20 bp, Artificial Sequence
  Description of Artificial Sequence: Synthetic oligonucleotide
  Target: ATXN1; (-) strand; PAM type: NRG; PAM sequence: TAG
ggagaagtatctaccaaacg

SEQ ID NO: 49813 - DNA, 20 bp, Artificial Sequence
  Description of Artificial Sequence: Synthetic oligonucleotide
  Target: ATXN1; (-) strand; PAM type: NRG; PAM sequence: AAG
gacttctcaaggagcaggag

SEQ ID NO: 49814 - DNA, 20 bp, Artificial Sequence
  Description of Artificial Sequence: Synthetic oligonucleotide
  Target: ATXN1; (-) strand; PAM type: NRG; PAM sequence: GAG
ggggacttctcaaggagcag

SEQ ID NO: 49815 - DNA, 20 bp, Artificial Sequence
  Description of Artificial Sequence: Synthetic oligonucleotide
  Target: ATXN1; (-) strand; PAM type: NRG; PAM sequence: AGG
ctggggacttctcaaggagc

SEQ ID NO: 49816 - DNA, 20 bp, Artificial Sequence
  Description of Artificial Sequence: Synthetic oligonucleotide
  Target: ATXN1; (-) strand; PAM type: NRG; PAM sequence: CAG
actggggacttctcaaggag

SEQ ID NO: 49817 - DNA, 20 bp, Artificial Sequence
  Description of Artificial Sequence: Synthetic oligonucleotide
  Target: ATXN1; (-) strand; PAM type: NRG; PAM sequence: GAG
accactggggacttctcaag

SEQ ID NO: 49818 - DNA, 20 bp, Artificial Sequence
  Description of Artificial Sequence: Synthetic oligonucleotide
  Target: ATXN1; (-) strand; PAM type: NRG; PAM sequence: AGG
tgaccactggggacttctca

SEQ ID NO: 49819 - DNA, 20 bp, Artificial Sequence
  Description of Artificial Sequence: Synthetic oligonucleotide
  Target: ATXN1; (-) strand; PAM type: NRG; PAM sequence: AAG
ctgaccactggggacttctc

SEQ ID NO: 49820 - DNA, 20 bp, Artificial Sequence
  Description of Artificial Sequence: Synthetic oligonucleotide
  Target: ATXN1; (-) strand; PAM type: NRG; PAM sequence: GGG
ctctccatgactgaccactg

SEQ ID NO: 49821 - DNA, 20 bp, Artificial Sequence
  Description of Artificial Sequence: Synthetic oligonucleotide
  Target: ATXN1; (-) strand; PAM type: NRG; PAM sequence: GGG
actctccatgactgaccact

SEQ ID NO: 49822 - DNA, 20 bp, Artificial Sequence
  Description of Artificial Sequence: Synthetic oligonucleotide
  Target: ATXN1; (-) strand; PAM type: NRG; PAM sequence: TGG
aactctccatgactgaccac

SEQ ID NO: 49823 - DNA, 20 bp, Artificial Sequence
  Description of Artificial Sequence: Synthetic oligonucleotide
  Target: ATXN1; (-) strand; PAM type: NRG; PAM sequence: GGG
acgtcagtggctcttagatt

SEQ ID NO: 49824 - DNA, 20 bp, Artificial Sequence
  Description of Artificial Sequence: Synthetic oligonucleotide
  Target: ATXN1; (-) strand; PAM type: NRG; PAM sequence: TGG
aacgtcagtggctcttagat

SEQ ID NO: 49825 - DNA, 20 bp, Artificial Sequence
  Description of Artificial Sequence: Synthetic oligonucleotide
  Target: ATXN1; (-) strand; PAM type: NRG; PAM sequence: TAG
atagaaacgtcagtggctct

SEQ ID NO: 49826 - DNA, 20 bp, Artificial Sequence
  Description of Artificial Sequence: Synthetic oligonucleotide
  Target: ATXN1; (-) strand; PAM type: NRG; PAM sequence: TGG
catcagtatagaaacgtcag

SEQ ID NO: 49827 - DNA, 20 bp, Artificial Sequence
  Description of Artificial Sequence: Synthetic oligonucleotide
  Target: ATXN1; (-) strand; PAM type: NRG; PAM sequence: CAG
atacatcagtatagaaacgt

SEQ ID NO: 49828 - DNA, 20 bp, Artificial Sequence
  Description of Artificial Sequence: Synthetic oligonucleotide
  Target: ATXN1; (-) strand; PAM type: NRG; PAM sequence: TAG
aatgtagacatacatcagta

SEQ ID NO: 49829 - DNA, 20 bp, Artificial Sequence
  Description of Artificial Sequence: Synthetic oligonucleotide
  Target: ATXN1; (-) strand; PAM type: NRG; PAM sequence: CAG
ctataaatgtagacatacat

SEQ ID NO: 49830 - DNA, 20 bp, Artificial Sequence
  Description of Artificial Sequence: Synthetic oligonucleotide
  Target: ATXN1; (-) strand; PAM type: NRG; PAM sequence: TAG
catgtctaaatctataaatg

SEQ ID NO: 49831 - DNA, 20 bp, Artificial Sequence
  Description of Artificial Sequence: Synthetic oligonucleotide
  Target: ATXN1; (-) strand; PAM type: NRG; PAM sequence: GGG
agttagtggaacttcaattt

SEQ ID NO: 49832 - DNA, 20 bp, Artificial Sequence
  Description of Artificial Sequence: Synthetic oligonucleotide
  Target: ATXN1; (-) strand; PAM type: NRG; PAM sequence: TGG
tagttagtggaacttcaatt

SEQ ID NO: 49833 - DNA, 20 bp, Artificial Sequence
  Description of Artificial Sequence: Synthetic oligonucleotide
  Target: ATXN1; (-) strand; PAM type: NRG; PAM sequence: TGG
aatagccaattactagttag

SEQ ID NO: 49834 - DNA, 20 bp, Artificial Sequence
  Description of Artificial Sequence: Synthetic oligonucleotide
  Target: ATXN1; (-) strand; PAM type: NRG; PAM sequence: TAG
actaatagccaattactagt

SEQ ID NO: 49835 - DNA, 20 bp, Artificial Sequence
  Description of Artificial Sequence: Synthetic oligonucleotide
  Target: ATXN1; (-) strand; PAM type: NRG; PAM sequence: TAG
aattactaatagccaattac

SEQ ID NO: 49836 - DNA, 20 bp, Artificial Sequence
  Description of Artificial Sequence: Synthetic oligonucleotide
  Target: ATXN1; (-) strand; PAM type: NRG; PAM sequence: TAG
gttttgggtagaattactaa

SEQ ID NO: 49837 - DNA, 20 bp, Artificial Sequence
  Description of Artificial Sequence: Synthetic oligonucleotide
  Target: ATXN1; (-) strand; PAM type: NRG; PAM sequence: TAG
aattattaatttgttttggg

SEQ ID NO: 49838 - DNA, 20 bp, Artificial Sequence
  Description of Artificial Sequence: Synthetic oligonucleotide
  Target: ATXN1; (-) strand; PAM type: NRG; PAM sequence: GGG
atgaattattaatttgtttt

SEQ ID NO: 49839 - DNA, 20 bp, Artificial Sequence
  Description of Artificial Sequence: Synthetic oligonucleotide
  Target: ATXN1; (-) strand; PAM type: NRG; PAM sequence: TGG
aatgaattattaatttgttt

SEQ ID NO: 49840 - DNA, 20 bp, Artificial Sequence
  Description of Artificial Sequence: Synthetic oligonucleotide
  Target: ATXN1; (-) strand; PAM type: NRG; PAM sequence: TGG
gagccataagccaccaggcc

SEQ ID NO: 49841 - DNA, 20 bp, Artificial Sequence
  Description of Artificial Sequence: Synthetic oligonucleotide
  Target: ATXN1; (-) strand; PAM type: NRG; PAM sequence: AGG
gattagagccataagccacc

SEQ ID NO: 49842 - DNA, 20 bp, Artificial Sequence
  Description of Artificial Sequence: Synthetic oligonucleotide
  Target: ATXN1; (-) strand; PAM type: NRG; PAM sequence: CAG
agattagagccataagccac

SEQ ID NO: 49843 - DNA, 20 bp, Artificial Sequence
  Description of Artificial Sequence: Synthetic oligonucleotide
  Target: ATXN1; (-) strand; PAM type: NRG; PAM sequence: AAG
agtgctgagattagagccat

SEQ ID NO: 49844 - DNA, 20 bp, Artificial Sequence
  Description of Artificial Sequence: Synthetic oligonucleotide
  Target: ATXN1; (-) strand; PAM type: NRG; PAM sequence: GAG
ctcccaaagtgctgagatta

SEQ ID NO: 49845 - DNA, 20 bp, Artificial Sequence
  Description of Artificial Sequence: Synthetic oligonucleotide
  Target: ATXN1; (-) strand; PAM type: NRG; PAM sequence: TAG
gcctcccaaagtgctgagat

SEQ ID NO: 49846 - DNA, 20 bp, Artificial Sequence
  Description of Artificial Sequence: Synthetic oligonucleotide
  Target: ATXN1; (-) strand; PAM type: NRG; PAM sequence: GAG
ccttggcctcccaaagtgct

SEQ ID NO: 49847 - DNA, 20 bp, Artificial Sequence
  Description of Artificial Sequence: Synthetic oligonucleotide
  Target: ATXN1; (-) strand; PAM type: NRG; PAM sequence: AAG
cctcctgccttggcctccca

SEQ ID NO: 49848 - DNA, 20 bp, Artificial Sequence
  Description of Artificial Sequence: Synthetic oligonucleotide
  Target: ATXN1; (-) strand; PAM type: NRG; PAM sequence: TGG
ctcaagggatcctcctgcct

SEQ ID NO: 49849 - DNA, 20 bp, Artificial Sequence
  Description of Artificial Sequence: Synthetic oligonucleotide
  Target: ATXN1; (-) strand; PAM type: NRG; PAM sequence: GGG
tcttaaactcctggcctcaa

SEQ ID NO: 49850 - DNA, 20 bp, Artificial Sequence
  Description of Artificial Sequence: Synthetic oligonucleotide
  Target: ATXN1; (-) strand; PAM type: NRG; PAM sequence: AGG
gtcttaaactcctggcctca

SEQ ID NO: 49851 - DNA, 20 bp, Artificial Sequence
  Description of Artificial Sequence: Synthetic oligonucleotide
  Target: ATXN1; (-) strand; PAM type: NRG; PAM sequence: AAG
ggtcttaaactcctggcctc

SEQ ID NO: 49852 - DNA, 20 bp, Artificial Sequence
  Description of Artificial Sequence: Synthetic oligonucleotide
  Target: ATXN1; (-) strand; PAM type: NRG; PAM sequence: TGG
ccaggctggtcttaaactcc

SEQ ID NO: 49853 - DNA, 20 bp, Artificial Sequence
  Description of Artificial Sequence: Synthetic oligonucleotide
  Target: ATXN1; (-) strand; PAM type: NRG; PAM sequence: TGG
tcttgctatgttgcccaggc

SEQ ID NO: 49854 - DNA, 20 bp, Artificial Sequence
  Description of Artificial Sequence: Synthetic oligonucleotide
  Target: ATXN1; (-) strand; PAM type: NRG; PAM sequence: AGG
ggggtcttgctatgttgccc

SEQ ID NO: 49855 - DNA, 20 bp, Artificial Sequence
  Description of Artificial Sequence: Synthetic oligonucleotide
  Target: ATXN1; (-) strand; PAM type: NRG; PAM sequence: CAG
tggggtcttgctatgttgcc

SEQ ID NO: 49856 - DNA, 20 bp, Artificial Sequence
  Description of Artificial Sequence: Synthetic oligonucleotide
  Target: ATXN1; (-) strand; PAM type: NRG; PAM sequence: GGG
ttaagcttcttgtatagatg

SEQ ID NO: 49857 - DNA, 20 bp, Artificial Sequence
  Description of Artificial Sequence: Synthetic oligonucleotide
  Target: ATXN1; (-) strand; PAM type: NRG; PAM sequence: GGG
tttaagcttcttgtatagat

SEQ ID NO: 49858 - DNA, 20 bp, Artificial Sequence
  Description of Artificial Sequence: Synthetic oligonucleotide
  Target: ATXN1; (-) strand; PAM type: NRG; PAM sequence: TGG
ttttaagcttcttgtataga

SEQ ID NO: 49859 - DNA, 20 bp, Artificial Sequence
  Description of Artificial Sequence: Synthetic oligonucleotide
  Target: ATXN1; (-) strand; PAM type: NRG; PAM sequence: TAG
atttttttaagcttcttgta

SEQ ID NO: 49860 - DNA, 20 bp, Artificial Sequence
  Description of Artificial Sequence: Synthetic oligonucleotide
  Target: ATXN1; (-) strand; PAM type: NRG; PAM sequence: AAG
tcctgcctggctattttttt

SEQ ID NO: 49861 - DNA, 20 bp, Artificial Sequence
  Description of Artificial Sequence: Synthetic oligonucleotide
  Target: ATXN1; (-) strand; PAM type: NRG; PAM sequence: TGG
gttcacaccattctcctgcc

SEQ ID NO: 49862 - DNA, 20 bp, Artificial Sequence
  Description of Artificial Sequence: Synthetic oligonucleotide
  Target: ATXN1; (-) strand; PAM type: NRG; PAM sequence: AGG
cactgcaagctccgcctccc

SEQ ID NO: 49863 - DNA, 20 bp, Artificial Sequence
  Description of Artificial Sequence: Synthetic oligonucleotide
  Target: ATXN1; (-) strand; PAM type: NRG; PAM sequence: CAG
tcactgcaagctccgcctcc

SEQ ID NO: 49864 - DNA, 20 bp, Artificial Sequence
  Description of Artificial Sequence: Synthetic oligonucleotide
  Target: ATXN1; (-) strand; PAM type: NRG; PAM sequence: AAG
gtgtgatcccagctcactgc

SEQ ID NO: 49865 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtagtgtgatcc

SEQ ID NO: 49866 - DNA, 20 bp, Artificial Sequence
  Description of Artificial Sequence: Synthetic oligonucleotide
  Target: ATXN1; (-) strand; PAM type: NRG; PAM sequence: TAG
ttgcccaggctggagtgcag

SEQ ID NO: 49867 - DNA, 20 bp, Artificial Sequence
  Description of Artificial Sequence: Synthetic oligonucleotide
  Target: ATXN1; (-) strand; PAM type: NRG; PAM sequence: CAG
ctgttgcccaggctggagtg

SEQ ID NO: 49868 - DNA, 20 bp, Artificial Sequence
  Description of Artificial Sequence: Synthetic oligonucleotide
  Target: ATXN1; (-) strand; PAM type: NRG; PAM sequence: GAG
tcgctctgttgcccaggctg

SEQ ID NO: 49869 - DNA, 20 bp, Artificial Sequence
  Description of Artificial Sequence: Synthetic oligonucleotide
  Target: ATXN1; (-) strand; PAM type: NRG; PAM sequence: TGG
tctcgctctgttgcccaggc

SEQ ID NO: 49870 - DNA, 20 bp, Artificial Sequence
  Description of Artificial Sequence: Synthetic oligonucleotide
  Target: ATXN1; (-) strand; PAM type: NRG; PAM sequence: AGG
ggaatctcgctctgttgccc

SEQ ID NO: 49871 - DNA, 20 bp, Artificial Sequence
  Description of Artificial Sequence: Synthetic oligonucleotide
  Target: ATXN1; (-) strand; PAM type: NRG; PAM sequence: CAG
tggaatctcgctctgttgcc

SEQ ID NO: 49872 - DNA, 20 bp, Artificial Sequence
  Description of Artificial Sequence: Synthetic oligonucleotide
  Target: ATXN1; (-) strand; PAM type: NRG; PAM sequence: TGG
atttttttttttttttgaga

SEQ ID NO: 49873 - DNA, 20 bp, Artificial Sequence
  Description of Artificial Sequence: Synthetic oligonucleotide
  Target: ATXN1; (-) strand; PAM type: NRG; PAM sequence: GAG
gggtattttttttttttttt

SEQ ID NO: 49874 - DNA, 20 bp, Artificial Sequence
  Description of Artificial Sequence: Synthetic oligonucleotide
  Target: ATXN1; (-) strand; PAM type: NRG; PAM sequence: GGG
aagtgcacaccaccgtacct

SEQ ID NO: 49875 - DNA, 20 bp, Artificial Sequence
  Description of Artificial Sequence: Synthetic oligonucleotide
  Target: ATXN1; (-) strand; PAM type: NRG; PAM sequence: TGG
taagtgcacaccaccgtacc

SEQ ID NO: 49876 - DNA, 20 bp, Artificial Sequence
  Description of Artificial Sequence: Synthetic oligonucleotide
  Target: ATXN1; (-) strand; PAM type: NRG; PAM sequence: AAG
tcccaagttgctgggactat

SEQ ID NO: 49877 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagttgct

SEQ ID NO: 49878 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccaagttgc

SEQ ID NO: 49879 - DNA, 20 bp, Artificial Sequence
  Description of Artificial Sequence: Synthetic oligonucleotide
  Target: ATXN1; (-) strand; PAM type: NRG; PAM sequence: AAG
tgcttccacctcagcctccc

SEQ ID NO: 49880 - DNA, 20 bp, Artificial Sequence
  Description of Artificial Sequence: Synthetic oligonucleotide
  Target: ATXN1; (-) strand; PAM type: NRG; PAM sequence: CAG
cccaagtgatgcttccacct

SEQ ID NO: 49881 - DNA, 20 bp, Artificial Sequence
  Description of Artificial Sequence: Synthetic oligonucleotide
  Target: ATXN1; (-) strand; PAM type: NRG; PAM sequence: AAG
atcctcaaacttctgggccc

SEQ ID NO: 49882 - DNA, 20 bp, Artificial Sequence
  Description of Artificial Sequence: Synthetic oligonucleotide
  Target: ATXN1; (-) strand; PAM type: NRG; PAM sequence: GGG
cactgcatcctcaaacttct

SEQ ID NO: 49883 - DNA, 20 bp, Artificial Sequence
  Description of Artificial Sequence: Synthetic oligonucleotide
  Target: ATXN1; (-) strand; PAM type: NRG; PAM sequence: TGG
tcactgcatcctcaaacttc

SEQ ID NO: 49884 - DNA, 20 bp, Artificial Sequence
  Description of Artificial Sequence: Synthetic oligonucleotide
  Target: ATXN1; (-) strand; PAM type: NRG; PAM sequence: TAG
ggagagcactggcacgatca

SEQ ID NO: 49885 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagagcac

SEQ ID NO: 49886 - DNA, 20 bp, Artificial Sequence
  Description of Artificial Sequence: Synthetic oligonucleotide
  Target: ATXN1; (-) strand; PAM type: NRG; PAM sequence: GAG
ctcttgtcacccaggctgga

SEQ ID NO: 49887 - DNA, 20 bp, Artificial Sequence
  Description of Artificial Sequence: Synthetic oligonucleotide
  Target: ATXN1; (-) strand; PAM type: NRG; PAM sequence: GAG
cactcttgtcacccaggctg

SEQ ID NO: 49888 - DNA, 20 bp, Artificial Sequence
  Description of Artificial Sequence: Synthetic oligonucleotide
  Target: ATXN1; (-) strand; PAM type: NRG; PAM sequence: TGG
ctcactcttgtcacccaggc

SEQ ID NO: 49889 - DNA, 20 bp, Artificial Sequence
  Description of Artificial Sequence: Synthetic oligonucleotide
  Target: ATXN1; (-) strand; PAM type: NRG; PAM sequence: AGG
gagtctcactcttgtcaccc

SEQ ID NO: 49890 - DNA, 20 bp, Artificial Sequence
  Description of Artificial Sequence: Synthetic oligonucleotide
  Target: ATXN1; (-) strand; PAM type: NRG; PAM sequence: CAG
agagtctcactcttgtcacc

SEQ ID NO: 49891 - DNA, 20 bp, Artificial Sequence
  Description of Artificial Sequence: Synthetic oligonucleotide
  Target: ATXN1; (-) strand; PAM type: NRG; PAM sequence: GAG
ttttcttttctttagggaga

SEQ ID NO: 49892 - DNA, 20 bp, Artificial Sequence
  Description of Artificial Sequence: Synthetic oligonucleotide
  Target: ATXN1; (-) strand; PAM type: NRG; PAM sequence: GAG
ctttttcttttctttaggga

SEQ ID NO: 49893 - DNA, 20 bp, Artificial Sequence
  Description of Artificial Sequence: Synthetic oligonucleotide
  Target: ATXN1; (-) strand; PAM type: NRG; PAM sequence: GAG
ttctttttcttttctttagg

SEQ ID NO: 49894 - DNA, 20 bp, Artificial Sequence
  Description of Artificial Sequence: Synthetic oligonucleotide
  Target: ATXN1; (-) strand; PAM type: NRG; PAM sequence: GGG
aattctttttcttttcttta

SEQ ID NO: 49895 - DNA, 20 bp, Artificial Sequence
  Description of Artificial Sequence: Synthetic oligonucleotide
  Target: ATXN1; (-) strand; PAM type: NRG; PAM sequence: AGG
gaattctttttcttttcttt

SEQ ID NO: 49896 - DNA, 20 bp, Artificial Sequence
  Description of Artificial Sequence: Synthetic oligonucleotide
  Target: ATXN1; (-) strand; PAM type: NRG; PAM sequence: TAG
ggaattctttttcttttctt

SEQ ID NO: 49897 - DNA, 20 bp, Artificial Sequence
  Description of Artificial Sequence: Synthetic oligonucleotide
  Target: ATXN1; (-) strand; PAM type: NRG; PAM sequence: GGG
aaaaaagcaaaaccttccaa

SEQ ID NO: 49898 - DNA, 20 bp, Artificial Sequence
  Description of Artificial Sequence: Synthetic oligonucleotide
  Target: ATXN1; (-) strand; PAM type: NRG; PAM sequence: AGG
taaaaaagcaaaaccttcca

SEQ ID NO: 49899 - DNA, 20 bp, Artificial Sequence
  Description of Artificial Sequence: Synthetic oligonucleotide
  Target: ATXN1; (-) strand; PAM type: NRG; PAM sequence: AAG
ctaaaaaagcaaaaccttcc

SEQ ID NO: 49900 - DNA, 20 bp, Artificial Sequence
  Description of Artificial Sequence: Synthetic oligonucleotide
  Target: ATXN1; (-) strand; PAM type: NRG; PAM sequence: AAG
agctaatcttatttctaaaa

SEQ ID NO: 49901 - DNA, 20 bp, Artificial Sequence
  Description of Artificial Sequence: Synthetic oligonucleotide
  Target: ATXN1; (-) strand; PAM type: NRG; PAM sequence: TAG
ctttgcattattaattttct

SEQ ID NO: 49902 - DNA, 20 bp, Artificial Sequence
  Description of Artificial Sequence: Synthetic oligonucleotide
  Target: ATXN1; (-) strand; PAM type: NRG; PAM sequence: TAG
caattttggatttaaaaaaa

SEQ ID NO: 49903 - DNA, 20 bp, Artificial Sequence
  Description of Artificial Sequence: Synthetic oligonucleotide
  Target: ATXN1; (-) strand; PAM type: NRG; PAM sequence: TGG
aaactattttaaaacaattt

SEQ ID NO: 49904 - DNA, 20 bp, Artificial Sequence
  Description of Artificial Sequence: Synthetic oligonucleotide
  Target: ATXN1; (-) strand; PAM type: NRG; PAM sequence: GGG
tgttatggaggaatggaaat

SEQ ID NO: 49905 - DNA, 20 bp, Artificial Sequence
  Description of Artificial Sequence: Synthetic oligonucleotide
  Target: ATXN1; (-) strand; PAM type: NRG; PAM sequence: TGG
ttgttatggaggaatggaaa

SEQ ID NO: 49906 - DNA, 20 bp, Artificial Sequence
  Description of Artificial Sequence: Synthetic oligonucleotide
  Target: ATXN1; (-) strand; PAM type: NRG; PAM sequence: TGG
tcttcattgttatggaggaa

SEQ ID NO: 49907 - DNA, 20 bp, Artificial Sequence
  Description of Artificial Sequence: Synthetic oligonucleotide
  Target: ATXN1; (-) strand; PAM type: NRG; PAM sequence: AGG
cagcatcttcattgttatgg

SEQ ID NO: 49908 - DNA, 20 bp, Artificial Sequence
  Description of Artificial Sequence: Synthetic oligonucleotide
  Target: ATXN1; (-) strand; PAM type: NRG; PAM sequence: GAG
tcagcatcttcattgttatg

SEQ ID NO: 49909 - DNA, 20 bp, Artificial Sequence
  Description of Artificial Sequence: Synthetic oligonucleotide
  Target: ATXN1; (-) strand; PAM type: NRG; PAM sequence: TGG
agtcagcatcttcattgtta

SEQ ID NO: 49910 - DNA, 20 bp, Artificial Sequence
  Description of Artificial Sequence: Synthetic oligonucleotide
  Target: ATXN1; (-) strand; PAM type: NRG; PAM sequence: CAG
cagtaacagacgttgaaagt

SEQ ID NO: 49911 - DNA, 20 bp, Artificial Sequence
  Description of Artificial Sequence: Synthetic oligonucleotide
  Target: ATXN1; (-) strand; PAM type: NRG; PAM sequence: AAG
gctacagtaacagacgttga

SEQ ID NO: 49912 - DNA, 20 bp, Artificial Sequence
  Description of Artificial Sequence: Synthetic oligonucleotide
  Target: ATXN1; (-) strand; PAM type: NRG; PAM sequence: CAG
ctctacctaggctacagtaa

SEQ ID NO: 49913 - DNA, 20 bp, Artificial Sequence
  Description of Artificial Sequence: Synthetic oligonucleotide
  Target: ATXN1; (-) strand; PAM type: NRG; PAM sequence: CAG
ccttcactctacctaggcta

SEQ ID NO: 49914 - DNA, 20 bp, Artificial Sequence
  Description of Artificial Sequence: Synthetic oligonucleotide
  Target: ATXN1; (-) strand; PAM type: NRG; PAM sequence: AGG
gaccacccttcactctacct

SEQ ID NO: 49915 - DNA, 20 bp, Artificial Sequence
  Description of Artificial Sequence: Synthetic oligonucleotide
  Target: ATXN1; (-) strand; PAM type: NRG; PAM sequence: TAG
tgaccacccttcactctacc

SEQ ID NO: 49916 - DNA, 20 bp, Artificial Sequence
  Description of Artificial Sequence: Synthetic oligonucleotide
  Target: ATXN1; (-) strand; PAM type: NRG; PAM sequence: TGG
cctgctctagatgtgagtct

SEQ ID NO: 49917 - DNA, 20 bp, Artificial Sequence
  Description of Artificial Sequence: Synthetic oligonucleotide
  Target: ATXN1; (-) strand; PAM type: NRG; PAM sequence: GAG
gacacccctgctctagatgt

SEQ ID NO: 49918 - DNA, 20 bp, Artificial Sequence
  Description of Artificial Sequence: Synthetic oligonucleotide
  Target: ATXN1; (-) strand; PAM type: NRG; PAM sequence: TAG
aagattggacacccctgctc

SEQ ID NO: 49919 - DNA, 20 bp, Artificial Sequence
  Description of Artificial Sequence: Synthetic oligonucleotide
  Target: ATXN1; (-) strand; PAM type: NRG; PAM sequence: TGG
gcccagggaagccaaaagat

SEQ ID NO: 49920 - DNA, 20 bp, Artificial Sequence
  Description of Artificial Sequence: Synthetic oligonucleotide
  Target: ATXN1; (-) strand; PAM type: NRG; PAM sequence: AAG
gtgtggcccagggaagccaa

SEQ ID NO: 49921 - DNA, 20 bp, Artificial Sequence
  Description of Artificial Sequence: Synthetic oligonucleotide
  Target: ATXN1; (-) strand; PAM type: NRG; PAM sequence: AAG
ccttccagtgtggcccaggg

SEQ ID NO: 49922 - DNA, 20 bp, Artificial Sequence
  Description of Artificial Sequence: Synthetic oligonucleotide
  Target: ATXN1; (-) strand; PAM type: NRG; PAM sequence: GGG
tctccttccagtgtggccca

SEQ ID NO: 49923 - DNA, 20 bp, Artificial Sequence
  Description of Artificial Sequence: Synthetic oligonucleotide
  Target: ATXN1; (-) strand; PAM type: NRG; PAM sequence: AGG
ttctccttccagtgtggccc

SEQ ID NO: 49924 - DNA, 20 bp, Artificial Sequence
  Description of Artificial Sequence: Synthetic oligonucleotide
  Target: ATXN1; (-) strand; PAM type: NRG; PAM sequence: CAG
tttctccttccagtgtggcc

SEQ ID NO: 49925 - DNA, 20 bp, Artificial Sequence
  Description of Artificial Sequence: Synthetic oligonucleotide
  Target: ATXN1; (-) strand; PAM type: NRG; PAM sequence: TGG
caatttttctccttccagtg

SEQ ID NO: 49926 - DNA, 20 bp, Artificial Sequence
  Description of Artificial Sequence: Synthetic oligonucleotide
  Target: ATXN1; (-) strand; PAM type: NRG; PAM sequence: CAG
caagacaatttttctccttc

SEQ ID NO: 49927 - DNA, 20 bp, Artificial Sequence
  Description of Artificial Sequence: Synthetic oligonucleotide
  Target: ATXN1; (-) strand; PAM type: NRG; PAM sequence: AAG
gtgtcttttatgtgcagccc

SEQ ID NO: 49928 - DNA, 20 bp, Artificial Sequence
  Description of Artificial Sequence: Synthetic oligonucleotide
  Target: ATXN1; (-) strand; PAM type: NRG; PAM sequence: CAG
gtgatagtgtcttttatgtg

SEQ ID NO: 49929 - DNA, 20 bp, Artificial Sequence
  Description of Artificial Sequence: Synthetic oligonucleotide
  Target: ATXN1; (-) strand; PAM type: NRG; PAM sequence: TAG
tcatcagctgtcattagtga

SEQ ID NO: 49930 - DNA, 20 bp, Artificial Sequence
  Description of Artificial Sequence: Synthetic oligonucleotide
  Target: ATXN1; (-) strand; PAM type: NRG; PAM sequence: TAG
tttagctcatcagctgtcat

SEQ ID NO: 49931 - DNA, 20 bp, Artificial Sequence
  Description of Artificial Sequence: Synthetic oligonucleotide
  Target: ATXN1; (-) strand; PAM type: NRG; PAM sequence: CAG
ttattttttttttagctcat

SEQ ID NO: 49932 - DNA, 20 bp, Artificial Sequence
  Description of Artificial Sequence: Synthetic oligonucleotide
  Target: ATXN1; (-) strand; PAM type: NRG; PAM sequence: TAG
aagtttatttattttttttt

SEQ ID NO: 49933 - DNA, 20 bp, Artificial Sequence
  Description of Artificial Sequence: Synthetic oligonucleotide
  Target: ATXN1; (-) strand; PAM type: NRG; PAM sequence: AAG
aacacttggccaagacttgc

SEQ ID NO: 49934 - DNA, 20 bp, Artificial Sequence
  Description of Artificial Sequence: Synthetic oligonucleotide
  Target: ATXN1; (-) strand; PAM type: NRG; PAM sequence: AAG
cttcccaggaacacttggcc

SEQ ID NO: 49935 - DNA, 20 bp, Artificial Sequence
  Description of Artificial Sequence: Synthetic oligonucleotide
  Target: ATXN1; (-) strand; PAM type: NRG; PAM sequence: TGG
caggccttcccaggaacact

SEQ ID NO: 49936 - DNA, 20 bp, Artificial Sequence
  Description of Artificial Sequence: Synthetic oligonucleotide
  Target: ATXN1; (-) strand; PAM type: NRG; PAM sequence: AGG
tctgccatccaggccttccc

SEQ ID NO: 49937 - DNA, 20 bp, Artificial Sequence
  Description of Artificial Sequence: Synthetic oligonucleotide
  Target: ATXN1; (-) strand; PAM type: NRG; PAM sequence: CAG
ctctgccatccaggccttcc

SEQ ID NO: 49938 - DNA, 20 bp, Artificial Sequence
  Description of Artificial Sequence: Synthetic oligonucleotide
  Target: ATXN1; (-) strand; PAM type: NRG; PAM sequence: AGG
cccattcacctctgccatcc

SEQ ID NO: 49939 - DNA, 20 bp, Artificial Sequence
  Description of Artificial Sequence: Synthetic oligonucleotide
  Target: ATXN1; (-) strand; PAM type: NRG; PAM sequence: CAG
tcccattcacctctgccatc

SEQ ID NO: 49940 - DNA, 20 bp, Artificial Sequence
  Description of Artificial Sequence: Synthetic oligonucleotide
  Target: ATXN1; (-) strand; PAM type: NRG; PAM sequence: TGG
tcagggagtctttctgagca

SEQ ID NO: 49941 - DNA, 20 bp, Artificial Sequence
  Description of Artificial Sequence: Synthetic oligonucleotide
  Target: ATXN1; (-) strand; PAM type: NRG; PAM sequence: GAG
ggctttcagggagtctttct

SEQ ID NO: 49942 - DNA, 20 bp, Artificial Sequence
  Description of Artificial Sequence: Synthetic oligonucleotide
  Target: ATXN1; (-) strand; PAM type: NRG; PAM sequence: GAG
ggagtaacaaggctttcagg

SEQ ID NO: 49943 - DNA, 20 bp, Artificial Sequence
  Description of Artificial Sequence: Synthetic oligonucleotide
  Target: ATXN1; (-) strand; PAM type: NRG; PAM sequence: GGG
gaggagtaacaaggctttca

SEQ ID NO: 49944 - DNA, 20 bp, Artificial Sequence
  Description of Artificial Sequence: Synthetic oligonucleotide
  Target: ATXN1; (-) strand; PAM type: NRG; PAM sequence: AGG
agaggagtaacaaggctttc

SEQ ID NO: 49945 - DNA, 20 bp, Artificial Sequence
  Description of Artificial Sequence: Synthetic oligonucleotide
  Target: ATXN1; (-) strand; PAM type: NRG; PAM sequence: CAG
gagaggagtaacaaggcttt

SEQ ID NO: 49946 - DNA, 20 bp, Artificial Sequence
  Description of Artificial Sequence: Synthetic oligonucleotide
  Target: ATXN1; (-) strand; PAM type: NRG; PAM sequence: AGG
tgggacagagaggagtaaca

SEQ ID NO: 49947 - DNA, 20 bp, Artificial Sequence
  Description of Artificial Sequence: Synthetic oligonucleotide
  Target: ATXN1; (-) strand; PAM type: NRG; PAM sequence: AAG
ttgggacagagaggagtaac

SEQ ID NO: 49948 - DNA, 20 bp, Artificial Sequence
  Description of Artificial Sequence: Synthetic oligonucleotide
  Target: ATXN1; (-) strand; PAM type: NRG; PAM sequence: GAG
agggaacttgggacagagag

SEQ ID NO: 49949 - DNA, 20 bp, Artificial Sequence
  Description of Artificial Sequence: Synthetic oligonucleotide
  Target: ATXN1; (-) strand; PAM type: NRG; PAM sequence: AGG
aaagggaacttgggacagag

SEQ ID NO: 49950 - DNA, 20 bp, Artificial Sequence
  Description of Artificial Sequence: Synthetic oligonucleotide
  Target: ATXN1; (-) strand; PAM type: NRG; PAM sequence: GAG
aaaagggaacttgggacaga

SEQ ID NO: 49951 - DNA, 20 bp, Artificial Sequence
  Description of Artificial Sequence: Synthetic oligonucleotide
  Target: ATXN1; (-) strand; PAM type: NRG; PAM sequence: GAG
ggaaaagggaacttgggaca

SEQ ID NO: 49952 - DNA, 20 bp, Artificial Sequence
  Description of Artificial Sequence: Synthetic oligonucleotide
  Target: ATXN1; (-) strand; PAM type: NRG; PAM sequence: CAG
tgggaaaagggaacttggga

SEQ ID NO: 49953 - DNA, 20 bp, Artificial Sequence
  Description of Artificial Sequence: Synthetic oligonucleotide
  Target: ATXN1; (-) strand; PAM type: NRG; PAM sequence: GGG
gtcctgggaaaagggaactt

SEQ ID NO: 49954 - DNA, 20 bp, Artificial Sequence
  Description of Artificial Sequence: Synthetic oligonucleotide
  Target: ATXN1; (-) strand; PAM type: NRG; PAM sequence: TGG
cgtcctgggaaaagggaact

SEQ ID NO: 49955 - DNA, 20 bp, Artificial Sequence
  Description of Artificial Sequence: Synthetic oligonucleotide
  Target: ATXN1; (-) strand; PAM type: NRG; PAM sequence: GGG
gagcaatcgtcctgggaaaa

SEQ ID NO: 49956 - DNA, 20 bp, Artificial Sequence
  Description of Artificial Sequence: Synthetic oligonucleotide
  Target: ATXN1; (-) strand; PAM type: NRG; PAM sequence: AGG
agagcaatcgtcctgggaaa

SEQ ID NO: 49957 - DNA, 20 bp, Artificial Sequence
  Description of Artificial Sequence: Synthetic oligonucleotide
  Target: ATXN1; (-) strand; PAM type: NRG; PAM sequence: AAG
aagagcaatcgtcctgggaa

SEQ ID NO: 49958 - DNA, 20 bp, Artificial Sequence
  Description of Artificial Sequence: Synthetic oligonucleotide
  Target: ATXN1; (-) strand; PAM type: NRG; PAM sequence: GGG
ggaggaagagcaatcgtcct

SEQ ID NO: 49959 - DNA, 20 bp, Artificial Sequence
  Description of Artificial Sequence: Synthetic oligonucleotide
  Target: ATXN1; (-) strand; PAM type: NRG; PAM sequence: TGG
gggaggaagagcaatcgtcc

SEQ ID NO: 49960 - DNA, 20 bp, Artificial Sequence
  Description of Artificial Sequence: Synthetic oligonucleotide
  Target: ATXN1; (-) strand; PAM type: NRG; PAM sequence: GAG
ggagggcgagatgggaggaa

SEQ ID NO: 49961 - DNA, 20 bp, Artificial Sequence
  Description of Artificial Sequence: Synthetic oligonucleotide
  Target: ATXN1; (-) strand; PAM type: NRG; PAM sequence: AAG
gaggagggcgagatgggagg

SEQ ID NO: 49962 - DNA, 20 bp, Artificial Sequence
  Description of Artificial Sequence: Synthetic oligonucleotide
  Target: ATXN1; (-) strand; PAM type: NRG; PAM sequence: AGG
agagaggagggcgagatggg

SEQ ID NO: 49963 - DNA, 20 bp, Artificial Sequence
  Description of Artificial Sequence: Synthetic oligonucleotide
  Target: ATXN1; (-) strand; PAM type: NRG; PAM sequence: GAG
aagagaggagggcgagatgg

SEQ ID NO: 49964 - DNA, 20 bp, Artificial Sequence
  Description of Artificial Sequence: Synthetic oligonucleotide
  Target: ATXN1; (-) strand; PAM type: NRG; PAM sequence: GGG
gtaagagaggagggcgagat

SEQ ID NO: 49965 - DNA, 20 bp, Artificial Sequence
  Description of Artificial Sequence: Synthetic oligonucleotide
  Target: ATXN1; (-) strand; PAM type: NRG; PAM sequence: TGG
tgtaagagaggagggcgaga

SEQ ID NO: 49966 - DNA, 20 bp, Artificial Sequence
  Description of Artificial Sequence: Synthetic oligonucleotide
  Target: ATXN1; (-) strand; PAM type: NRG; PAM sequence: GAG
gacctgtaagagaggagggc

SEQ ID NO: 49967 - DNA, 20 bp, Artificial Sequence
  Description of Artificial Sequence: Synthetic oligonucleotide
  Target: ATXN1; (-) strand; PAM type: NRG; PAM sequence: GGG
tagggacctgtaagagagga

SEQ ID NO: 49968 - DNA, 20 bp, Artificial Sequence
  Description of Artificial Sequence: Synthetic oligonucleotide
  Target: ATXN1; (-) strand; PAM type: NRG; PAM sequence: AGG
atagggacctgtaagagagg

SEQ ID NO: 49969 - DNA, 20 bp, Artificial Sequence
  Description of Artificial Sequence: Synthetic oligonucleotide
  Target: ATXN1; (-) strand; PAM type: NRG; PAM sequence: GAG
tatagggacctgtaagagag

SEQ ID NO: 49970 - DNA, 20 bp, Artificial Sequence
  Description of Artificial Sequence: Synthetic oligonucleotide
  Target: ATXN1; (-) strand; PAM type: NRG; PAM sequence: AGG
attatagggacctgtaagag

SEQ ID NO: 49971 - DNA, 20 bp, Artificial Sequence
  Description of Artificial Sequence: Synthetic oligonucleotide
  Target: ATXN1; (-) strand; PAM type: NRG; PAM sequence: GAG
cattatagggacctgtaaga

SEQ ID NO: 49972 - DNA, 20 bp, Artificial Sequence
  Description of Artificial Sequence: Synthetic oligonucleotide
  Target: ATXN1; (-) strand; PAM type: NRG; PAM sequence: GAG
gccattatagggacctgtaa

SEQ ID NO: 49973 - DNA, 20 bp, Artificial Sequence
  Description of Artificial Sequence: Synthetic oligonucleotide
  Target: ATXN1; (-) strand; PAM type: NRG; PAM sequence: AAG
cagccattatagggacctgt

SEQ ID NO: 49974 - DNA, 20 bp, Artificial Sequence
  Description of Artificial Sequence: Synthetic oligonucleotide
  Target: ATXN1; (-) strand; PAM type: NRG; PAM sequence: GGG
acataagaacagccattata

SEQ ID NO: 49975 - DNA, 20 bp, Artificial Sequence
  Description of Artificial Sequence: Synthetic oligonucleotide
  Target: ATXN1; (-) strand; PAM type: NRG; PAM sequence: AGG
aacataagaacagccattat

SEQ ID NO: 49976 - DNA, 20 bp, Artificial Sequence
  Description of Artificial Sequence: Synthetic oligonucleotide
  Target: ATXN1; (-) strand; PAM type: NRG; PAM sequence: TAG
gaacataagaacagccatta

SEQ ID NO: 49977 - DNA, 20 bp, Artificial Sequence
  Description of Artificial Sequence: Synthetic oligonucleotide
  Target: ATXN1; (-) strand; PAM type: NRG; PAM sequence: CAG
gggagtggggaacataagaa

SEQ ID NO: 49978 - DNA, 20 bp, Artificial Sequence
  Description of Artificial Sequence: Synthetic oligonucleotide
  Target: ATXN1; (-) strand; PAM type: NRG; PAM sequence: AAG
gggtagggagtggggaacat

SEQ ID NO: 49979 - DNA, 20 bp, Artificial Sequence
  Description of Artificial Sequence: Synthetic oligonucleotide
  Target: ATXN1; (-) strand; PAM type: NRG; PAM sequence: GGG
atggtgcggggtagggagtg

SEQ ID NO: 49980 - DNA, 20 bp, Artificial Sequence
  Description of Artificial Sequence: Synthetic oligonucleotide
  Target: ATXN1; (-) strand; PAM type: NRG; PAM sequence: GGG
tatggtgcggggtagggagt

SEQ ID NO: 49981 - DNA, 20 bp, Artificial Sequence
  Description of Artificial Sequence: Synthetic oligonucleotide
  Target: ATXN1; (-) strand; PAM type: NRG; PAM sequence: TGG
atatggtgcggggtagggag

SEQ ID NO: 49982 - DNA, 20 bp, Artificial Sequence
  Description of Artificial Sequence: Synthetic oligonucleotide
  Target: ATXN1; (-) strand; PAM type: NRG; PAM sequence: GAG
aagatatggtgcggggtagg

SEQ ID NO: 49983 - DNA, 20 bp, Artificial Sequence
  Description of Artificial Sequence: Synthetic oligonucleotide
  Target: ATXN1; (-) strand; PAM type: NRG; PAM sequence: GGG
agaagatatggtgcggggta

SEQ ID NO: 49984 - DNA, 20 bp, Artificial Sequence
  Description of Artificial Sequence: Synthetic oligonucleotide
  Target: ATXN1; (-) strand; PAM type: NRG; PAM sequence: AGG
gagaagatatggtgcggggt

SEQ ID NO: 49985 - DNA, 20 bp, Artificial Sequence
  Description of Artificial Sequence: Synthetic oligonucleotide
  Target: ATXN1; (-) strand; PAM type: NRG; PAM sequence: TAG
agagaagatatggtgcgggg

SEQ ID NO: 49986 - DNA, 20 bp, Artificial Sequence
  Description of Artificial Sequence: Synthetic oligonucleotide
  Target: ATXN1; (-) strand; PAM type: NRG; PAM sequence: GGG
ttaagagaagatatggtgcg

SEQ ID NO: 49987 - DNA, 20 bp, Artificial Sequence
  Description of Artificial Sequence: Synthetic oligonucleotide
  Target: ATXN1; (-) strand; PAM type: NRG; PAM sequence: GGG
cttaagagaagatatggtgc

SEQ ID NO: 49988 - DNA, 20 bp, Artificial Sequence
  Description of Artificial Sequence: Synthetic oligonucleotide
  Target: ATXN1; (-) strand; PAM type: NRG; PAM sequence: CGG
ccttaagagaagatatggtg

SEQ ID NO: 49989 - DNA, 20 bp, Artificial Sequence
  Description of Artificial Sequence: Synthetic oligonucleotide
  Target: ATXN1; (-) strand; PAM type: NRG; PAM sequence: TGG
ttcctccttaagagaagata

SEQ ID NO: 49990 - DNA, 20 bp, Artificial Sequence
  Description of Artificial Sequence: Synthetic oligonucleotide
  Target: ATXN1; (-) strand; PAM type: NRG; PAM sequence: AAG
gccaaattcctccttaagag

SEQ ID NO: 49991 - DNA, 20 bp, Artificial Sequence
  Description of Artificial Sequence: Synthetic oligonucleotide
  Target: ATXN1; (-) strand; PAM type: NRG; PAM sequence: GAG
taggccaaattcctccttaa

SEQ ID NO: 49992 - DNA, 20 bp, Artificial Sequence
  Description of Artificial Sequence: Synthetic oligonucleotide
  Target: ATXN1; (-) strand; PAM type: NRG; PAM sequence: AAG
attaggccaaattcctcctt

SEQ ID NO: 49993 - DNA, 20 bp, Artificial Sequence
  Description of Artificial Sequence: Synthetic oligonucleotide
  Target: ATXN1; (-) strand; PAM type: NRG; PAM sequence: AGG
tcaatgattaaacttagatt

SEQ ID NO: 49994 - DNA, 20 bp, Artificial Sequence
  Description of Artificial Sequence: Synthetic oligonucleotide
  Target: ATXN1; (-) strand; PAM type: NRG; PAM sequence: TAG
gtcaatgattaaacttagat

SEQ ID NO: 49995 - DNA, 20 bp, Artificial Sequence
  Description of Artificial Sequence: Synthetic oligonucleotide
  Target: ATXN1; (-) strand; PAM type: NRG; PAM sequence: TAG
gaaaggtcaatgattaaact

SEQ ID NO: 49996 - DNA, 20 bp, Artificial Sequence
  Description of Artificial Sequence: Synthetic oligonucleotide
  Target: ATXN1; (-) strand; PAM type: NRG; PAM sequence: AGG
tattccttgtgaggtcagaa

SEQ ID NO: 49997 - DNA, 20 bp, Artificial Sequence
  Description of Artificial Sequence: Synthetic oligonucleotide
  Target: ATXN1; (-) strand; PAM type: NRG; PAM sequence: AAG
ctattccttgtgaggtcaga

SEQ ID NO: 49998 - DNA, 20 bp, Artificial Sequence
  Description of Artificial Sequence: Synthetic oligonucleotide
  Target: ATXN1; (-) strand; PAM type: NRG; PAM sequence: CAG
cttgctattccttgtgaggt

SEQ ID NO: 49999 - DNA, 20 bp, Artificial Sequence
  Description of Artificial Sequence: Synthetic oligonucleotide
  Target: ATXN1; (-) strand; PAM type: NRG; PAM sequence: AGG
ttagcttgctattccttgtg

SEQ ID NO: 50000 - DNA, 20 bp, Artificial Sequence
  Description of Artificial Sequence: Synthetic oligonucleotide
  Target: ATXN1; (-) strand; PAM type: NRG; PAM sequence: GAG
tttagcttgctattccttgt

SEQ ID NO: 50001 - DNA, 20 bp, Artificial Sequence
  Description of Artificial Sequence: Synthetic oligonucleotide
  Target: ATXN1; (-) strand; PAM type: NRG; PAM sequence: TAG
ggacaagttctgtgcttatt

SEQ ID NO: 50002 - DNA, 20 bp, Artificial Sequence
  Description of Artificial Sequence: Synthetic oligonucleotide
  Target: ATXN1; (-) strand; PAM type: NRG; PAM sequence: AAG
cctcaccatctaaggaggac

SEQ ID NO: 50003 - DNA, 20 bp, Artificial Sequence
  Description of Artificial Sequence: Synthetic oligonucleotide
  Target: ATXN1; (-) strand; PAM type: NRG; PAM sequence: AGG
tctttcctcaccatctaagg

SEQ ID NO: 50004 - DNA, 20 bp, Artificial Sequence
  Description of Artificial Sequence: Synthetic oligonucleotide
  Target: ATXN1; (-) strand; PAM type: NRG; PAM sequence: GAG
ctctttcctcaccatctaag

SEQ ID NO: 50005 - DNA, 20 bp, Artificial Sequence
  Description of Artificial Sequence: Synthetic oligonucleotide
  Target: ATXN1; (-) strand; PAM type: NRG; PAM sequence: AGG
ttctctttcctcaccatcta

SEQ ID NO: 50006 - DNA, 20 bp, Artificial Sequence
  Description of Artificial Sequence: Synthetic oligonucleotide
  Target: ATXN1; (-) strand; PAM type: NRG; PAM sequence: AAG
attctctttcctcaccatct

SEQ ID NO: 50007 - DNA, 20 bp, Artificial Sequence
  Description of Artificial Sequence: Synthetic oligonucleotide
  Target: ATXN1; (-) strand; PAM type: NRG; PAM sequence: AAG
gaattaaagaaaaatatagc

SEQ ID NO: 50008 - DNA, 20 bp, Artificial Sequence
  Description of Artificial Sequence: Synthetic oligonucleotide
  Target: ATXN1; (-) strand; PAM type: NRG; PAM sequence: TAG
ccatgaattaaagaaaaata

SEQ ID NO: 50009 - DNA, 20 bp, Artificial Sequence
  Description of Artificial Sequence: Synthetic oligonucleotide
  Target: ATXN1; (-) strand; PAM type: NRG; PAM sequence: AAG
ataaaatgttccatgaatta

SEQ ID NO: 50010 - DNA, 20 bp, Artificial Sequence
  Description of Artificial Sequence: Synthetic oligonucleotide
  Target: ATXN1; (-) strand; PAM type: NRG; PAM sequence: CAG
agtattcccaacagtcctcc

SEQ ID NO: 50011 - DNA, 20 bp, Artificial Sequence
  Description of Artificial Sequence: Synthetic oligonucleotide
  Target: ATXN1; (-) strand; PAM type: NRG; PAM sequence: CAG
gtatgacagagtattcccaa

SEQ ID NO: 50012 - DNA, 20 bp, Artificial Sequence
  Description of Artificial Sequence: Synthetic oligonucleotide
  Target: ATXN1; (-) strand; PAM type: NRG; PAM sequence: GAG
ggaatgatgctggtatgaca

SEQ ID NO: 50013 - DNA, 20 bp, Artificial Sequence
  Description of Artificial Sequence: Synthetic oligonucleotide
  Target: ATXN1; (-) strand; PAM type: NRG; PAM sequence: CAG
gtggaatgatgctggtatga

SEQ ID NO: 50014 - DNA, 20 bp, Artificial Sequence
  Description of Artificial Sequence: Synthetic oligonucleotide
  Target: ATXN1; (-) strand; PAM type: NRG; PAM sequence: TGG
gggctcaagtggaatgatgc

SEQ ID NO: 50015 - DNA, 20 bp, Artificial Sequence
  Description of Artificial Sequence: Synthetic oligonucleotide
  Target: ATXN1; (-) strand; PAM type: NRG; PAM sequence: TGG
tatagcataaagggctcaag

SEQ ID NO: 50016 - DNA, 20 bp, Artificial Sequence
  Description of Artificial Sequence: Synthetic oligonucleotide
  Target: ATXN1; (-) strand; PAM type: NRG; PAM sequence: AAG
tattatagcataaagggctc

SEQ ID NO: 50017 - DNA, 20 bp, Artificial Sequence
  Description of Artificial Sequence: Synthetic oligonucleotide
  Target: ATXN1; (-) strand; PAM type: NRG; PAM sequence: GGG
atttaatattatagcataaa

SEQ ID NO: 50018 - DNA, 20 bp, Artificial Sequence
  Description of Artificial Sequence: Synthetic oligonucleotide
  Target: ATXN1; (-) strand; PAM type: NRG; PAM sequence: AGG
catttaatattatagcataa

SEQ ID NO: 50019 - DNA, 20 bp, Artificial Sequence
  Description of Artificial Sequence: Synthetic oligonucleotide
  Target: ATXN1; (-) strand; PAM type: NRG; PAM sequence: AAG
acatttaatattatagcata

SEQ ID NO: 50020 - DNA, 20 bp, Artificial Sequence
  Description of Artificial Sequence: Synthetic oligonucleotide
  Target: ATXN1; (-) strand; PAM type: NRG; PAM sequence: TAG
tataactacatttaatatta

SEQ ID NO: 50021 - DNA, 20 bp, Artificial Sequence
  Description of Artificial Sequence: Synthetic oligonucleotide
  Target: ATXN1; (-) strand; PAM type: NRG; PAM sequence: AGG
agtttgaaaagaaggaaaat

SEQ ID NO: 50022 - DNA, 20 bp, Artificial Sequence
  Description of Artificial Sequence: Synthetic oligonucleotide
  Target: ATXN1; (-) strand; PAM type: NRG; PAM sequence: TAG
tagtttgaaaagaaggaaaa

SEQ ID NO: 50023 - DNA, 20 bp, Artificial Sequence
  Description of Artificial Sequence: Synthetic oligonucleotide
  Target: ATXN1; (-) strand; PAM type: NRG; PAM sequence: AGG
agttttatagtttgaaaaga

SEQ ID NO: 50024 - DNA, 20 bp, Artificial Sequence
  Description of Artificial Sequence: Synthetic oligonucleotide
  Target: ATXN1; (-) strand; PAM type: NRG; PAM sequence: AAG
aagttttatagtttgaaaag

SEQ ID NO: 50025 - DNA, 20 bp, Artificial Sequence
  Description of Artificial Sequence: Synthetic oligonucleotide
  Target: ATXN1; (-) strand; PAM type: NRG; PAM sequence: AAG
actaagttttatagtttgaa

SEQ ID NO: 50026 - DNA, 20 bp, Artificial Sequence
  Description of Artificial Sequence: Synthetic oligonucleotide
  Target: ATXN1; (-) strand; PAM type: NRG; PAM sequence: TAG
acgtgaaagactaagtttta

SEQ ID NO: 50027 - DNA, 20 bp, Artificial Sequence
  Description of Artificial Sequence: Synthetic oligonucleotide
  Target: ATXN1; (-) strand; PAM type: NRG; PAM sequence: AAG
ctcccattacgtgaaagact

SEQ ID NO: 50028 - DNA, 20 bp, Artificial Sequence
  Description of Artificial Sequence: Synthetic oligonucleotide
  Target: ATXN1; (-) strand; PAM type: NRG; PAM sequence: AAG
tcgcctctcccattacgtga

SEQ ID NO: 50029 - DNA, 20 bp, Artificial Sequence
  Description of Artificial Sequence: Synthetic oligonucleotide
  Target: ATXN1; (-) strand; PAM type: NRG; PAM sequence: AAG
atatattgagcatttaccat

SEQ ID NO: 50030 - DNA, 20 bp, Artificial Sequence
  Description of Artificial Sequence: Synthetic oligonucleotide
  Target: ATXN1; (-) strand; PAM type: NRG; PAM sequence: GAG
taataatagataaatatatt

SEQ ID NO: 50031 - DNA, 20 bp, Artificial Sequence
  Description of Artificial Sequence: Synthetic oligonucleotide
  Target: ATXN1; (-) strand; PAM type: NRG; PAM sequence: TAG
tccagtattatcattaataa

SEQ ID NO: 50032 - DNA, 20 bp, Artificial Sequence
  Description of Artificial Sequence: Synthetic oligonucleotide
  Target: ATXN1; (-) strand; PAM type: NRG; PAM sequence: CAG
gaattatttcagtataaatc

SEQ ID NO: 50033 - DNA, 20 bp, Artificial Sequence
  Description of Artificial Sequence: Synthetic oligonucleotide
  Target: ATXN1; (-) strand; PAM type: NRG; PAM sequence: CAG
taataagtggtgaattattt

SEQ ID NO: 50034 - DNA, 20 bp, Artificial Sequence
  Description of Artificial Sequence: Synthetic oligonucleotide
  Target: ATXN1; (-) strand; PAM type: NRG; PAM sequence: TGG
aagaattgtgttttaataag

SEQ ID NO: 50035 - DNA, 20 bp, Artificial Sequence
  Description of Artificial Sequence: Synthetic oligonucleotide
  Target: ATXN1; (-) strand; PAM type: NRG; PAM sequence: AAG
tttaagaattgtgttttaat

SEQ ID NO: 50036 - DNA, 20 bp, Artificial Sequence
  Description of Artificial Sequence: Synthetic oligonucleotide
  Target: ATXN1; (-) strand; PAM type: NRG; PAM sequence: AAG
ggaagggcaacttatatttt

SEQ ID NO: 50037 - DNA, 20 bp, Artificial Sequence
  Description of Artificial Sequence: Synthetic oligonucleotide
  Target: ATXN1; (-) strand; PAM type: NRG; PAM sequence: GGG
aaagtgtgtgtggtggggaa

SEQ ID NO: 50038 - DNA, 20 bp, Artificial Sequence
  Description of Artificial Sequence: Synthetic oligonucleotide
  Target: ATXN1; (-) strand; PAM type: NRG; PAM sequence: AGG
aaaagtgtgtgtggtgggga

SEQ ID NO: 50039 - DNA, 20 bp, Artificial Sequence
  Description of Artificial Sequence: Synthetic oligonucleotide
  Target: ATXN1; (-) strand; PAM type: NRG; PAM sequence: AAG
gaaaagtgtgtgtggtgggg

SEQ ID NO: 50040 - DNA, 20 bp, Artificial Sequence
  Description of Artificial Sequence: Synthetic oligonucleotide
  Target: ATXN1; (-) strand; PAM type: NRG; PAM sequence: GGG
acagaaaagtgtgtgtggtg

SEQ ID NO: 50041 - DNA, 20 bp, Artificial Sequence
  Description of Artificial Sequence: Synthetic oligonucleotide
  Target: ATXN1; (-) strand; PAM type: NRG; PAM sequence: GGG
aacagaaaagtgtgtgtggt

SEQ ID NO: 50042 - DNA, 20 bp, Artificial Sequence
  Description of Artificial Sequence: Synthetic oligonucleotide
  Target: ATXN1; (-) strand; PAM type: NRG; PAM sequence: TGG
aaacagaaaagtgtgtgtgg

SEQ ID NO: 50043 - DNA, 20 bp, Artificial Sequence
  Description of Artificial Sequence: Synthetic oligonucleotide
  Target: ATXN1; (-) strand; PAM type: NRG; PAM sequence: TGG
cacaaacagaaaagtgtgtg

SEQ ID NO: 50044 - DNA, 20 bp, Artificial Sequence
  Description of Artificial Sequence: Synthetic oligonucleotide
  Target: ATXN1; (-) strand; PAM type: NRG; PAM sequence: AAG
tctaatgaccacaaacagaa

SEQ ID NO: 50045 - DNA, 20 bp, Artificial Sequence
  Description of Artificial Sequence: Synthetic oligonucleotide
  Target: ATXN1; (-) strand; PAM type: NRG; PAM sequence: CAG
catgatctaatgaccacaaa

SEQ ID NO: 50046 - DNA, 20 bp, Artificial Sequence
  Description of Artificial Sequence: Synthetic oligonucleotide
  Target: ATXN1; (-) strand; PAM type: NRG; PAM sequence: TAG
tgtttaggcaaagccgttag

SEQ ID NO: 50047 - DNA, 20 bp, Artificial Sequence
  Description of Artificial Sequence: Synthetic oligonucleotide
  Target: ATXN1; (-) strand; PAM type: NRG; PAM sequence: TAG
aattgtttaggcaaagccgt

SEQ ID NO: 50048 - DNA, 20 bp, Artificial Sequence
  Description of Artificial Sequence: Synthetic oligonucleotide
  Target: ATXN1; (-) strand; PAM type: NRG; PAM sequence: AAG
atgaataaattgtttaggca

SEQ ID NO: 50049 - DNA, 20 bp, Artificial Sequence
  Description of Artificial Sequence: Synthetic oligonucleotide
  Target: ATXN1; (-) strand; PAM type: NRG; PAM sequence: AGG
gttaaatgaataaattgttt

SEQ ID NO: 50050 - DNA, 20 bp, Artificial Sequence
  Description of Artificial Sequence: Synthetic oligonucleotide
  Target: ATXN1; (-) strand; PAM type: NRG; PAM sequence: TAG
tgttaaatgaataaattgtt

SEQ ID NO: 50051 - DNA, 20 bp, Artificial Sequence
  Description of Artificial Sequence: Synthetic oligonucleotide
  Target: ATXN1; (-) strand; PAM type: NRG; PAM sequence: TAG
ctagctgggtgcctggtgtg

SEQ ID NO: 50052 - DNA, 20 bp, Artificial Sequence
  Description of Artificial Sequence: Synthetic oligonucleotide
  Target: ATXN1; (-) strand; PAM type: NRG; PAM sequence: TGG
ccccagactagctgggtgcc

SEQ ID NO: 50053 - DNA, 20 bp, Artificial Sequence
  Description of Artificial Sequence: Synthetic oligonucleotide
  Target: ATXN1; (-) strand; PAM type: NRG; PAM sequence: GGG
tttttgtccccagactagct

SEQ ID NO: 50054 - DNA, 20 bp, Artificial Sequence
  Description of Artificial Sequence: Synthetic oligonucleotide
  Target: ATXN1; (-) strand; PAM type: NRG; PAM sequence: TGG
gtttttgtccccagactagc

SEQ ID NO: 50055 - DNA, 20 bp, Artificial Sequence
  Description of Artificial Sequence: Synthetic oligonucleotide
  Target: ATXN1; (-) strand; PAM type: NRG; PAM sequence: TAG
acccgtttttgtccccagac

SEQ ID NO: 50056 - DNA, 20 bp, Artificial Sequence
  Description of Artificial Sequence: Synthetic oligonucleotide
  Target: ATXN1; (-) strand; PAM type: NRG; PAM sequence: CAG
gtcttacccgtttttgtccc

SEQ ID NO: 50057 - DNA, 20 bp, Artificial Sequence
  Description of Artificial Sequence: Synthetic oligonucleotide
  Target: ATXN1; (-) strand; PAM type: NRG; PAM sequence: AAG
atcatccctttggggcagaa

SEQ ID NO: 50058 - DNA, 20 bp, Artificial Sequence
  Description of Artificial Sequence: Synthetic oligonucleotide
  Target: ATXN1; (-) strand; PAM type: NRG; PAM sequence: CAG
attccatcatccctttgggg

SEQ ID NO: 50059 - DNA, 20 bp, Artificial Sequence
  Description of Artificial Sequence: Synthetic oligonucleotide
  Target: ATXN1; (-) strand; PAM type: NRG; PAM sequence: GGG
tccattccatcatccctttg

SEQ ID NO: 50060 - DNA, 20 bp, Artificial Sequence
  Description of Artificial Sequence: Synthetic oligonucleotide
  Target: ATXN1; (-) strand; PAM type: NRG; PAM sequence: GGG
ctccattccatcatcccttt

SEQ ID NO: 50061 - DNA, 20 bp, Artificial Sequence
  Description of Artificial Sequence: Synthetic oligonucleotide
  Target: ATXN1; (-) strand; PAM type: NRG; PAM sequence: TGG
cctccattccatcatccctt

SEQ ID NO: 50062 - DNA, 20 bp, Artificial Sequence
  Description of Artificial Sequence: Synthetic oligonucleotide
  Target: ATXN1; (-) strand; PAM type: NRG; PAM sequence: AAG
caaaggagtgccccatgtca

SEQ ID NO: 50063 - DNA, 20 bp, Artificial Sequence
  Description of Artificial Sequence: Synthetic oligonucleotide
  Target: ATXN1; (-) strand; PAM type: NRG; PAM sequence: GAG
ctttacttcattggccaaag

SEQ ID NO: 50064 - DNA, 20 bp, Artificial Sequence
  Description of Artificial Sequence: Synthetic oligonucleotide
  Target: ATXN1; (-) strand; PAM type: NRG; PAM sequence: AGG
acctttacttcattggccaa

SEQ ID NO: 50065 - DNA, 20 bp, Artificial Sequence
  Description of Artificial Sequence: Synthetic oligonucleotide
  Target: ATXN1; (-) strand; PAM type: NRG; PAM sequence: AAG
gacctttacttcattggcca

SEQ ID NO: 50066 - DNA, 20 bp, Artificial Sequence
  Description of Artificial Sequence: Synthetic oligonucleotide
  Target: ATXN1; (-) strand; PAM type: NRG; PAM sequence: TGG
ctcactgacctttacttcat

SEQ ID NO: 50067 - DNA, 20 bp, Artificial Sequence
  Description of Artificial Sequence: Synthetic oligonucleotide
  Target: ATXN1; (-) strand; PAM type: NRG; PAM sequence: AGG
ttcatgaccttttctatgac

SEQ ID NO: 50068 - DNA, 20 bp, Artificial Sequence
  Description of Artificial Sequence: Synthetic oligonucleotide
  Target: ATXN1; (-) strand; PAM type: NRG; PAM sequence: CAG
attcatgaccttttctatga

SEQ ID NO: 50069 - DNA, 20 bp, Artificial Sequence
  Description of Artificial Sequence: Synthetic oligonucleotide
  Target: ATXN1; (-) strand; PAM type: NRG; PAM sequence: TGG
aaagtgaagtatcctgtagc

SEQ ID NO: 50070 - DNA, 20 bp, Artificial Sequence
  Description of Artificial Sequence: Synthetic oligonucleotide
  Target: ATXN1; (-) strand; PAM type: NRG; PAM sequence: TAG
gagcaaagtgaagtatcctg

SEQ ID NO: 50071 - DNA, 20 bp, Artificial Sequence
  Description of Artificial Sequence: Synthetic oligonucleotide
  Target: ATXN1; (-) strand; PAM type: NRG; PAM sequence: AAG
aatctcatgagagcaaagtg

SEQ ID NO: 50072 - DNA, 20 bp, Artificial Sequence
  Description of Artificial Sequence: Synthetic oligonucleotide
  Target: ATXN1; (-) strand; PAM type: NRG; PAM sequence: AAG
gaccaaatctcatgagagca

SEQ ID NO: 50073 - DNA, 20 bp, Artificial Sequence
  Description of Artificial Sequence: Synthetic oligonucleotide
  Target: ATXN1; (-) strand; PAM type: NRG; PAM sequence: GAG
ttactgaccaaatctcatga

SEQ ID NO: 50074 - DNA, 20 bp, Artificial Sequence
  Description of Artificial Sequence: Synthetic oligonucleotide
  Target: ATXN1; (-) strand; PAM type: NRG; PAM sequence: GAG
ctttactgaccaaatctcat

SEQ ID NO: 50075 - DNA, 20 bp, Artificial Sequence
  Description of Artificial Sequence: Synthetic oligonucleotide
  Target: ATXN1; (-) strand; PAM type: NRG; PAM sequence: CGG
ctcctgattttctctttaca

SEQ ID NO: 50076 - DNA, 20 bp, Artificial Sequence
  Description of Artificial Sequence: Synthetic oligonucleotide
  Target: ATXN1; (-) strand; PAM type: NRG; PAM sequence: AGG
cttttgttcacaggctggca

SEQ ID NO: 50077 - DNA, 20 bp, Artificial Sequence
  Description of Artificial Sequence: Synthetic oligonucleotide
  Target: ATXN1; (-) strand; PAM type: NRG; PAM sequence: AAG
tcttttgttcacaggctggc

SEQ ID NO: 50078 - DNA, 20 bp, Artificial Sequence
  Description of Artificial Sequence: Synthetic oligonucleotide
  Target: ATXN1; (-) strand; PAM type: NRG; PAM sequence: TGG
ctagtcttttgttcacaggc

SEQ ID NO: 50079 - DNA, 20 bp, Artificial Sequence
  Description of Artificial Sequence: Synthetic oligonucleotide
  Target: ATXN1; (-) strand; PAM type: NRG; PAM sequence: AGG
ttggctagtcttttgttcac

SEQ ID NO: 50080 - DNA, 20 bp, Artificial Sequence
  Description of Artificial Sequence: Synthetic oligonucleotide
  Target: ATXN1; (-) strand; PAM type: NRG; PAM sequence: CAG
attggctagtcttttgttca

SEQ ID NO: 50081 - DNA, 20 bp, Artificial Sequence
  Description of Artificial Sequence: Synthetic oligonucleotide
  Target: ATXN1; (-) strand; PAM type: NRG; PAM sequence: TAG
tggtaagaagtggcattggc

SEQ ID NO: 50082 - DNA, 20 bp, Artificial Sequence
  Description of Artificial Sequence: Synthetic oligonucleotide
  Target: ATXN1; (-) strand; PAM type: NRG; PAM sequence: TGG
ttgctggtaagaagtggcat

SEQ ID NO: 50083 - DNA, 20 bp, Artificial Sequence
  Description of Artificial Sequence: Synthetic oligonucleotide
  Target: ATXN1; (-) strand; PAM type: NRG; PAM sequence: TGG
tggaccttgctggtaagaag

SEQ ID NO: 50084 - DNA, 20 bp, Artificial Sequence
  Description of Artificial Sequence: Synthetic oligonucleotide
  Target: ATXN1; (-) strand; PAM type: NRG; PAM sequence: AAG
gtttggaccttgctggtaag

SEQ ID NO: 50085 - DNA, 20 bp, Artificial Sequence
  Description of Artificial Sequence: Synthetic oligonucleotide
  Target: ATXN1; (-) strand; PAM type: NRG; PAM sequence: AAG
actgtttggaccttgctggt

SEQ ID NO: 50086 - DNA, 20 bp, Artificial Sequence
  Description of Artificial Sequence: Synthetic oligonucleotide
  Target: ATXN1; (-) strand; PAM type: NRG; PAM sequence: TGG
catgactgtttggaccttgc

SEQ ID NO: 50087 - DNA, 20 bp, Artificial Sequence
  Description of Artificial Sequence: Synthetic oligonucleotide
  Target: ATXN1; (-) strand; PAM type: NRG; PAM sequence: TGG
ataaccttggcatgactgtt

SEQ ID NO: 50088 - DNA, 20 bp, Artificial Sequence
  Description of Artificial Sequence: Synthetic oligonucleotide
  Target: ATXN1; (-) strand; PAM type: NRG; PAM sequence: TGG
ctacataccccacataacct

SEQ ID NO: 50089 - DNA, 20 bp, Artificial Sequence
  Description of Artificial Sequence: Synthetic oligonucleotide
  Target: ATXN1; (-) strand; PAM type: NRG; PAM sequence: GAG
aattcaagacagggtacaga

SEQ ID NO: 50090 - DNA, 20 bp, Artificial Sequence
  Description of Artificial Sequence: Synthetic oligonucleotide
  Target: ATXN1; (-) strand; PAM type: NRG; PAM sequence: GAG
agaattcaagacagggtaca

SEQ ID NO: 50091 - DNA, 20 bp, Artificial Sequence
  Description of Artificial Sequence: Synthetic oligonucleotide
  Target: ATXN1; (-) strand; PAM type: NRG; PAM sequence: CAG
atagaattcaagacagggta

SEQ ID NO: 50092 - DNA, 20 bp, Artificial Sequence
  Description of Artificial Sequence: Synthetic oligonucleotide
  Target: ATXN1; (-) strand; PAM type: NRG; PAM sequence: GGG
gcaaaatagaattcaagaca

SEQ ID NO: 50093 - DNA, 20 bp, Artificial Sequence
  Description of Artificial Sequence: Synthetic oligonucleotide
  Target: ATXN1; (-) strand; PAM type: NRG; PAM sequence: AGG
tgcaaaatagaattcaagac

SEQ ID NO: 50094 - DNA, 20 bp, Artificial Sequence
  Description of Artificial Sequence: Synthetic oligonucleotide
  Target: ATXN1; (-) strand; PAM type: NRG; PAM sequence: CAG
gtgcaaaatagaattcaaga

SEQ ID NO: 50095 - DNA, 20 bp, Artificial Sequence
  Description of Artificial Sequence: Synthetic oligonucleotide
  Target: ATXN1; (-) strand; PAM type: NRG; PAM sequence: AAG
ggatgtgcaaaatagaattc

SEQ ID NO: 50096 - DNA, 20 bp, Artificial Sequence
  Description of Artificial Sequence: Synthetic oligonucleotide
  Target: ATXN1; (-) strand; PAM type: NRG; PAM sequence: TAG
gctttcctggatgtgcaaaa

SEQ ID NO: 50097 - DNA, 20 bp, Artificial Sequence
  Description of Artificial Sequence: Synthetic oligonucleotide
  Target: ATXN1; (-) strand; PAM type: NRG; PAM sequence: TGG
catgcgtttcttggctttcc

SEQ ID NO: 50098 - DNA, 20 bp, Artificial Sequence
  Description of Artificial Sequence: Synthetic oligonucleotide
  Target: ATXN1; (-) strand; PAM type: NRG; PAM sequence: TGG
aatcaggtgcatgcgtttct

SEQ ID NO: 50099 - DNA, 20 bp, Artificial Sequence
  Description of Artificial Sequence: Synthetic oligonucleotide
  Target: ATXN1; (-) strand; PAM type: NRG; PAM sequence: AGG
tgactatatatgttgcaatc

SEQ ID NO: 50100 - DNA, 20 bp, Artificial Sequence
  Description of Artificial Sequence: Synthetic oligonucleotide
  Target: ATXN1; (-) strand; PAM type: NRG; PAM sequence: CAG
atgactatatatgttgcaat

SEQ ID NO: 50101 - DNA, 20 bp, Artificial Sequence
  Description of Artificial Sequence: Synthetic oligonucleotide
  Target: ATXN1; (-) strand; PAM type: NRG; PAM sequence: TGG
taatcttgccatccaaactg

SEQ ID NO: 50102 - DNA, 20 bp, Artificial Sequence
  Description of Artificial Sequence: Synthetic oligonucleotide
  Target: ATXN1; (-) strand; PAM type: NRG; PAM sequence: AGG
gaagctctctgataggaaaa

SEQ ID NO: 50103 - DNA, 20 bp, Artificial Sequence
  Description of Artificial Sequence: Synthetic oligonucleotide
  Target: ATXN1; (-) strand; PAM type: NRG; PAM sequence: AAG
tgaagctctctgataggaaa

SEQ ID NO: 50104 - DNA, 20 bp, Artificial Sequence
  Description of Artificial Sequence: Synthetic oligonucleotide
  Target: ATXN1; (-) strand; PAM type: NRG; PAM sequence: AGG
aacagatgaagctctctgat

SEQ ID NO: 50105 - DNA, 20 bp, Artificial Sequence
  Description of Artificial Sequence: Synthetic oligonucleotide
  Target: ATXN1; (-) strand; PAM type: NRG; PAM sequence: TAG
aaacagatgaagctctctga

SEQ ID NO: 50106 - DNA, 20 bp, Artificial Sequence
  Description of Artificial Sequence: Synthetic oligonucleotide
  Target: ATXN1; (-) strand; PAM type: NRG; PAM sequence: AAG
gaagtcagagaaaacagatg

SEQ ID NO: 50107 - DNA, 20 bp, Artificial Sequence
  Description of Artificial Sequence: Synthetic oligonucleotide
  Target: ATXN1; (-) strand; PAM type: NRG; PAM sequence: CAG
catggagaagtcagagaaaa

SEQ ID NO: 50108 - DNA, 20 bp, Artificial Sequence
  Description of Artificial Sequence: Synthetic oligonucleotide
  Target: ATXN1; (-) strand; PAM type: NRG; PAM sequence: GAG
gtggatccatggagaagtca

SEQ ID NO: 50109 - DNA, 20 bp, Artificial Sequence
  Description of Artificial Sequence: Synthetic oligonucleotide
  Target: ATXN1; (-) strand; PAM type: NRG; PAM sequence: CAG
ttgtggatccatggagaagt

SEQ ID NO: 50110 - DNA, 20 bp, Artificial Sequence
  Description of Artificial Sequence: Synthetic oligonucleotide
  Target: ATXN1; (-) strand; PAM type: NRG; PAM sequence: AAG
actgttgtggatccatggag

SEQ ID NO: 50111 - DNA, 20 bp, Artificial Sequence
  Description of Artificial Sequence: Synthetic oligonucleotide
  Target: ATXN1; (-) strand; PAM type: NRG; PAM sequence: GAG
ttgactgttgtggatccatg

SEQ ID NO: 50112 - DNA, 20 bp, Artificial Sequence
  Description of Artificial Sequence: Synthetic oligonucleotide
  Target: ATXN1; (-) strand; PAM type: NRG; PAM sequence: TGG
cattgactgttgtggatcca

SEQ ID NO: 50113 - DNA, 20 bp, Artificial Sequence
  Description of Artificial Sequence: Synthetic oligonucleotide
  Target: ATXN1; (-) strand; PAM type: NRG; PAM sequence: TGG
ttttaaagcattgactgttg

SEQ ID NO: 50114 - DNA, 20 bp, Artificial Sequence
  Description of Artificial Sequence: Synthetic oligonucleotide
  Target: ATXN1; (-) strand; PAM type: NRG; PAM sequence: AAG
catgtcctgagtatttttta

SEQ ID NO: 50115 - DNA, 20 bp, Artificial Sequence
  Description of Artificial Sequence: Synthetic oligonucleotide
  Target: ATXN1; (-) strand; PAM type: NRG; PAM sequence: GAG
tttgtattggtccatgtcct

SEQ ID NO: 50116 - DNA, 20 bp, Artificial Sequence
  Description of Artificial Sequence: Synthetic oligonucleotide
  Target: ATXN1; (-) strand; PAM type: NRG; PAM sequence: TGG
gattacctttatttttgtat

SEQ ID NO: 50117 - DNA, 20 bp, Artificial Sequence
  Description of Artificial Sequence: Synthetic oligonucleotide
  Target: ATXN1; (-) strand; PAM type: NRG; PAM sequence: CAG
ctgtggccttattccatgtt

SEQ ID NO: 50118 - DNA, 20 bp, Artificial Sequence
  Description of Artificial Sequence: Synthetic oligonucleotide
  Target: ATXN1; (-) strand; PAM type: NRG; PAM sequence: TGG
tctttttagagaaccttctg

SEQ ID NO: 50119 - DNA, 20 bp, Artificial Sequence
  Description of Artificial Sequence: Synthetic oligonucleotide
  Target: ATXN1; (-) strand; PAM type: NRG; PAM sequence: GAG
aaggtcagatactcttttta

SEQ ID NO: 50120 - DNA, 20 bp, Artificial Sequence
  Description of Artificial Sequence: Synthetic oligonucleotide
  Target: ATXN1; (-) strand; PAM type: NRG; PAM sequence: TAG
gcaaggtcagatactctttt

SEQ ID NO: 50121 - DNA, 20 bp, Artificial Sequence
  Description of Artificial Sequence: Synthetic oligonucleotide
  Target: ATXN1; (-) strand; PAM type: NRG; PAM sequence: CAG
cacaccagtctgagcaaggt

SEQ ID NO: 50122 - DNA, 20 bp, Artificial Sequence
  Description of Artificial Sequence: Synthetic oligonucleotide
  Target: ATXN1; (-) strand; PAM type: NRG; PAM sequence: AGG
tggtcacaccagtctgagca

SEQ ID NO: 50123 - DNA, 20 bp, Artificial Sequence
  Description of Artificial Sequence: Synthetic oligonucleotide
  Target: ATXN1; (-) strand; PAM type: NRG; PAM sequence: AAG
atggtcacaccagtctgagc

SEQ ID NO: 50124 - DNA, 20 bp, Artificial Sequence
  Description of Artificial Sequence: Synthetic oligonucleotide
  Target: ATXN1; (-) strand; PAM type: NRG; PAM sequence: GAG
tctcatggtcacaccagtct

SEQ ID NO: 50125 - DNA, 20 bp, Artificial Sequence
  Description of Artificial Sequence: Synthetic oligonucleotide
  Target: ATXN1; (-) strand; PAM type: NRG; PAM sequence: CAG
ctcatatctcatggtcacac

SEQ ID NO: 50126 - DNA, 20 bp, Artificial Sequence
  Description of Artificial Sequence: Synthetic oligonucleotide
  Target: ATXN1; (-) strand; PAM type: NRG; PAM sequence: TGG
ttgttccatctcatatctca

SEQ ID NO: 50127 - DNA, 20 bp, Artificial Sequence
  Description of Artificial Sequence: Synthetic oligonucleotide
  Target: ATXN1; (-) strand; PAM type: NRG; PAM sequence: GAG
gaagtgggaatgaatatgaa

SEQ ID NO: 50128 - DNA, 20 bp, Artificial Sequence
  Description of Artificial Sequence: Synthetic oligonucleotide
  Target: ATXN1; (-) strand; PAM type: NRG; PAM sequence: AAG
ctgaagtgggaatgaatatg

SEQ ID NO: 50129 - DNA, 20 bp, Artificial Sequence
  Description of Artificial Sequence: Synthetic oligonucleotide
  Target: ATXN1; (-) strand; PAM type: NRG; PAM sequence: GGG
gtgttaggctgaactgaagt

SEQ ID NO: 50130 - DNA, 20 bp, Artificial Sequence
  Description of Artificial Sequence: Synthetic oligonucleotide
  Target: ATXN1; (-) strand; PAM type: NRG; PAM sequence: TGG
agtgttaggctgaactgaag

SEQ ID NO: 50131 - DNA, 20 bp, Artificial Sequence
  Description of Artificial Sequence: Synthetic oligonucleotide
  Target: ATXN1; (-) strand; PAM type: NRG; PAM sequence: AAG
tgaagtgttaggctgaactg

SEQ ID NO: 50132 - DNA, 20 bp, Artificial Sequence
  Description of Artificial Sequence: Synthetic oligonucleotide
  Target: ATXN1; (-) strand; PAM type: NRG; PAM sequence: AGG
catttggtgaatgaagtgtt

SEQ ID NO: 50133 - DNA, 20 bp, Artificial Sequence
  Description of Artificial Sequence: Synthetic oligonucleotide
  Target: ATXN1; (-) strand; PAM type: NRG; PAM sequence: TAG
tcatttggtgaatgaagtgt

SEQ ID NO: 50134 - DNA, 20 bp, Artificial Sequence
  Description of Artificial Sequence: Synthetic oligonucleotide
  Target: ATXN1; (-) strand; PAM type: NRG; PAM sequence: AAG
gatcactcatttggtgaatg

SEQ ID NO: 50135 - DNA, 20 bp, Artificial Sequence
  Description of Artificial Sequence: Synthetic oligonucleotide
  Target: ATXN1; (-) strand; PAM type: NRG; PAM sequence: TGG
gcagttggtgatcactcatt

SEQ ID NO: 50136 - DNA, 20 bp, Artificial Sequence
  Description of Artificial Sequence: Synthetic oligonucleotide
  Target: ATXN1; (-) strand; PAM type: NRG; PAM sequence: TGG
tctgatgcatagtaggcagt

SEQ ID NO: 50137 - DNA, 20 bp, Artificial Sequence
  Description of Artificial Sequence: Synthetic oligonucleotide
  Target: ATXN1; (-) strand; PAM type: NRG; PAM sequence: CAG
tatgtctgatgcatagtagg

SEQ ID NO: 50138 - DNA, 20 bp, Artificial Sequence
  Description of Artificial Sequence: Synthetic oligonucleotide
  Target: ATXN1; (-) strand; PAM type: NRG; PAM sequence: AGG
ttatatgtctgatgcatagt

SEQ ID NO: 50139 - DNA, 20 bp, Artificial Sequence
  Description of Artificial Sequence: Synthetic oligonucleotide
  Target: ATXN1; (-) strand; PAM type: NRG; PAM sequence: TAG
tttatatgtctgatgcatag

SEQ ID NO: 50140 - DNA, 20 bp, Artificial Sequence
  Description of Artificial Sequence: Synthetic oligonucleotide
  Target: ATXN1; (-) strand; PAM type: NRG; PAM sequence: TAG
tgttttatatgtctgatgca

SEQ ID NO: 50141 - DNA, 20 bp, Artificial Sequence
  Description of Artificial Sequence: Synthetic oligonucleotide
  Target: ATXN1; (-) strand; PAM type: NRG; PAM sequence: TAG
agaacaggaactgtgtcttt

SEQ ID NO: 50142 - DNA, 20 bp, Artificial Sequence
  Description of Artificial Sequence: Synthetic oligonucleotide
  Target: ATXN1; (-) strand; PAM type: NRG; PAM sequence: AGG
caatggagctccttgagaac

SEQ ID NO: 50143 - DNA, 20 bp, Artificial Sequence
  Description of Artificial Sequence: Synthetic oligonucleotide
  Target: ATXN1; (-) strand; PAM type: NRG; PAM sequence: CAG
tcaatggagctccttgagaa

SEQ ID NO: 50144 - DNA, 20 bp, Artificial Sequence
  Description of Artificial Sequence: Synthetic oligonucleotide
  Target: ATXN1; (-) strand; PAM type: NRG; PAM sequence: GAG
ccatatcaatggagctcctt

SEQ ID NO: 50145 - DNA, 20 bp, Artificial Sequence
  Description of Artificial Sequence: Synthetic oligonucleotide
  Target: ATXN1; (-) strand; PAM type: NRG; PAM sequence: GAG
aaatgccaaccatatcaatg

SEQ ID NO: 50146 - DNA, 20 bp, Artificial Sequence
  Description of Artificial Sequence: Synthetic oligonucleotide
  Target: ATXN1; (-) strand; PAM type: NRG; PAM sequence: TGG
acaaatgccaaccatatcaa

SEQ ID NO: 50147 - DNA, 20 bp, Artificial Sequence
  Description of Artificial Sequence: Synthetic oligonucleotide
  Target: ATXN1; (-) strand; PAM type: NRG; PAM sequence: GGG
tttgacatgagatttgggtg

SEQ ID NO: 50148 - DNA, 20 bp, Artificial Sequence
  Description of Artificial Sequence: Synthetic oligonucleotide
  Target: ATXN1; (-) strand; PAM type: NRG; PAM sequence: GGG
atttgacatgagatttgggt

SEQ ID NO: 50149 - DNA, 20 bp, Artificial Sequence
  Description of Artificial Sequence: Synthetic oligonucleotide
  Target: ATXN1; (-) strand; PAM type: NRG; PAM sequence: TGG
aatttgacatgagatttggg

SEQ ID NO: 50150 - DNA, 20 bp, Artificial Sequence
  Description of Artificial Sequence: Synthetic oligonucleotide
  Target: ATXN1; (-) strand; PAM type: NRG; PAM sequence: GGG
tacaatttgacatgagattt

SEQ ID NO: 50151 - DNA, 20 bp, Artificial Sequence
  Description of Artificial Sequence: Synthetic oligonucleotide
  Target: ATXN1; (-) strand; PAM type: NRG; PAM sequence: TGG
ttacaatttgacatgagatt

SEQ ID NO: 50152 - DNA, 20 bp, Artificial Sequence
  Description of Artificial Sequence: Synthetic oligonucleotide
  Target: ATXN1; (-) strand; PAM type: NRG; PAM sequence: GAG
tggggattacaatttgacat

SEQ ID NO: 50153 - DNA, 20 bp, Artificial Sequence
  Description of Artificial Sequence: Synthetic oligonucleotide
  Target: ATXN1; (-) strand; PAM type: NRG; PAM sequence: GGG
ggcccttcctccaaacactg

SEQ ID NO: 50154 - DNA, 20 bp, Artificial Sequence
  Description of Artificial Sequence: Synthetic oligonucleotide
  Target: ATXN1; (-) strand; PAM type: NRG; PAM sequence: GGG
aggcccttcctccaaacact

SEQ ID NO: 50155 - DNA, 20 bp, Artificial Sequence
  Description of Artificial Sequence: Synthetic oligonucleotide
  Target: ATXN1; (-) strand; PAM type: NRG; PAM sequence: TGG
caggcccttcctccaaacac

SEQ ID NO: 50156 - DNA, 20 bp, Artificial Sequence
  Description of Artificial Sequence: Synthetic oligonucleotide
  Target: ATXN1; (-) strand; PAM type: NRG; PAM sequence: AGG
tgatccagtcatctcccacc

SEQ ID NO: 50157 - DNA, 20 bp, Artificial Sequence
  Description of Artificial Sequence: Synthetic oligonucleotide
  Target: ATXN1; (-) strand; PAM type: NRG; PAM sequence: CAG
gtgatccagtcatctcccac

SEQ ID NO: 50158 - DNA, 20 bp, Artificial Sequence
  Description of Artificial Sequence: Synthetic oligonucleotide
  Target: ATXN1; (-) strand; PAM type: NRG; PAM sequence: CAG
agaaatctaagcccgtgatc

SEQ ID NO: 50159 - DNA, 20 bp, Artificial Sequence
  Description of Artificial Sequence: Synthetic oligonucleotide
  Target: ATXN1; (-) strand; PAM type: NRG; PAM sequence: AAG
gaacagagagggagaaatct

SEQ ID NO: 50160 - DNA, 20 bp, Artificial Sequence
  Description of Artificial Sequence: Synthetic oligonucleotide
  Target: ATXN1; (-) strand; PAM type: NRG; PAM sequence: GAG
ctatcatgagaacagagagg

SEQ ID NO: 50161 - DNA, 20 bp, Artificial Sequence
  Description of Artificial Sequence: Synthetic oligonucleotide
  Target: ATXN1; (-) strand; PAM type: NRG; PAM sequence: GGG
cactatcatgagaacagaga

SEQ ID NO: 50162 - DNA, 20 bp, Artificial Sequence
  Description of Artificial Sequence: Synthetic oligonucleotide
  Target: ATXN1; (-) strand; PAM type: NRG; PAM sequence: AGG
tcactatcatgagaacagag

SEQ ID NO: 50163 - DNA, 20 bp, Artificial Sequence
  Description of Artificial Sequence: Synthetic oligonucleotide
  Target: ATXN1; (-) strand; PAM type: NRG; PAM sequence: GAG
ctcactatcatgagaacaga

SEQ ID NO: 50164 - DNA, 20 bp, Artificial Sequence
  Description of Artificial Sequence: Synthetic oligonucleotide
  Target: ATXN1; (-) strand; PAM type: NRG; PAM sequence: GAG
aactcactatcatgagaaca

SEQ ID NO: 50165 - DNA, 20 bp, Artificial Sequence
  Description of Artificial Sequence: Synthetic oligonucleotide
  Target: ATXN1; (-) strand; PAM type: NRG; PAM sequence: CAG
agaactcactatcatgagaa

SEQ ID NO: 50166 - DNA, 20 bp, Artificial Sequence
  Description of Artificial Sequence: Synthetic oligonucleotide
  Target: ATXN1; (-) strand; PAM type: NRG; PAM sequence: GAG
tcatgagaactcactatcat

SEQ ID NO: 50167 - DNA, 20 bp, Artificial Sequence
  Description of Artificial Sequence: Synthetic oligonucleotide
  Target: ATXN1; (-) strand; PAM type: NRG; PAM sequence: GAG
tttaaacaaccagatctcat

SEQ ID NO: 50168 - DNA, 20 bp, Artificial Sequence
  Description of Artificial Sequence: Synthetic oligonucleotide
  Target: ATXN1; (-) strand; PAM type: NRG; PAM sequence: CAG
gctacacacttttaaacaac

SEQ ID NO: 50169 - DNA, 20 bp, Artificial Sequence
  Description of Artificial Sequence: Synthetic oligonucleotide
  Target: ATXN1; (-) strand; PAM type: NRG; PAM sequence: AGG
gcaggaggaagggaaagggg

SEQ ID NO: 50170 - DNA, 20 bp, Artificial Sequence
  Description of Artificial Sequence: Synthetic oligonucleotide
  Target: ATXN1; (-) strand; PAM type: NRG; PAM sequence: GAG
agcaggaggaagggaaaggg

SEQ ID NO: 50171 - DNA, 20 bp, Artificial Sequence
  Description of Artificial Sequence: Synthetic oligonucleotide
  Target: ATXN1; (-) strand; PAM type: NRG; PAM sequence: GGG
ggagcaggaggaagggaaag

SEQ ID NO: 50172 - DNA, 20 bp, Artificial Sequence
  Description of Artificial Sequence: Synthetic oligonucleotide
  Target: ATXN1; (-) strand; PAM type: NRG; PAM sequence: GGG
tggagcaggaggaagggaaa

SEQ ID NO: 50173 - DNA, 20 bp, Artificial Sequence
  Description of Artificial Sequence: Synthetic oligonucleotide
  Target: ATXN1; (-) strand; PAM type: NRG; PAM sequence: AGG
ctggagcaggaggaagggaa

SEQ ID NO: 50174 - DNA, 20 bp, Artificial Sequence
  Description of Artificial Sequence: Synthetic oligonucleotide
  Target: ATXN1; (-) strand; PAM type: NRG; PAM sequence: AAG
gctggagcaggaggaaggga

SEQ ID NO: 50175 - DNA, 20 bp, Artificial Sequence
  Description of Artificial Sequence: Synthetic oligonucleotide
  Target: ATXN1; (-) strand; PAM type: NRG; PAM sequence: GGG
cgtggctggagcaggaggaa

SEQ ID NO: 50176 - DNA, 20 bp, Artificial Sequence
  Description of Artificial Sequence: Synthetic oligonucleotide
  Target: ATXN1; (-) strand; PAM type: NRG; PAM sequence: AGG
acgtggctggagcaggagga

SEQ ID NO: 50177 - DNA, 20 bp, Artificial Sequence
  Description of Artificial Sequence: Synthetic oligonucleotide
  Target: ATXN1; (-) strand; PAM type: NRG; PAM sequence: AAG
tacgtggctggagcaggagg

SEQ ID NO: 50178 - DNA, 20 bp, Artificial Sequence
  Description of Artificial Sequence: Synthetic oligonucleotide
  Target: ATXN1; (-) strand; PAM type: NRG; PAM sequence: AGG
tcctacgtggctggagcagg

SEQ ID NO: 50179 - DNA, 20 bp, Artificial Sequence
  Description of Artificial Sequence: Synthetic oligonucleotide
  Target: ATXN1; (-) strand; PAM type: NRG; PAM sequence: GAG
gtcctacgtggctggagcag

SEQ ID NO: 50180 - DNA, 20 bp, Artificial Sequence
  Description of Artificial Sequence: Synthetic oligonucleotide
  Target: ATXN1; (-) strand; PAM type: NRG; PAM sequence: AGG
acgtcctacgtggctggagc

SEQ ID NO: 50181 - DNA, 20 bp, Artificial Sequence
  Description of Artificial Sequence: Synthetic oligonucleotide
  Target: ATXN1; (-) strand; PAM type: NRG; PAM sequence: CAG
cacgtcctacgtggctggag

SEQ ID NO: 50182 - DNA, 20 bp, Artificial Sequence
  Description of Artificial Sequence: Synthetic oligonucleotide
  Target: ATXN1; (-) strand; PAM type: NRG; PAM sequence: GAG
cagcacgtcctacgtggctg

SEQ ID NO: 50183 - DNA, 20 bp, Artificial Sequence
  Description of Artificial Sequence: Synthetic oligonucleotide
  Target: ATXN1; (-) strand; PAM type: NRG; PAM sequence: TGG
gccagcacgtcctacgtggc

SEQ ID NO: 50184 - DNA, 20 bp, Artificial Sequence
  Description of Artificial Sequence: Synthetic oligonucleotide
  Target: ATXN1; (-) strand; PAM type: NRG; PAM sequence: TGG
ggaagccagcacgtcctacg

SEQ ID NO: 50185 - DNA, 20 bp, Artificial Sequence
  Description of Artificial Sequence: Synthetic oligonucleotide
  Target: ATXN1; (-) strand; PAM type: NRG; PAM sequence: CAG
gcagaaggagaaggggaagc

SEQ ID NO: 50186 - DNA, 20 bp, Artificial Sequence
  Description of Artificial Sequence: Synthetic oligonucleotide
  Target: ATXN1; (-) strand; PAM type: NRG; PAM sequence: AAG
catggcagaaggagaagggg

SEQ ID NO: 50187 - DNA, 20 bp, Artificial Sequence
  Description of Artificial Sequence: Synthetic oligonucleotide
  Target: ATXN1; (-) strand; PAM type: NRG; PAM sequence: GGG
aatcatggcagaaggagaag

SEQ ID NO: 50188 - DNA, 20 bp, Artificial Sequence
  Description of Artificial Sequence: Synthetic oligonucleotide
  Target: ATXN1; (-) strand; PAM type: NRG; PAM sequence: GGG
caatcatggcagaaggagaa

SEQ ID NO: 50189 - DNA, 20 bp, Artificial Sequence
  Description of Artificial Sequence: Synthetic oligonucleotide
  Target: ATXN1; (-) strand; PAM type: NRG; PAM sequence: AGG
acaatcatggcagaaggaga

SEQ ID NO: 50190 - DNA, 20 bp, Artificial Sequence
  Description of Artificial Sequence: Synthetic oligonucleotide
  Target: ATXN1; (-) strand; PAM type: NRG; PAM sequence: AAG
tacaatcatggcagaaggag

SEQ ID NO: 50191 - DNA, 20 bp, Artificial Sequence
  Description of Artificial Sequence: Synthetic oligonucleotide
  Target: ATXN1; (-) strand; PAM type: NRG; PAM sequence: GAG
acttacaatcatggcagaag

SEQ ID NO: 50192 - DNA, 20 bp, Artificial Sequence
  Description of Artificial Sequence: Synthetic oligonucleotide
  Target: ATXN1; (-) strand; PAM type: NRG; PAM sequence: AGG
aaacttacaatcatggcaga

SEQ ID NO: 50193 - DNA, 20 bp, Artificial Sequence
  Description of Artificial Sequence: Synthetic oligonucleotide
  Target: ATXN1; (-) strand; PAM type: NRG; PAM sequence: AAG
gaaacttacaatcatggcag

SEQ ID NO: 50194 - DNA, 20 bp, Artificial Sequence
  Description of Artificial Sequence: Synthetic oligonucleotide
  Target: ATXN1; (-) strand; PAM type: NRG; PAM sequence: CAG
caggaaacttacaatcatgg

SEQ ID NO: 50195 - DNA, 20 bp, Artificial Sequence
  Description of Artificial Sequence: Synthetic oligonucleotide
  Target: ATXN1; (-) strand; PAM type: NRG; PAM sequence: TGG
cctcaggaaacttacaatca

SEQ ID NO: 50196 - DNA, 20 bp, Artificial Sequence
  Description of Artificial Sequence: Synthetic oligonucleotide
  Target: ATXN1; (-) strand; PAM type: NRG; PAM sequence: AGG
aacatggctggggaggcctc

SEQ ID NO: 50197 - DNA, 20 bp, Artificial Sequence
  Description of Artificial Sequence: Synthetic oligonucleotide
  Target: ATXN1; (-) strand; PAM type: NRG; PAM sequence: CAG
aaacatggctggggaggcct

SEQ ID NO: 50198 - DNA, 20 bp, Artificial Sequence
  Description of Artificial Sequence: Synthetic oligonucleotide
  Target: ATXN1; (-) strand; PAM type: NRG; PAM sequence: AGG
tacaggaaacatggctgggg

SEQ ID NO: 50199 - DNA, 20 bp, Artificial Sequence
  Description of Artificial Sequence: Synthetic oligonucleotide
  Target: ATXN1; (-) strand; PAM type: NRG; PAM sequence: GAG
gtacaggaaacatggctggg

SEQ ID NO: 50200 - DNA, 20 bp, Artificial Sequence
  Description of Artificial Sequence: Synthetic oligonucleotide
  Target: ATXN1; (-) strand; PAM type: NRG; PAM sequence: GGG
ctgtacaggaaacatggctg

SEQ ID NO: 50201 - DNA, 20 bp, Artificial Sequence
  Description of Artificial Sequence: Synthetic oligonucleotide
  Target: ATXN1; (-) strand; PAM type: NRG; PAM sequence: GGG
gctgtacaggaaacatggct

SEQ ID NO: 50202 - DNA, 20 bp, Artificial Sequence
  Description of Artificial Sequence: Synthetic oligonucleotide
  Target: ATXN1; (-) strand; PAM type: NRG; PAM sequence: TGG
ggctgtacaggaaacatggc

SEQ ID NO: 50203 - DNA, 20 bp, Artificial Sequence
  Description of Artificial Sequence: Synthetic oligonucleotide
  Target: ATXN1; (-) strand; PAM type: NRG; PAM sequence: TGG
cacaggctgtacaggaaaca

SEQ ID NO: 50204 - DNA, 20 bp, Artificial Sequence
  Description of Artificial Sequence: Synthetic oligonucleotide
  Target: ATXN1; (-) strand; PAM type: NRG; PAM sequence: AGG
catgtttccacaggctgtac

SEQ ID NO: 50205 - DNA, 20 bp, Artificial Sequence
  Description of Artificial Sequence: Synthetic oligonucleotide
  Target: ATXN1; (-) strand; PAM type: NRG; PAM sequence: CAG
tcatgtttccacaggctgta

SEQ ID NO: 50206 - DNA, 20 bp, Artificial Sequence
  Description of Artificial Sequence: Synthetic oligonucleotide
  Target: ATXN1; (-) strand; PAM type: NRG; PAM sequence: AGG
taattggctcatgtttccac

SEQ ID NO: 50207 - DNA, 20 bp, Artificial Sequence
  Description of Artificial Sequence: Synthetic oligonucleotide
  Target: ATXN1; (-) strand; PAM type: NRG; PAM sequence: CAG
ttaattggctcatgtttcca

SEQ ID NO: 50208 - DNA, 20 bp, Artificial Sequence
  Description of Artificial Sequence: Synthetic oligonucleotide
  Target: ATXN1; (-) strand; PAM type: NRG; PAM sequence: TGG
gtaaagaaaagaggtttaat

SEQ ID NO: 50209 - DNA, 20 bp, Artificial Sequence
  Description of Artificial Sequence: Synthetic oligonucleotide
  Target: ATXN1; (-) strand; PAM type: NRG; PAM sequence: AGG
ggataatgtgtaaagaaaag

SEQ ID NO: 50210 - DNA, 20 bp, Artificial Sequence
  Description of Artificial Sequence: Synthetic oligonucleotide
  Target: ATXN1; (-) strand; PAM type: NRG; PAM sequence: GAG
tggataatgtgtaaagaaaa

SEQ ID NO: 50211 - DNA, 20 bp, Artificial Sequence
  Description of Artificial Sequence: Synthetic oligonucleotide
  Target: ATXN1; (-) strand; PAM type: NRG; PAM sequence: AAG
actggataatgtgtaaagaa

SEQ ID NO: 50212 - DNA, 20 bp, Artificial Sequence
  Description of Artificial Sequence: Synthetic oligonucleotide
  Target: ATXN1; (-) strand; PAM type: NRG; PAM sequence: AAG
ctgagactggataatgtgta

SEQ ID NO: 50213 - DNA, 20 bp, Artificial Sequence
  Description of Artificial Sequence: Synthetic oligonucleotide
  Target: ATXN1; (-) strand; PAM type: NRG; PAM sequence: TGG
ctatgagaactacctgagac

SEQ ID NO: 50214 - DNA, 20 bp, Artificial Sequence
  Description of Artificial Sequence: Synthetic oligonucleotide
  Target: ATXN1; (-) strand; PAM type: NRG; PAM sequence: GAG
cattgctatgagaactacct

SEQ ID NO: 50215 - DNA, 20 bp, Artificial Sequence
  Description of Artificial Sequence: Synthetic oligonucleotide
  Target: ATXN1; (-) strand; PAM type: NRG; PAM sequence: GAG
gtctcttctcacattgctat

SEQ ID NO: 50216 - DNA, 20 bp, Artificial Sequence
  Description of Artificial Sequence: Synthetic oligonucleotide
  Target: ATXN1; (-) strand; PAM type: NRG; PAM sequence: TAG
cacactggatacagatgtat

SEQ ID NO: 50217 - DNA, 20 bp, Artificial Sequence
  Description of Artificial Sequence: Synthetic oligonucleotide
  Target: ATXN1; (-) strand; PAM type: NRG; PAM sequence: CAG
ccatctctgcacactggata

SEQ ID NO: 50218 - DNA, 20 bp, Artificial Sequence
  Description of Artificial Sequence: Synthetic oligonucleotide
  Target: ATXN1; (-) strand; PAM type: NRG; PAM sequence: TGG
tcttgaccatctctgcacac

SEQ ID NO: 50219 - DNA, 20 bp, Artificial Sequence
  Description of Artificial Sequence: Synthetic oligonucleotide
  Target: ATXN1; (-) strand; PAM type: NRG; PAM sequence: TAG
aaactcatatgtaagatttt

SEQ ID NO: 50220 - DNA, 20 bp, Artificial Sequence
  Description of Artificial Sequence: Synthetic oligonucleotide
  Target: ATXN1; (-) strand; PAM type: NRG; PAM sequence: AAG
cacccatgaaactcatatgt

SEQ ID NO: 50221 - DNA, 20 bp, Artificial Sequence
  Description of Artificial Sequence: Synthetic oligonucleotide
  Target: ATXN1; (-) strand; PAM type: NRG; PAM sequence: GAG
ttttccctcctggtctcact

SEQ ID NO: 50222 - DNA, 20 bp, Artificial Sequence
  Description of Artificial Sequence: Synthetic oligonucleotide
  Target: ATXN1; (-) strand; PAM type: NRG; PAM sequence: TGG
ccaccctaacttttccctcc

SEQ ID NO: 50223 - DNA, 20 bp, Artificial Sequence
  Description of Artificial Sequence: Synthetic oligonucleotide
  Target: ATXN1; (-) strand; PAM type: NRG; PAM sequence: GAG
accctgccatcagctccaag

SEQ ID NO: 50224 - DNA, 20 bp, Artificial Sequence
  Description of Artificial Sequence: Synthetic oligonucleotide
  Target: ATXN1; (-) strand; PAM type: NRG; PAM sequence: AGG
caaccctgccatcagctcca

SEQ ID NO: 50225 - DNA, 20 bp, Artificial Sequence
  Description of Artificial Sequence: Synthetic oligonucleotide
  Target: ATXN1; (-) strand; PAM type: NRG; PAM sequence: AAG
tcaaccctgccatcagctcc

SEQ ID NO: 50226 - DNA, 20 bp, Artificial Sequence
  Description of Artificial Sequence: Synthetic oligonucleotide
  Target: ATXN1; (-) strand; PAM type: NRG; PAM sequence: CAG
tcaaaactcaaccctgccat

SEQ ID NO: 50227 - DNA, 20 bp, Artificial Sequence
  Description of Artificial Sequence: Synthetic oligonucleotide
  Target: ATXN1; (-) strand; PAM type: NRG; PAM sequence: CAG
gttccctctcacatcacatg

SEQ ID NO: 50228 - DNA, 20 bp, Artificial Sequence
  Description of Artificial Sequence: Synthetic oligonucleotide
  Target: ATXN1; (-) strand; PAM type: NRG; PAM sequence: TAG
catgagctccctcctctgtc

SEQ ID NO: 50229 - DNA, 20 bp, Artificial Sequence
  Description of Artificial Sequence: Synthetic oligonucleotide
  Target: ATXN1; (-) strand; PAM type: NRG; PAM sequence: GAG
ccccttatgtgactctgcat

SEQ ID NO: 50230 - DNA, 20 bp, Artificial Sequence
  Description of Artificial Sequence: Synthetic oligonucleotide
  Target: ATXN1; (-) strand; PAM type: NRG; PAM sequence: TGG
tacttgtgcttccctgaatg

SEQ ID NO: 50231 - DNA, 20 bp, Artificial Sequence
  Description of Artificial Sequence: Synthetic oligonucleotide
  Target: ATXN1; (-) strand; PAM type: NRG; PAM sequence: TGG
ttacctccttcctcccctcc

SEQ ID NO: 50232 - DNA, 20 bp, Artificial Sequence
  Description of Artificial Sequence: Synthetic oligonucleotide
  Target: ATXN1; (-) strand; PAM type: NRG; PAM sequence: GGG
gagatatcttggggagagaa

SEQ ID NO: 50233 - DNA, 20 bp, Artificial Sequence
  Description of Artificial Sequence: Synthetic oligonucleotide
  Target: ATXN1; (-) strand; PAM type: NRG; PAM sequence: AGG
agagatatcttggggagaga

SEQ ID NO: 50234 - DNA, 20 bp, Artificial Sequence
  Description of Artificial Sequence: Synthetic oligonucleotide
  Target: ATXN1; (-) strand; PAM type: NRG; PAM sequence: AAG
aagagatatcttggggagag

SEQ ID NO: 50235 - DNA, 20 bp, Artificial Sequence
  Description of Artificial Sequence: Synthetic oligonucleotide
  Target: ATXN1; (-) strand; PAM type: NRG; PAM sequence: GAG
ttcaagagatatcttgggga

SEQ ID NO: 50236 - DNA, 20 bp, Artificial Sequence
  Description of Artificial Sequence: Synthetic oligonucleotide
  Target: ATXN1; (-) strand; PAM type: NRG; PAM sequence: GAG
ccttcaagagatatcttggg

SEQ ID NO: 50237 - DNA, 20 bp, Artificial Sequence
  Description of Artificial Sequence: Synthetic oligonucleotide
  Target: ATXN1; (-) strand; PAM type: NRG; PAM sequence: GGG
taccttcaagagatatcttg

SEQ ID NO: 50238 - DNA, 20 bp, Artificial Sequence
  Description of Artificial Sequence: Synthetic oligonucleotide
  Target: ATXN1; (-) strand; PAM type: NRG; PAM sequence: GGG
ataccttcaagagatatctt

SEQ ID NO: 50239 - DNA, 20 bp, Artificial Sequence
  Description of Artificial Sequence: Synthetic oligonucleotide
  Target: ATXN1; (-) strand; PAM type: NRG; PAM sequence: TGG
cataccttcaagagatatct

SEQ ID NO: 50240 - DNA, 20 bp, Artificial Sequence
  Description of Artificial Sequence: Synthetic oligonucleotide
  Target: ATXN1; (-) strand; PAM type: NRG; PAM sequence: GAG
gagattctccataccttcaa

SEQ ID NO: 50241 - DNA, 20 bp, Artificial Sequence
  Description of Artificial Sequence: Synthetic oligonucleotide
  Target: ATXN1; (-) strand; PAM type: NRG; PAM sequence: AAG
ctgagattctccataccttc

SEQ ID NO: 50242 - DNA, 20 bp, Artificial Sequence
  Description of Artificial Sequence: Synthetic oligonucleotide
  Target: ATXN1; (-) strand; PAM type: NRG; PAM sequence: GAG
tgttcctgcctaacccttct

SEQ ID NO: 50243 - DNA, 20 bp, Artificial Sequence
  Description of Artificial Sequence: Synthetic oligonucleotide
  Target: ATXN1; (-) strand; PAM type: NRG; PAM sequence: GAG
catcttctactctatgacca

SEQ ID NO: 50244 - DNA, 20 bp, Artificial Sequence
  Description of Artificial Sequence: Synthetic oligonucleotide
  Target: ATXN1; (-) strand; PAM type: NRG; PAM sequence: CAG
tccatcttctactctatgac

SEQ ID NO: 50245 - DNA, 20 bp, Artificial Sequence
  Description of Artificial Sequence: Synthetic oligonucleotide
  Target: ATXN1; (-) strand; PAM type: NRG; PAM sequence: TGG
tttgccttgcctgtagaacc

SEQ ID NO: 50246 - DNA, 20 bp, Artificial Sequence
  Description of Artificial Sequence: Synthetic oligonucleotide
  Target: ATXN1; (-) strand; PAM type: NRG; PAM sequence: TAG
ccgactgtttgccttgcctg

SEQ ID NO: 50247 - DNA, 20 bp, Artificial Sequence
  Description of Artificial Sequence: Synthetic oligonucleotide
  Target: ATXN1; (-) strand; PAM type: NRG; PAM sequence: AAG
cagctcagtggcattgcagc

SEQ ID NO: 50248 - DNA, 20 bp, Artificial Sequence
  Description of Artificial Sequence: Synthetic oligonucleotide
  Target: ATXN1; (-) strand; PAM type: NRG; PAM sequence: CAG
atgacagctcagtggcattg

SEQ ID NO: 50249 - DNA, 20 bp, Artificial Sequence
  Description of Artificial Sequence: Synthetic oligonucleotide
  Target: ATXN1; (-) strand; PAM type: NRG; PAM sequence: TGG
caaacctgatgacagctcag

SEQ ID NO: 50250 - DNA, 20 bp, Artificial Sequence
  Description of Artificial Sequence: Synthetic oligonucleotide
  Target: ATXN1; (-) strand; PAM type: NRG; PAM sequence: CAG
ggccaaacctgatgacagct

SEQ ID NO: 50251 - DNA, 20 bp, Artificial Sequence
  Description of Artificial Sequence: Synthetic oligonucleotide
  Target: ATXN1; (-) strand; PAM type: NRG; PAM sequence: CAG
cagcaggccaaacctgatga

SEQ ID NO: 50252 - DNA, 20 bp, Artificial Sequence
  Description of Artificial Sequence: Synthetic oligonucleotide
  Target: ATXN1; (-) strand; PAM type: NRG; PAM sequence: AGG
atgcttactgcccctgcagc

SEQ ID NO: 50253 - DNA, 20 bp, Artificial Sequence
  Description of Artificial Sequence: Synthetic oligonucleotide
  Target: ATXN1; (-) strand; PAM type: NRG; PAM sequence: CAG
catgcttactgcccctgcag

SEQ ID NO: 50254 - DNA, 20 bp, Artificial Sequence
  Description of Artificial Sequence: Synthetic oligonucleotide
  Target: ATXN1; (-) strand; PAM type: NRG; PAM sequence: CAG
ctccatgcttactgcccctg

SEQ ID NO: 50255 - DNA, 20 bp, Artificial Sequence
  Description of Artificial Sequence: Synthetic oligonucleotide
  Target: ATXN1; (-) strand; PAM type: NRG; PAM sequence: GGG
ccttggtgctgagtctgcct

SEQ ID NO: 50256 - DNA, 20 bp, Artificial Sequence
  Description of Artificial Sequence: Synthetic oligonucleotide
  Target: ATXN1; (-) strand; PAM type: NRG; PAM sequence: TGG
gccttggtgctgagtctgcc

SEQ ID NO: 50257 - DNA, 20 bp, Artificial Sequence
  Description of Artificial Sequence: Synthetic oligonucleotide
  Target: ATXN1; (-) strand; PAM type: NRG; PAM sequence: GAG
cattcagcagccttggtgct

SEQ ID NO: 50258 - DNA, 20 bp, Artificial Sequence
  Description of Artificial Sequence: Synthetic oligonucleotide
  Target: ATXN1; (-) strand; PAM type: NRG; PAM sequence: TGG
gcccagccattcagcagcct

SEQ ID NO: 50259 - DNA, 20 bp, Artificial Sequence
  Description of Artificial Sequence: Synthetic oligonucleotide
  Target: ATXN1; (-) strand; PAM type: NRG; PAM sequence: CAG
gcccctgcccagccattcag

SEQ ID NO: 50260 - DNA, 20 bp, Artificial Sequence
  Description of Artificial Sequence: Synthetic oligonucleotide
  Target: ATXN1; (-) strand; PAM type: NRG; PAM sequence: CAG
tgtgcccctgcccagccatt

SEQ ID NO: 50261 - DNA, 20 bp, Artificial Sequence
  Description of Artificial Sequence: Synthetic oligonucleotide
  Target: ATXN1; (-) strand; PAM type: NRG; PAM sequence: CAG
ttcctccatgtgcccctgcc

SEQ ID NO: 50262 - DNA, 20 bp, Artificial Sequence
  Description of Artificial Sequence: Synthetic oligonucleotide
  Target: ATXN1; (-) strand; PAM type: NRG; PAM sequence: AAG
aatggcactagccaagccag

SEQ ID NO: 50263 - DNA, 20 bp, Artificial Sequence
  Description of Artificial Sequence: Synthetic oligonucleotide
  Target: ATXN1; (-) strand; PAM type: NRG; PAM sequence: CAG
gcaaatggcactagccaagc

SEQ ID NO: 50264 - DNA, 20 bp, Artificial Sequence
  Description of Artificial Sequence: Synthetic oligonucleotide
  Target: ATXN1; (-) strand; PAM type: NRG; PAM sequence: AAG
ttgtgcaaatggcactagcc

SEQ ID NO: 50265 - DNA, 20 bp, Artificial Sequence
  Description of Artificial Sequence: Synthetic oligonucleotide
  Target: ATXN1; (-) strand; PAM type: NRG; PAM sequence: TAG
atctcttgtgcaaatggcac

SEQ ID NO: 50266 - DNA, 20 bp, Artificial Sequence
  Description of Artificial Sequence: Synthetic oligonucleotide
  Target: ATXN1; (-) strand; PAM type: NRG; PAM sequence: TGG
tcccatatctcttgtgcaaa

SEQ ID NO: 50267 - DNA, 20 bp, Artificial Sequence
  Description of Artificial Sequence: Synthetic oligonucleotide
  Target: ATXN1; (-) strand; PAM type: NRG; PAM sequence: TAG
gcactgagttagaaaggagc

SEQ ID NO: 50268 - DNA, 20 bp, Artificial Sequence
  Description of Artificial Sequence: Synthetic oligonucleotide
  Target: ATXN1; (-) strand; PAM type: NRG; PAM sequence: GAG
taaggcactgagttagaaag

SEQ ID NO: 50269 - DNA, 20 bp, Artificial Sequence
  Description of Artificial Sequence: Synthetic oligonucleotide
  Target: ATXN1; (-) strand; PAM type: NRG; PAM sequence: AGG
attaaggcactgagttagaa

SEQ ID NO: 50270 - DNA, 20 bp, Artificial Sequence
  Description of Artificial Sequence: Synthetic oligonucleotide
  Target: ATXN1; (-) strand; PAM type: NRG; PAM sequence: AAG
aattaaggcactgagttaga

SEQ ID NO: 50271 - DNA, 20 bp, Artificial Sequence
  Description of Artificial Sequence: Synthetic oligonucleotide
  Target: ATXN1; (-) strand; PAM type: NRG; PAM sequence: TAG
gagaaattaaggcactgagt

SEQ ID NO: 50272 - DNA, 20 bp, Artificial Sequence
  Description of Artificial Sequence: Synthetic oligonucleotide
  Target: ATXN1; (-) strand; PAM type: NRG; PAM sequence: GAG
aaacgagaaattaaggcact

SEQ ID NO: 50273 - DNA, 20 bp, Artificial Sequence
  Description of Artificial Sequence: Synthetic oligonucleotide
  Target: ATXN1; (-) strand; PAM type: NRG; PAM sequence: AGG
agaagtaaaacgagaaatta

SEQ ID NO: 50274 - DNA, 20 bp, Artificial Sequence
  Description of Artificial Sequence: Synthetic oligonucleotide
  Target: ATXN1; (-) strand; PAM type: NRG; PAM sequence: AAG
tagaagtaaaacgagaaatt

SEQ ID NO: 50275 - DNA, 20 bp, Artificial Sequence
  Description of Artificial Sequence: Synthetic oligonucleotide
  Target: ATXN1; (-) strand; PAM type: NRG; PAM sequence: GAG
ctttatcctagaagtaaaac

SEQ ID NO: 50276 - DNA, 20 bp, Artificial Sequence
  Description of Artificial Sequence: Synthetic oligonucleotide
  Target: ATXN1; (-) strand; PAM type: NRG; PAM sequence: AAG
gattttaaactttatcctag

SEQ ID NO: 50277 - DNA, 20 bp, Artificial Sequence
  Description of Artificial Sequence: Synthetic oligonucleotide
  Target: ATXN1; (-) strand; PAM type: NRG; PAM sequence: TAG
agagattttaaactttatcc

SEQ ID NO: 50278 - DNA, 20 bp, Artificial Sequence
  Description of Artificial Sequence: Synthetic oligonucleotide
  Target: ATXN1; (-) strand; PAM type: NRG; PAM sequence: GAG
gaactttcagcgtcaagtta

SEQ ID NO: 50279 - DNA, 20 bp, Artificial Sequence
  Description of Artificial Sequence: Synthetic oligonucleotide
  Target: ATXN1; (-) strand; PAM type: NRG; PAM sequence: TAG
gagaactttcagcgtcaagt

SEQ ID NO: 50280 - DNA, 20 bp, Artificial Sequence
  Description of Artificial Sequence: Synthetic oligonucleotide
  Target: ATXN1; (-) strand; PAM type: NRG; PAM sequence: AAG
tgtagagaactttcagcgtc

SEQ ID NO: 50281 - DNA, 20 bp, Artificial Sequence
  Description of Artificial Sequence: Synthetic oligonucleotide
  Target: ATXN1; (-) strand; PAM type: NRG; PAM sequence: CAG
gggggattgtagagaacttt

SEQ ID NO: 50282 - DNA, 20 bp, Artificial Sequence
  Description of Artificial Sequence: Synthetic oligonucleotide
  Target: ATXN1; (-) strand; PAM type: NRG; PAM sequence: GAG
ctgcatgtagggggattgta

SEQ ID NO: 50283 - DNA, 20 bp, Artificial Sequence
  Description of Artificial Sequence: Synthetic oligonucleotide
  Target: ATXN1; (-) strand; PAM type: NRG; PAM sequence: TAG
tactgcatgtagggggattg

SEQ ID NO: 50284 - DNA, 20 bp, Artificial Sequence
  Description of Artificial Sequence: Synthetic oligonucleotide
  Target: ATXN1; (-) strand; PAM type: NRG; PAM sequence: GGG
gagtacctactgcatgtagg

SEQ ID NO: 50285 - DNA, 20 bp, Artificial Sequence
  Description of Artificial Sequence: Synthetic oligonucleotide
  Target: ATXN1; (-) strand; PAM type: NRG; PAM sequence: GGG
cgagtacctactgcatgtag

SEQ ID NO: 50286 - DNA, 20 bp, Artificial Sequence
  Description of Artificial Sequence: Synthetic oligonucleotide
  Target: ATXN1; (-) strand; PAM type: NRG; PAM sequence: GGG
tcgagtacctactgcatgta

SEQ ID NO: 50287 - DNA, 20 bp, Artificial Sequence
  Description of Artificial Sequence: Synthetic oligonucleotide
  Target: ATXN1; (-) strand; PAM type: NRG; PAM sequence: AGG
atcgagtacctactgcatgt

SEQ ID NO: 50288 - DNA, 20 bp, Artificial Sequence
  Description of Artificial Sequence: Synthetic oligonucleotide
  Target: ATXN1; (-) strand; PAM type: NRG; PAM sequence: TAG
tatcgagtacctactgcatg

SEQ ID NO: 50289 - DNA, 20 bp, Artificial Sequence
  Description of Artificial Sequence: Synthetic oligonucleotide
  Target: ATXN1; (-) strand; PAM type: NRG; PAM sequence: GAG
tgaatcaactggtatgtatc

SEQ ID NO: 50290 - DNA, 20 bp, Artificial Sequence
  Description of Artificial Sequence: Synthetic oligonucleotide
  Target: ATXN1; (-) strand; PAM type: NRG; PAM sequence: TGG
gtttcagttgttgaatcaac

SEQ ID NO: 50291 - DNA, 20 bp, Artificial Sequence
  Description of Artificial Sequence: Synthetic oligonucleotide
  Target: ATXN1; (-) strand; PAM type: NRG; PAM sequence: CAG
ttatttttgtgtgtttgttt

SEQ ID NO: 50292 - DNA, 20 bp, Artificial Sequence
  Description of Artificial Sequence: Synthetic oligonucleotide
  Target: ATXN1; (-) strand; PAM type: NRG; PAM sequence: AAG
attgatatgttagatagaga

SEQ ID NO: 50293 - DNA, 20 bp, Artificial Sequence
  Description of Artificial Sequence: Synthetic oligonucleotide
  Target: ATXN1; (-) strand; PAM type: NRG; PAM sequence: GAG
aaatattgatatgttagata

SEQ ID NO: 50294 - DNA, 20 bp, Artificial Sequence
  Description of Artificial Sequence: Synthetic oligonucleotide
  Target: ATXN1; (-) strand; PAM type: NRG; PAM sequence: TAG
aaaaatattgatatgttaga

SEQ ID NO: 50295 - DNA, 20 bp, Artificial Sequence
  Description of Artificial Sequence: Synthetic oligonucleotide
  Target: ATXN1; (-) strand; PAM type: NRG; PAM sequence: TAG
tcagaaaaatattgatatgt

SEQ ID NO: 50296 - DNA, 20 bp, Artificial Sequence
  Description of Artificial Sequence: Synthetic oligonucleotide
  Target: ATXN1; (-) strand; PAM type: NRG; PAM sequence: CAG
tagtaagccaaacctgtaat

SEQ ID NO: 50297 - DNA, 20 bp, Artificial Sequence
  Description of Artificial Sequence: Synthetic oligonucleotide
  Target: ATXN1; (-) strand; PAM type: NRG; PAM sequence: AAG
tttcacaaaggcaaagtagt

SEQ ID NO: 50298 - DNA, 20 bp, Artificial Sequence
  Description of Artificial Sequence: Synthetic oligonucleotide
  Target: ATXN1; (-) strand; PAM type: NRG; PAM sequence: TAG
cttctttcacaaaggcaaag

SEQ ID NO: 50299 - DNA, 20 bp, Artificial Sequence
  Description of Artificial Sequence: Synthetic oligonucleotide
  Target: ATXN1; (-) strand; PAM type: NRG; PAM sequence: AAG
tctcttctttcacaaaggca

SEQ ID NO: 50300 - DNA, 20 bp, Artificial Sequence
  Description of Artificial Sequence: Synthetic oligonucleotide
  Target: ATXN1; (-) strand; PAM type: NRG; PAM sequence: AGG
ctatttctcttctttcacaa

SEQ ID NO: 50301 - DNA, 20 bp, Artificial Sequence
  Description of Artificial Sequence: Synthetic oligonucleotide
  Target: ATXN1; (-) strand; PAM type: NRG; PAM sequence: AAG
gctatttctcttctttcaca

SEQ ID NO: 50302 - DNA, 20 bp, Artificial Sequence
  Description of Artificial Sequence: Synthetic oligonucleotide
  Target: ATXN1; (-) strand; PAM type: NRG; PAM sequence: AAG
ttattctttgaataagttgc

SEQ ID NO: 50303 - DNA, 20 bp, Artificial Sequence
  Description of Artificial Sequence: Synthetic oligonucleotide
  Target: ATXN1; (-) strand; PAM type: NRG; PAM sequence: AAG
acttatcttattctttgaat

SEQ ID NO: 50304 - DNA, 20 bp, Artificial Sequence
  Description of Artificial Sequence: Synthetic oligonucleotide
  Target: ATXN1; (-) strand; PAM type: NRG; PAM sequence: CAG
gtttgagattagcacgttat

SEQ ID NO: 50305 - DNA, 20 bp, Artificial Sequence
  Description of Artificial Sequence: Synthetic oligonucleotide
  Target: ATXN1; (-) strand; PAM type: NRG; PAM sequence: TAG
agagaaaatgtgtttgagat

SEQ ID NO: 50306 - DNA, 20 bp, Artificial Sequence
  Description of Artificial Sequence: Synthetic oligonucleotide
  Target: ATXN1; (-) strand; PAM type: NRG; PAM sequence: GAG
tcaggagagaaaatgtgttt

SEQ ID NO: 50307 - DNA, 20 bp, Artificial Sequence
  Description of Artificial Sequence: Synthetic oligonucleotide
  Target: ATXN1; (-) strand; PAM type: NRG; PAM sequence: GAG
actgtagccctgtatcagga

SEQ ID NO: 50308 - DNA, 20 bp, Artificial Sequence
  Description of Artificial Sequence: Synthetic oligonucleotide
  Target: ATXN1; (-) strand; PAM type: NRG; PAM sequence: GAG
acactgtagccctgtatcag

SEQ ID NO: 50309 - DNA, 20 bp, Artificial Sequence
  Description of Artificial Sequence: Synthetic oligonucleotide
  Target: ATXN1; (-) strand; PAM type: NRG; PAM sequence: AGG
acacactgtagccctgtatc

SEQ ID NO: 50310 - DNA, 20 bp, Artificial Sequence
  Description of Artificial Sequence: Synthetic oligonucleotide
  Target: ATXN1; (-) strand; PAM type: NRG; PAM sequence: CAG
aacacactgtagccctgtat

SEQ ID NO: 50311 - DNA, 20 bp, Artificial Sequence
  Description of Artificial Sequence: Synthetic oligonucleotide
  Target: ATXN1; (-) strand; PAM type: NRG; PAM sequence: TAG
ataatcagatgaacacactg

SEQ ID NO: 50312 - DNA, 20 bp, Artificial Sequence
  Description of Artificial Sequence: Synthetic oligonucleotide
  Target: ATXN1; (-) strand; PAM type: NRG; PAM sequence: CAG
gaatgattgttggtgataat

SEQ ID NO: 50313 - DNA, 20 bp, Artificial Sequence
  Description of Artificial Sequence: Synthetic oligonucleotide
  Target: ATXN1; (-) strand; PAM type: NRG; PAM sequence: TGG
gaatgattaggaatgattgt

SEQ ID NO: 50314 - DNA, 20 bp, Artificial Sequence
  Description of Artificial Sequence: Synthetic oligonucleotide
  Target: ATXN1; (-) strand; PAM type: NRG; PAM sequence: AGG
agagtaagataggaatgatt

SEQ ID NO: 50315 - DNA, 20 bp, Artificial Sequence
  Description of Artificial Sequence: Synthetic oligonucleotide
  Target: ATXN1; (-) strand; PAM type: NRG; PAM sequence: TAG
cagagtaagataggaatgat

SEQ ID NO: 50316 - DNA, 20 bp, Artificial Sequence
  Description of Artificial Sequence: Synthetic oligonucleotide
  Target: ATXN1; (-) strand; PAM type: NRG; PAM sequence: AGG
accctaacccagagtaagat

SEQ ID NO: 50317 - DNA, 20 bp, Artificial Sequence
  Description of Artificial Sequence: Synthetic oligonucleotide
  Target: ATXN1; (-) strand; PAM type: NRG; PAM sequence: TAG
gaccctaacccagagtaaga

SEQ ID NO: 50318 - DNA, 20 bp, Artificial Sequence
  Description of Artificial Sequence: Synthetic oligonucleotide
  Target: ATXN1; (-) strand; PAM type: NRG; PAM sequence: AAG
cagagaccctaacccagagt

SEQ ID NO: 50319 - DNA, 20 bp, Artificial Sequence
  Description of Artificial Sequence: Synthetic oligonucleotide
  Target: ATXN1; (-) strand; PAM type: NRG; PAM sequence: GAG
aggacagagaccctaaccca

SEQ ID NO: 50320 - DNA, 20 bp, Artificial Sequence
  Description of Artificial Sequence: Synthetic oligonucleotide
  Target: ATXN1; (-) strand; PAM type: NRG; PAM sequence: CAG
agaggacagagaccctaacc

SEQ ID NO: 50321 - DNA, 20 bp, Artificial Sequence
  Description of Artificial Sequence: Synthetic oligonucleotide
  Target: ATXN1; (-) strand; PAM type: NRG; PAM sequence: GAG
taagggtgaaggagaggaca

SEQ ID NO: 50322 - DNA, 20 bp, Artificial Sequence
  Description of Artificial Sequence: Synthetic oligonucleotide
  Target: ATXN1; (-) strand; PAM type: NRG; PAM sequence: CAG
cttaagggtgaaggagagga

SEQ ID NO: 50323 - DNA, 20 bp, Artificial Sequence
  Description of Artificial Sequence: Synthetic oligonucleotide
  Target: ATXN1; (-) strand; PAM type: NRG; PAM sequence: AGG
tagccttaagggtgaaggag

SEQ ID NO: 50324 - DNA, 20 bp, Artificial Sequence
  Description of Artificial Sequence: Synthetic oligonucleotide
  Target: ATXN1; (-) strand; PAM type: NRG; PAM sequence: GAG
atagccttaagggtgaagga

SEQ ID NO: 50325 - DNA, 20 bp, Artificial Sequence
  Description of Artificial Sequence: Synthetic oligonucleotide
  Target: ATXN1; (-) strand; PAM type: NRG; PAM sequence: GAG
taatagccttaagggtgaag

SEQ ID NO: 50326 - DNA, 20 bp, Artificial Sequence
  Description of Artificial Sequence: Synthetic oligonucleotide
  Target: ATXN1; (-) strand; PAM type: NRG; PAM sequence: AGG
actaatagccttaagggtga

SEQ ID NO: 50327 - DNA, 20 bp, Artificial Sequence
  Description of Artificial Sequence: Synthetic oligonucleotide
  Target: ATXN1; (-) strand; PAM type: NRG; PAM sequence: AAG
gactaatagccttaagggtg

SEQ ID NO: 50328 - DNA, 20 bp, Artificial Sequence
  Description of Artificial Sequence: Synthetic oligonucleotide
  Target: ATXN1; (-) strand; PAM type: NRG; PAM sequence: GGG
gtgaagactaatagccttaa

SEQ ID NO: 50329 - DNA, 20 bp, Artificial Sequence
  Description of Artificial Sequence: Synthetic oligonucleotide
  Target: ATXN1; (-) strand; PAM type: NRG; PAM sequence: AGG
cgtgaagactaatagcctta

SEQ ID NO: 50330 - DNA, 20 bp, Artificial Sequence
  Description of Artificial Sequence: Synthetic oligonucleotide
  Target: ATXN1; (-) strand; PAM type: NRG; PAM sequence: AAG
tcgtgaagactaatagcctt

SEQ ID NO: 50331 - DNA, 20 bp, Artificial Sequence
  Description of Artificial Sequence: Synthetic oligonucleotide
  Target: ATXN1; (-) strand; PAM type: NRG; PAM sequence: TAG
ttttttatcgtgaagactaa

SEQ ID NO: 50332 - DNA, 20 bp, Artificial Sequence
  Description of Artificial Sequence: Synthetic oligonucleotide
  Target: ATXN1; (-) strand; PAM type: NRG; PAM sequence: AAG
cctagaaattttttatcgtg

SEQ ID NO: 50333 - DNA, 20 bp, Artificial Sequence
  Description of Artificial Sequence: Synthetic oligonucleotide
  Target: ATXN1; (-) strand; PAM type: NRG; PAM sequence: TAG
cccaagcatctatctctacc

SEQ ID NO: 50334 - DNA, 20 bp, Artificial Sequence
  Description of Artificial Sequence: Synthetic oligonucleotide
  Target: ATXN1; (-) strand; PAM type: NRG; PAM sequence: AAG
acttgctcttttagaacccc

SEQ ID NO: 50335 - DNA, 20 bp, Artificial Sequence
  Description of Artificial Sequence: Synthetic oligonucleotide
  Target: ATXN1; (-) strand; PAM type: NRG; PAM sequence: TAG
aggattaccacttgctcttt

SEQ ID NO: 50336 - DNA, 20 bp, Artificial Sequence
  Description of Artificial Sequence: Synthetic oligonucleotide
  Target: ATXN1; (-) strand; PAM type: NRG; PAM sequence: AGG
ggaatgtgtcatcgtatgtg

SEQ ID NO: 50337 - DNA, 20 bp, Artificial Sequence
  Description of Artificial Sequence: Synthetic oligonucleotide
  Target: ATXN1; (-) strand; PAM type: NRG; PAM sequence: GAG
tggaatgtgtcatcgtatgt

SEQ ID NO: 50338 - DNA, 20 bp, Artificial Sequence
  Description of Artificial Sequence: Synthetic oligonucleotide
  Target: ATXN1; (-) strand; PAM type: NRG; PAM sequence: TGG
atgcagactgctttagaggc

SEQ ID NO: 50339 - DNA, 20 bp, Artificial Sequence
  Description of Artificial Sequence: Synthetic oligonucleotide
  Target: ATXN1; (-) strand; PAM type: NRG; PAM sequence: AGG
tgtaatgcagactgctttag

SEQ ID NO: 50340 - DNA, 20 bp, Artificial Sequence
  Description of Artificial Sequence: Synthetic oligonucleotide
  Target: ATXN1; (-) strand; PAM type: NRG; PAM sequence: GAG
ctgtaatgcagactgcttta

SEQ ID NO: 50341 - DNA, 20 bp, Artificial Sequence
  Description of Artificial Sequence: Synthetic oligonucleotide
  Target: ATXN1; (-) strand; PAM type: NRG; PAM sequence: TAG
tcctgtaatgcagactgctt

SEQ ID NO: 50342 - DNA, 20 bp, Artificial Sequence
  Description of Artificial Sequence: Synthetic oligonucleotide
  Target: ATXN1; (-) strand; PAM type: NRG; PAM sequence: CAG
ataataatgatcctgtaatg

SEQ ID NO: 50343 - DNA, 20 bp, Artificial Sequence
  Description of Artificial Sequence: Synthetic oligonucleotide
  Target: ATXN1; (-) strand; PAM type: NRG; PAM sequence: TGG
ctgaattgtggcttctttgc

SEQ ID NO: 50344 - DNA, 20 bp, Artificial Sequence
  Description of Artificial Sequence: Synthetic oligonucleotide
  Target: ATXN1; (-) strand; PAM type: NRG; PAM sequence: TGG
ttgcatagattcctgaattg

SEQ ID NO: 50345 - DNA, 20 bp, Artificial Sequence
  Description of Artificial Sequence: Synthetic oligonucleotide
  Target: ATXN1; (-) strand; PAM type: NRG; PAM sequence: TAG
ttcacttaattatttttgca

SEQ ID NO: 50346 - DNA, 20 bp, Artificial Sequence
  Description of Artificial Sequence: Synthetic oligonucleotide
  Target: ATXN1; (-) strand; PAM type: NRG; PAM sequence: GAG
tgattgatggaaacttgatg

SEQ ID NO: 50347 - DNA, 20 bp, Artificial Sequence
  Description of Artificial Sequence: Synthetic oligonucleotide
  Target: ATXN1; (-) strand; PAM type: NRG; PAM sequence: TGG
agtgattgatggaaacttga

SEQ ID NO: 50348 - DNA, 20 bp, Artificial Sequence
  Description of Artificial Sequence: Synthetic oligonucleotide
  Target: ATXN1; (-) strand; PAM type: NRG; PAM sequence: TGG
tggcaaggaggagtgattga

SEQ ID NO: 50349 - DNA, 20 bp, Artificial Sequence
  Description of Artificial Sequence: Synthetic oligonucleotide
  Target: ATXN1; (-) strand; PAM type: NRG; PAM sequence: GAG
aagggcagaatggcaaggag

SEQ ID NO: 50350 - DNA, 20 bp, Artificial Sequence
  Description of Artificial Sequence: Synthetic oligonucleotide
  Target: ATXN1; (-) strand; PAM type: NRG; PAM sequence: AGG
ggaagggcagaatggcaagg

SEQ ID NO: 50351 - DNA, 20 bp, Artificial Sequence
  Description of Artificial Sequence: Synthetic oligonucleotide
  Target: ATXN1; (-) strand; PAM type: NRG; PAM sequence: GAG
aggaagggcagaatggcaag

SEQ ID NO: 50352 - DNA, 20 bp, Artificial Sequence
  Description of Artificial Sequence: Synthetic oligonucleotide
  Target: ATXN1; (-) strand; PAM type: NRG; PAM sequence: AGG
tcaggaagggcagaatggca

SEQ ID NO: 50353 - DNA, 20 bp, Artificial Sequence
  Description of Artificial Sequence: Synthetic oligonucleotide
  Target: ATXN1; (-) strand; PAM type: NRG; PAM sequence: AAG
ctcaggaagggcagaatggc

SEQ ID NO: 50354 - DNA, 20 bp, Artificial Sequence
  Description of Artificial Sequence: Synthetic oligonucleotide
  Target: ATXN1; (-) strand; PAM type: NRG; PAM sequence: TGG
tcatctcaggaagggcagaa

SEQ ID NO: 50355 - DNA, 20 bp, Artificial Sequence
  Description of Artificial Sequence: Synthetic oligonucleotide
  Target: ATXN1; (-) strand; PAM type: NRG; PAM sequence: CAG
tgttgtcatctcaggaaggg

SEQ ID NO: 50356 - DNA, 20 bp, Artificial Sequence
  Description of Artificial Sequence: Synthetic oligonucleotide
  Target: ATXN1; (-) strand; PAM type: NRG; PAM sequence: GGG
acatgttgtcatctcaggaa

SEQ ID NO: 50357 - DNA, 20 bp, Artificial Sequence
  Description of Artificial Sequence: Synthetic oligonucleotide
  Target: ATXN1; (-) strand; PAM type: NRG; PAM sequence: AGG
gacatgttgtcatctcagga

SEQ ID NO: 50358 - DNA, 20 bp, Artificial Sequence
  Description of Artificial Sequence: Synthetic oligonucleotide
  Target: ATXN1; (-) strand; PAM type: NRG; PAM sequence: AAG
tgacatgttgtcatctcagg

SEQ ID NO: 50359 - DNA, 20 bp, Artificial Sequence
  Description of Artificial Sequence: Synthetic oligonucleotide
  Target: ATXN1; (-) strand; PAM type: NRG; PAM sequence: AGG
agctgacatgttgtcatctc

SEQ ID NO: 50360 - DNA, 20 bp, Artificial Sequence
  Description of Artificial Sequence: Synthetic oligonucleotide
  Target: ATXN1; (-) strand; PAM type: NRG; PAM sequence: CAG
cagctgacatgttgtcatct

SEQ ID NO: 50361 - DNA, 20 bp, Artificial Sequence
  Description of Artificial Sequence: Synthetic oligonucleotide
  Target: ATXN1; (-) strand; PAM type: NRG; PAM sequence: CAG
gatgtagatcttgttcaaag

SEQ ID NO: 50362 - DNA, 20 bp, Artificial Sequence
  Description of Artificial Sequence: Synthetic oligonucleotide
  Target: ATXN1; (-) strand; PAM type: NRG; PAM sequence: AAG
cgcgatgtagatcttgttca

SEQ ID NO: 50363 - DNA, 20 bp, Artificial Sequence
  Description of Artificial Sequence: Synthetic oligonucleotide
  Target: ATXN1; (-) strand; PAM type: NRG; PAM sequence: TAG
gcaatgcagagaacgcgatg

SEQ ID NO: 50364 - DNA, 20 bp, Artificial Sequence
  Description of Artificial Sequence: Synthetic oligonucleotide
  Target: ATXN1; (-) strand; PAM type: NRG; PAM sequence: GAG
gcagcagcaagtgcaatgca

SEQ ID NO: 50365 - DNA, 20 bp, Artificial Sequence
  Description of Artificial Sequence: Synthetic oligonucleotide
  Target: ATXN1; (-) strand; PAM type: NRG; PAM sequence: CAG
aagcagcagcaagtgcaatg

SEQ ID NO: 50366 - DNA, 20 bp, Artificial Sequence
  Description of Artificial Sequence: Synthetic oligonucleotide
  Target: ATXN1; (-) strand; PAM type: NRG; PAM sequence: AAG
gcagactacaaagcagcagc

SEQ ID NO: 50367 - DNA, 20 bp, Artificial Sequence
  Description of Artificial Sequence: Synthetic oligonucleotide
  Target: ATXN1; (-) strand; PAM type: NRG; PAM sequence: CAG
cccagcagactacaaagcag

SEQ ID NO: 50368 - DNA, 20 bp, Artificial Sequence
  Description of Artificial Sequence: Synthetic oligonucleotide
  Target: ATXN1; (-) strand; PAM type: NRG; PAM sequence: CAG
ctacccagcagactacaaag

SEQ ID NO: 50369 - DNA, 20 bp, Artificial Sequence
  Description of Artificial Sequence: Synthetic oligonucleotide
  Target: ATXN1; (-) strand; PAM type: NRG; PAM sequence: AAG
ccactacccagcagactaca

SEQ ID NO: 50370 - DNA, 20 bp, Artificial Sequence
  Description of Artificial Sequence: Synthetic oligonucleotide
  Target: ATXN1; (-) strand; PAM type: NRG; PAM sequence: CAG
gcgctgtcaccactacccag

SEQ ID NO: 50371 - DNA, 20 bp, Artificial Sequence
  Description of Artificial Sequence: Synthetic oligonucleotide
  Target: ATXN1; (-) strand; PAM type: NRG; PAM sequence: CAG
aacgcgctgtcaccactacc

SEQ ID NO: 50372 - DNA, 20 bp, Artificial Sequence
  Description of Artificial Sequence: Synthetic oligonucleotide
  Target: ATXN1; (-) strand; PAM type: NRG; PAM sequence: TGG
ctgaactccccattttttta

SEQ ID NO: 50373 - DNA, 20 bp, Artificial Sequence
  Description of Artificial Sequence: Synthetic oligonucleotide
  Target: ATXN1; (-) strand; PAM type: NRG; PAM sequence: CAG
aaaatgttctcagccccctc

SEQ ID NO: 50374 - DNA, 20 bp, Artificial Sequence
  Description of Artificial Sequence: Synthetic oligonucleotide
  Target: ATXN1; (-) strand; PAM type: NRG; PAM sequence: CAG
caaatatgttaaaatgttct

SEQ ID NO: 50375 - DNA, 20 bp, Artificial Sequence
  Description of Artificial Sequence: Synthetic oligonucleotide
  Target: ATXN1; (-) strand; PAM type: NRG; PAM sequence: CAG
aaagcaaaagtttaagttct

SEQ ID NO: 50376 - DNA, 20 bp, Artificial Sequence
  Description of Artificial Sequence: Synthetic oligonucleotide
  Target: ATXN1; (-) strand; PAM type: NRG; PAM sequence: AAG
tgatctgaaagcaaaagttt

SEQ ID NO: 50377 - DNA, 20 bp, Artificial Sequence
  Description of Artificial Sequence: Synthetic oligonucleotide
  Target: ATXN1; (-) strand; PAM type: NRG; PAM sequence: AAG
tcagtctgatctgaaagcaa

SEQ ID NO: 50378 - DNA, 20 bp, Artificial Sequence
  Description of Artificial Sequence: Synthetic oligonucleotide
  Target: ATXN1; (-) strand; PAM type: NRG; PAM sequence: AAG
aagagttcagtctgatctga

SEQ ID NO: 50379 - DNA, 20 bp, Artificial Sequence
  Description of Artificial Sequence: Synthetic oligonucleotide
  Target: ATXN1; (-) strand; PAM type: NRG; PAM sequence: CAG
atgtaaaagtgttaagagtt

SEQ ID NO: 50380 - DNA, 20 bp, Artificial Sequence
  Description of Artificial Sequence: Synthetic oligonucleotide
  Target: ATXN1; (-) strand; PAM type: NRG; PAM sequence: GAG
ctttcatgtaaaagtgttaa

SEQ ID NO: 50381 - DNA, 20 bp, Artificial Sequence
  Description of Artificial Sequence: Synthetic oligonucleotide
  Target: ATXN1; (-) strand; PAM type: NRG; PAM sequence: AAG
ttctttcatgtaaaagtgtt

SEQ ID NO: 50382 - DNA, 20 bp, Artificial Sequence
  Description of Artificial Sequence: Synthetic oligonucleotide
  Target: ATXN1; (-) strand; PAM type: NRG; PAM sequence: AAG
cttgcatttctttcatgtaa

SEQ ID NO: 50383 - DNA, 20 bp, Artificial Sequence
  Description of Artificial Sequence: Synthetic oligonucleotide
  Target: ATXN1; (-) strand; PAM type: NRG; PAM sequence: AGG
taatgtattggttttatcat

SEQ ID NO: 50384 - DNA, 20 bp, Artificial Sequence
  Description of Artificial Sequence: Synthetic oligonucleotide
  Target: ATXN1; (-) strand; PAM type: NRG; PAM sequence: TAG
ttaatgtattggttttatca

SEQ ID NO: 50385 - DNA, 20 bp, Artificial Sequence
  Description of Artificial Sequence: Synthetic oligonucleotide
  Target: ATXN1; (-) strand; PAM type: NRG; PAM sequence: TGG
atccacatatgttaatgtat

SEQ ID NO: 50386 - DNA, 20 bp, Artificial Sequence
  Description of Artificial Sequence: Synthetic oligonucleotide
  Target: ATXN1; (-) strand; PAM type: NRG; PAM sequence: AGG
ttgctctcctgactttctag

SEQ ID NO: 50387 - DNA, 20 bp, Artificial Sequence
  Description of Artificial Sequence: Synthetic oligonucleotide
  Target: ATXN1; (-) strand; PAM type: NRG; PAM sequence: GAG
tttgctctcctgactttcta

SEQ ID NO: 50388 - DNA, 20 bp, Artificial Sequence
  Description of Artificial Sequence: Synthetic oligonucleotide
  Target: ATXN1; (-) strand; PAM type: NRG; PAM sequence: TAG
catttgctctcctgactttc

SEQ ID NO: 50389 - DNA, 20 bp, Artificial Sequence
  Description of Artificial Sequence: Synthetic oligonucleotide
  Target: ATXN1; (-) strand; PAM type: NRG; PAM sequence: GAG
gcagatcagaataactcaag

SEQ ID NO: 50390 - DNA, 20 bp, Artificial Sequence
  Description of Artificial Sequence: Synthetic oligonucleotide
  Target: ATXN1; (-) strand; PAM type: NRG; PAM sequence: AGG
cagcagatcagaataactca

SEQ ID NO: 50391 - DNA, 20 bp, Artificial Sequence
  Description of Artificial Sequence: Synthetic oligonucleotide
  Target: ATXN1; (-) strand; PAM type: NRG; PAM sequence: AAG
gcagcagatcagaataactc

SEQ ID NO: 50392 - DNA, 20 bp, Artificial Sequence
  Description of Artificial Sequence: Synthetic oligonucleotide
  Target: ATXN1; (-) strand; PAM type: NRG; PAM sequence: CAG
ggtggccttgtgcagcagat

SEQ ID NO: 50393 - DNA, 20 bp, Artificial Sequence
  Description of Artificial Sequence: Synthetic oligonucleotide
  Target: ATXN1; (-) strand; PAM type: NRG; PAM sequence: CAG
gccctggtggccttgtgcag

SEQ ID NO: 50394 - DNA, 20 bp, Artificial Sequence
  Description of Artificial Sequence: Synthetic oligonucleotide
  Target: ATXN1; (-) strand; PAM type: NRG; PAM sequence: CAG
ccagccctggtggccttgtg

SEQ ID NO: 50395 - DNA, 20 bp, Artificial Sequence
  Description of Artificial Sequence: Synthetic oligonucleotide
  Target: ATXN1; (-) strand; PAM type: NRG; PAM sequence: TGG
tgtcagagacccagccctgg

SEQ ID NO: 50396 - DNA, 20 bp, Artificial Sequence
  Description of Artificial Sequence: Synthetic oligonucleotide
  Target: ATXN1; (-) strand; PAM type: NRG; PAM sequence: TGG
cagtgtcagagacccagccc

SEQ ID NO: 50397 - DNA, 20 bp, Artificial Sequence
  Description of Artificial Sequence: Synthetic oligonucleotide
  Target: ATXN1; (-) strand; PAM type: NRG; PAM sequence: CAG
tgttatcagtgtcagagacc

SEQ ID NO: 50398 - DNA, 20 bp, Artificial Sequence
  Description of Artificial Sequence: Synthetic oligonucleotide
  Target: ATXN1; (-) strand; PAM type: NRG; PAM sequence: GAG
gagacctgttatcagtgtca

SEQ ID NO: 50399 - DNA, 20 bp, Artificial Sequence
  Description of Artificial Sequence: Synthetic oligonucleotide
  Target: ATXN1; (-) strand; PAM type: NRG; PAM sequence: CAG
cagagacctgttatcagtgt

SEQ ID NO: 50400 - DNA, 20 bp, Artificial Sequence
  Description of Artificial Sequence: Synthetic oligonucleotide
  Target: ATXN1; (-) strand; PAM type: NRG; PAM sequence: CAG
cttcaccagagacctgttat

SEQ ID NO: 50401 - DNA, 20 bp, Artificial Sequence
  Description of Artificial Sequence: Synthetic oligonucleotide
  Target: ATXN1; (-) strand; PAM type: NRG; PAM sequence: GAG
ttacacaaggtccttcacca

SEQ ID NO: 50402 - DNA, 20 bp, Artificial Sequence
  Description of Artificial Sequence: Synthetic oligonucleotide
  Target: ATXN1; (-) strand; PAM type: NRG; PAM sequence: CAG
ctttacacaaggtccttcac

SEQ ID NO: 50403 - DNA, 20 bp, Artificial Sequence
  Description of Artificial Sequence: Synthetic oligonucleotide
  Target: ATXN1; (-) strand; PAM type: NRG; PAM sequence: AGG
accattatactctttacaca

SEQ ID NO: 50404 - DNA, 20 bp, Artificial Sequence
  Description of Artificial Sequence: Synthetic oligonucleotide
  Target: ATXN1; (-) strand; PAM type: NRG; PAM sequence: AAG
taccattatactctttacac

SEQ ID NO: 50405 - DNA, 20 bp, Artificial Sequence
  Description of Artificial Sequence: Synthetic oligonucleotide
  Target: ATXN1; (-) strand; PAM type: NRG; PAM sequence: TAG
ttctctctatgtacatcttt

SEQ ID NO: 50406 - DNA, 20 bp, Artificial Sequence
  Description of Artificial Sequence: Synthetic oligonucleotide
  Target: ATXN1; (-) strand; PAM type: NRG; PAM sequence: GAG
attcagcctatgagcccaag

SEQ ID NO: 50407 - DNA, 20 bp, Artificial Sequence
  Description of Artificial Sequence: Synthetic oligonucleotide
  Target: ATXN1; (-) strand; PAM type: NRG; PAM sequence: AGG
gcattcagcctatgagccca

SEQ ID NO: 50408 - DNA, 20 bp, Artificial Sequence
  Description of Artificial Sequence: Synthetic oligonucleotide
  Target: ATXN1; (-) strand; PAM type: NRG; PAM sequence: AAG
ggcattcagcctatgagccc

SEQ ID NO: 50409 - DNA, 20 bp, Artificial Sequence
  Description of Artificial Sequence: Synthetic oligonucleotide
  Target: ATXN1; (-) strand; PAM type: NRG; PAM sequence: GAG
ttcagaggcattcagcctat

SEQ ID NO: 50410 - DNA, 20 bp, Artificial Sequence
  Description of Artificial Sequence: Synthetic oligonucleotide
  Target: ATXN1; (-) strand; PAM type: NRG; PAM sequence: CAG
tgttcatgttcagaggcatt

SEQ ID NO: 50411 - DNA, 20 bp, Artificial Sequence
  Description of Artificial Sequence: Synthetic oligonucleotide
  Target: ATXN1; (-) strand; PAM type: NRG; PAM sequence: AGG
aacatcctgttcatgttcag

SEQ ID NO: 50412 - DNA, 20 bp, Artificial Sequence
  Description of Artificial Sequence: Synthetic oligonucleotide
  Target: ATXN1; (-) strand; PAM type: NRG; PAM sequence: GAG
taacatcctgttcatgttca

SEQ ID NO: 50413 - DNA, 20 bp, Artificial Sequence
  Description of Artificial Sequence: Synthetic oligonucleotide
  Target: ATXN1; (-) strand; PAM type: NRG; PAM sequence: CAG
agtaacatcctgttcatgtt

SEQ ID NO: 50414 - DNA, 20 bp, Artificial Sequence
  Description of Artificial Sequence: Synthetic oligonucleotide
  Target: ATXN1; (-) strand; PAM type: NRG; PAM sequence: GAG
ttttaaaaagtgatttgaag

SEQ ID NO: 50415 - DNA, 20 bp, Artificial Sequence
  Description of Artificial Sequence: Synthetic oligonucleotide
  Target: ATXN1; (-) strand; PAM type: NRG; PAM sequence: AGG
atttttaaaaagtgatttga

SEQ ID NO: 50416 - DNA, 20 bp, Artificial Sequence
  Description of Artificial Sequence: Synthetic oligonucleotide
  Target: ATXN1; (-) strand; PAM type: NRG; PAM sequence: AAG
tatttttaaaaagtgatttg

SEQ ID NO: 50417 - DNA, 20 bp, Artificial Sequence
  Description of Artificial Sequence: Synthetic oligonucleotide
  Target: ATXN1; (-) strand; PAM type: NRG; PAM sequence: AAG
ataatcaaaatatttttaaa

SEQ ID NO: 50418 - DNA, 20 bp, Artificial Sequence
  Description of Artificial Sequence: Synthetic oligonucleotide
  Target: ATXN1; (-) strand; PAM type: NRG; PAM sequence: TAG
tgagaccagcctgggcaaca

SEQ ID NO: 50419 - DNA, 20 bp, Artificial Sequence
  Description of Artificial Sequence: Synthetic oligonucleotide
  Target: ATXN1; (-) strand; PAM type: NRG; PAM sequence: GGG
caggagtttgagaccagcct

SEQ ID NO: 50420 - DNA, 20 bp, Artificial Sequence
  Description of Artificial Sequence: Synthetic oligonucleotide
  Target: ATXN1; (-) strand; PAM type: NRG; PAM sequence: TGG
ccaggagtttgagaccagcc

SEQ ID NO: 50421 - DNA, 20 bp, Artificial Sequence
  Description of Artificial Sequence: Synthetic oligonucleotide
  Target: ATXN1; (-) strand; PAM type: NRG; PAM sequence: CAG
tgagcccaggagtttgagac

SEQ ID NO: 50422 - DNA, 20 bp, Artificial Sequence
  Description of Artificial Sequence: Synthetic oligonucleotide
  Target: ATXN1; (-) strand; PAM type: NRG; PAM sequence: GAG
ttgcttgagcccaggagttt

SEQ ID NO: 50423 - DNA, 20 bp, Artificial Sequence
  Description of Artificial Sequence: Synthetic oligonucleotide
  Target: ATXN1; (-) strand; PAM type: NRG; PAM sequence: GAG
ggcagattgcttgagcccag

SEQ ID NO: 50424 - DNA, 20 bp, Artificial Sequence
  Description of Artificial Sequence: Synthetic oligonucleotide
  Target: ATXN1; (-) strand; PAM type: NRG; PAM sequence: AGG
caggcagattgcttgagccc

SEQ ID NO: 50425 - DNA, 20 bp, Artificial Sequence
  Description of Artificial Sequence: Synthetic oligonucleotide
  Target: ATXN1; (-) strand; PAM type: NRG; PAM sequence: CAG
gcaggcagattgcttgagcc

SEQ ID NO: 50426 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggcagattgctt

SEQ ID NO: 50427 - DNA, 20 bp, Artificial Sequence
  Description of Artificial Sequence: Synthetic oligonucleotide
  Target: ATXN1; (-) strand; PAM type: NRG; PAM sequence: CAG
ctttgggaggctgaggcagg

SEQ ID NO: 50428 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggctgaggc

SEQ ID NO: 50429 - DNA, 20 bp, Artificial Sequence
  Description of Artificial Sequence: Synthetic oligonucleotide
  Target: ATXN1; (-) strand; PAM type: NRG; PAM sequence: CAG
agcactttgggaggctgagg

SEQ ID NO: 50430 - DNA, 20 bp, Artificial Sequence
  Description of Artificial Sequence: Synthetic oligonucleotide
  Target: ATXN1; (-) strand; PAM type: NRG; PAM sequence: AGG
cctagcactttgggaggctg

SEQ ID NO: 50431 - DNA, 20 bp, Artificial Sequence
  Description of Artificial Sequence: Synthetic oligonucleotide
  Target: ATXN1; (-) strand; PAM type: NRG; PAM sequence: GAG
tcctagcactttgggaggct

SEQ ID NO: 50432 - DNA, 20 bp, Artificial Sequence
  Description of Artificial Sequence: Synthetic oligonucleotide
  Target: ATXN1; (-) strand; PAM type: NRG; PAM sequence: AGG
tgtaatcctagcactttggg

SEQ ID NO: 50433 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcctagcactttgg

SEQ ID NO: 50434 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcctagcacttt

SEQ ID NO: 50435 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcctagcactt

SEQ ID NO: 50436 - DNA, 20 bp, Artificial Sequence
  Description of Artificial Sequence: Synthetic oligonucleotide
  Target: ATXN1; (-) strand; PAM type: NRG; PAM sequence: TAG
gtagttcacgcctgtaatcc

SEQ ID NO: 50437 - DNA, 20 bp, Artificial Sequence
  Description of Artificial Sequence: Synthetic oligonucleotide
  Target: ATXN1; (-) strand; PAM type: NRG; PAM sequence: TAG
ataggggaggctgggcacgg

SEQ ID NO: 50438 - DNA, 20 bp, Artificial Sequence
  Description of Artificial Sequence: Synthetic oligonucleotide
  Target: ATXN1; (-) strand; PAM type: NRG; PAM sequence: CGG
gatataggggaggctgggca

SEQ ID NO: 50439 - DNA, 20 bp, Artificial Sequence
  Description of Artificial Sequence: Synthetic oligonucleotide
  Target: ATXN1; (-) strand; PAM type: NRG; PAM sequence: GGG
aaaatgatataggggaggct

SEQ ID NO: 50440 - DNA, 20 bp, Artificial Sequence
  Description of Artificial Sequence: Synthetic oligonucleotide
  Target: ATXN1; (-) strand; PAM type: NRG; PAM sequence: TGG
aaaaatgatataggggaggc

SEQ ID NO: 50441 - DNA, 20 bp, Artificial Sequence
  Description of Artificial Sequence: Synthetic oligonucleotide
  Target: ATXN1; (-) strand; PAM type: NRG; PAM sequence: AGG
gagtaaaaatgatatagggg

SEQ ID NO: 50442 - DNA, 20 bp, Artificial Sequence
  Description of Artificial Sequence: Synthetic oligonucleotide
  Target: ATXN1; (-) strand; PAM type: NRG; PAM sequence: GAG
ggagtaaaaatgatataggg

SEQ ID NO: 50443 - DNA, 20 bp, Artificial Sequence
  Description of Artificial Sequence: Synthetic oligonucleotide
  Target: ATXN1; (-) strand; PAM type: NRG; PAM sequence: GGG
tgggagtaaaaatgatatag

SEQ ID NO: 50444 - DNA, 20 bp, Artificial Sequence
  Description of Artificial Sequence: Synthetic oligonucleotide
  Target: ATXN1; (-) strand; PAM type: NRG; PAM sequence: GGG
ctgggagtaaaaatgatata

SEQ ID NO: 50445 - DNA, 20 bp, Artificial Sequence
  Description of Artificial Sequence: Synthetic oligonucleotide
  Target: ATXN1; (-) strand; PAM type: NRG; PAM sequence: AGG
cctgggagtaaaaatgatat

SEQ ID NO: 50446 - DNA, 20 bp, Artificial Sequence
  Description of Artificial Sequence: Synthetic oligonucleotide
  Target: ATXN1; (-) strand; PAM type: NRG; PAM sequence: TAG
ccctgggagtaaaaatgata

SEQ ID NO: 50447 - DNA, 20 bp, Artificial Sequence
  Description of Artificial Sequence: Synthetic oligonucleotide
  Target: ATXN1; (-) strand; PAM type: NRG; PAM sequence: GAG
caaagaaatagtagccctgg

SEQ ID NO: 50448 - DNA, 20 bp, Artificial Sequence
  Description of Artificial Sequence: Synthetic oligonucleotide
  Target: ATXN1; (-) strand; PAM type: NRG; PAM sequence: GGG
ctcaaagaaatagtagccct

SEQ ID NO: 50449 - DNA, 20 bp, Artificial Sequence
  Description of Artificial Sequence: Synthetic oligonucleotide
  Target: ATXN1; (-) strand; PAM type: NRG; PAM sequence: TGG
cctcaaagaaatagtagccc

SEQ ID NO: 50450 - DNA, 20 bp, Artificial Sequence
  Description of Artificial Sequence: Synthetic oligonucleotide
  Target: ATXN1; (-) strand; PAM type: NRG; PAM sequence: TAG
ccttgtcctcaaagaaatag

SEQ ID NO: 50451 - DNA, 20 bp, Artificial Sequence
  Description of Artificial Sequence: Synthetic oligonucleotide
  Target: ATXN1; (-) strand; PAM type: NRG; PAM sequence: TAG
agtccttgtcctcaaagaaa

SEQ ID NO: 50452 - DNA, 20 bp, Artificial Sequence
  Description of Artificial Sequence: Synthetic oligonucleotide
  Target: ATXN1; (-) strand; PAM type: NRG; PAM sequence: AAG
agacacagtccttgtcctca

SEQ ID NO: 50453 - DNA, 20 bp, Artificial Sequence
  Description of Artificial Sequence: Synthetic oligonucleotide
  Target: ATXN1; (-) strand; PAM type: NRG; PAM sequence: CAG
atactacaatgactaagaca

SEQ ID NO: 50454 - DNA, 20 bp, Artificial Sequence
  Description of Artificial Sequence: Synthetic oligonucleotide
  Target: ATXN1; (-) strand; PAM type: NRG; PAM sequence: AAG
cgcatcatactacaatgact

SEQ ID NO: 50455 - DNA, 20 bp, Artificial Sequence
  Description of Artificial Sequence: Synthetic oligonucleotide
  Target: ATXN1; (-) strand; PAM type: NRG; PAM sequence: TAG
tgctatgtgtcaggtactat

SEQ ID NO: 50456 - DNA, 20 bp, Artificial Sequence
  Description of Artificial Sequence: Synthetic oligonucleotide
  Target: ATXN1; (-) strand; PAM type: NRG; PAM sequence: AGG
ctaagcatctgctatgtgtc

SEQ ID NO: 50457 - DNA, 20 bp, Artificial Sequence
  Description of Artificial Sequence: Synthetic oligonucleotide
  Target: ATXN1; (-) strand; PAM type: NRG; PAM sequence: CAG
actaagcatctgctatgtgt

SEQ ID NO: 50458 - DNA, 20 bp, Artificial Sequence
  Description of Artificial Sequence: Synthetic oligonucleotide
  Target: ATXN1; (-) strand; PAM type: NRG; PAM sequence: AAG
ttaacaagctaacatgcact

SEQ ID NO: 50459 - DNA, 20 bp, Artificial Sequence
  Description of Artificial Sequence: Synthetic oligonucleotide
  Target: ATXN1; (-) strand; PAM type: NRG; PAM sequence: AAG
gccagatgcatgtatttaac

SEQ ID NO: 50460 - DNA, 20 bp, Artificial Sequence
  Description of Artificial Sequence: Synthetic oligonucleotide
  Target: ATXN1; (-) strand; PAM type: NRG; PAM sequence: CAG
atttgcttgatcccttgtgc

SEQ ID NO: 50461 - DNA, 20 bp, Artificial Sequence
  Description of Artificial Sequence: Synthetic oligonucleotide
  Target: ATXN1; (-) strand; PAM type: NRG; PAM sequence: GAG
cctagtcaatctgtcattca

SEQ ID NO: 50462 - DNA, 20 bp, Artificial Sequence
  Description of Artificial Sequence: Synthetic oligonucleotide
  Target: ATXN1; (-) strand; PAM type: NRG; PAM sequence: CAG
ttcctagtcaatctgtcatt

SEQ ID NO: 50463 - DNA, 20 bp, Artificial Sequence
  Description of Artificial Sequence: Synthetic oligonucleotide
  Target: ATXN1; (-) strand; PAM type: NRG; PAM sequence: TAG
cattgatctcccgctcttcc

SEQ ID NO: 50464 - DNA, 20 bp, Artificial Sequence
  Description of Artificial Sequence: Synthetic oligonucleotide
  Target: ATXN1; (-) strand; PAM type: NRG; PAM sequence: GAG
gctgatccgtgaccaccatt

SEQ ID NO: 50465 - DNA, 20 bp, Artificial Sequence
  Description of Artificial Sequence: Synthetic oligonucleotide
  Target: ATXN1; (-) strand; PAM type: NRG; PAM sequence: GAG
gggttctcatggttagttga

SEQ ID NO: 50466 - DNA, 20 bp, Artificial Sequence
  Description of Artificial Sequence: Synthetic oligonucleotide
  Target: ATXN1; (-) strand; PAM type: NRG; PAM sequence: GAG
ccgggttctcatggttagtt

SEQ ID NO: 50467 - DNA, 20 bp, Artificial Sequence
  Description of Artificial Sequence: Synthetic oligonucleotide
  Target: ATXN1; (-) strand; PAM type: NRG; PAM sequence: TAG
ttcatccgggttctcatggt

SEQ ID NO: 50468 - DNA, 20 bp, Artificial Sequence
  Description of Artificial Sequence: Synthetic oligonucleotide
  Target: ATXN1; (-) strand; PAM type: NRG; PAM sequence: TGG
ctacttcatccgggttctca

SEQ ID NO: 50469 - DNA, 20 bp, Artificial Sequence
  Description of Artificial Sequence: Synthetic oligonucleotide
  Target: ATXN1; (-) strand; PAM type: NRG; PAM sequence: GGG
acctagcttctacttcatcc

SEQ ID NO: 50470 - DNA, 20 bp, Artificial Sequence
  Description of Artificial Sequence: Synthetic oligonucleotide
  Target: ATXN1; (-) strand; PAM type: NRG; PAM sequence: CGG
aacctagcttctacttcatc

SEQ ID NO: 50471 - DNA, 20 bp, Artificial Sequence
  Description of Artificial Sequence: Synthetic oligonucleotide
  Target: ATXN1; (-) strand; PAM type: NRG; PAM sequence: TAG
gggaaaagatcagcttaacc

SEQ ID NO: 50472 - DNA, 20 bp, Artificial Sequence
  Description of Artificial Sequence: Synthetic oligonucleotide
  Target: ATXN1; (-) strand; PAM type: NRG; PAM sequence: CAG
taatgaggaggggaaaagat

SEQ ID NO: 50473 - DNA, 20 bp, Artificial Sequence
  Description of Artificial Sequence: Synthetic oligonucleotide
  Target: ATXN1; (-) strand; PAM type: NRG; PAM sequence: AAG
caatttaatgaggaggggaa

SEQ ID NO: 50474 - DNA, 20 bp, Artificial Sequence
  Description of Artificial Sequence: Synthetic oligonucleotide
  Target: ATXN1; (-) strand; PAM type: NRG; PAM sequence: GGG
aatggcaatttaatgaggag

SEQ ID NO: 50475 - DNA, 20 bp, Artificial Sequence
  Description of Artificial Sequence: Synthetic oligonucleotide
  Target: ATXN1; (-) strand; PAM type: NRG; PAM sequence: GGG
caatggcaatttaatgagga

SEQ ID NO: 50476 - DNA, 20 bp, Artificial Sequence
  Description of Artificial Sequence: Synthetic oligonucleotide
  Target: ATXN1; (-) strand; PAM type: NRG; PAM sequence: AGG
gcaatggcaatttaatgagg

SEQ ID NO: 50477 - DNA, 20 bp, Artificial Sequence
  Description of Artificial Sequence: Synthetic oligonucleotide
  Target: ATXN1; (-) strand; PAM type: NRG; PAM sequence: GAG
agcaatggcaatttaatgag

SEQ ID NO: 50478 - DNA, 20 bp, Artificial Sequence
  Description of Artificial Sequence: Synthetic oligonucleotide
  Target: ATXN1; (-) strand; PAM type: NRG; PAM sequence: AGG
ggagcaatggcaatttaatg

SEQ ID NO: 50479 - DNA, 20 bp, Artificial Sequence
  Description of Artificial Sequence: Synthetic oligonucleotide
  Target: ATXN1; (-) strand; PAM type: NRG; PAM sequence: GAG
gggagcaatggcaatttaat

SEQ ID NO: 50480 - DNA, 20 bp, Artificial Sequence
  Description of Artificial Sequence: Synthetic oligonucleotide
  Target: ATXN1; (-) strand; PAM type: NRG; PAM sequence: TGG
gatgaccctatagggagcaa

SEQ ID NO: 50481 - DNA, 20 bp, Artificial Sequence
  Description of Artificial Sequence: Synthetic oligonucleotide
  Target: ATXN1; (-) strand; PAM type: NRG; PAM sequence: GAG
ctttctgatgaccctatagg

SEQ ID NO: 50482 - DNA, 20 bp, Artificial Sequence
  Description of Artificial Sequence: Synthetic oligonucleotide
  Target: ATXN1; (-) strand; PAM type: NRG; PAM sequence: GGG
ggctttctgatgaccctata

SEQ ID NO: 50483 - DNA, 20 bp, Artificial Sequence
  Description of Artificial Sequence: Synthetic oligonucleotide
  Target: ATXN1; (-) strand; PAM type: NRG; PAM sequence: AGG
aggctttctgatgaccctat

SEQ ID NO: 50484 - DNA, 20 bp, Artificial Sequence
  Description of Artificial Sequence: Synthetic oligonucleotide
  Target: ATXN1; (-) strand; PAM type: NRG; PAM sequence: TAG
caggctttctgatgacccta

SEQ ID NO: 50485 - DNA, 20 bp, Artificial Sequence
  Description of Artificial Sequence: Synthetic oligonucleotide
  Target: ATXN1; (-) strand; PAM type: NRG; PAM sequence: AGG
cctccacaggggccatatcc

SEQ ID NO: 50486 - DNA, 20 bp, Artificial Sequence
  Description of Artificial Sequence: Synthetic oligonucleotide
  Target: ATXN1; (-) strand; PAM type: NRG; PAM sequence: CAG
gcctccacaggggccatatc

SEQ ID NO: 50487 - DNA, 20 bp, Artificial Sequence
  Description of Artificial Sequence: Synthetic oligonucleotide
  Target: ATXN1; (-) strand; PAM type: NRG; PAM sequence: GGG
gatatgtggtgcctccacag

SEQ ID NO: 50488 - DNA, 20 bp, Artificial Sequence
  Description of Artificial Sequence: Synthetic oligonucleotide
  Target: ATXN1; (-) strand; PAM type: NRG; PAM sequence: GGG
agatatgtggtgcctccaca

SEQ ID NO: 50489 - DNA, 20 bp, Artificial Sequence
  Description of Artificial Sequence: Synthetic oligonucleotide
  Target: ATXN1; (-) strand; PAM type: NRG; PAM sequence: AGG
gagatatgtggtgcctccac

SEQ ID NO: 50490 - DNA, 20 bp, Artificial Sequence
  Description of Artificial Sequence: Synthetic oligonucleotide
  Target: ATXN1; (-) strand; PAM type: NRG; PAM sequence: CAG
agagatatgtggtgcctcca

SEQ ID NO: 50491 - DNA, 20 bp, Artificial Sequence
  Description of Artificial Sequence: Synthetic oligonucleotide
  Target: ATXN1; (-) strand; PAM type: NRG; PAM sequence: TGG
actcagcattcagagatatg

SEQ ID NO: 50492 - DNA, 20 bp, Artificial Sequence
  Description of Artificial Sequence: Synthetic oligonucleotide
  Target: ATXN1; (-) strand; PAM type: NRG; PAM sequence: GAG
tctgttttactcagcattca

SEQ ID NO: 50493 - DNA, 20 bp, Artificial Sequence
  Description of Artificial Sequence: Synthetic oligonucleotide
  Target: ATXN1; (-) strand; PAM type: NRG; PAM sequence: CAG
tatctgttttactcagcatt

SEQ ID NO: 50494 - DNA, 20 bp, Artificial Sequence
  Description of Artificial Sequence: Synthetic oligonucleotide
  Target: ATXN1; (-) strand; PAM type: NRG; PAM sequence: CAG
tctacattatctgttttact

SEQ ID NO: 50495 - DNA, 20 bp, Artificial Sequence
  Description of Artificial Sequence: Synthetic oligonucleotide
  Target: ATXN1; (-) strand; PAM type: NRG; PAM sequence: AAG
acagtgaactttcagtgaag

SEQ ID NO: 50496 - DNA, 20 bp, Artificial Sequence
  Description of Artificial Sequence: Synthetic oligonucleotide
  Target: ATXN1; (-) strand; PAM type: NRG; PAM sequence: AAG
tccacagtgaactttcagtg

SEQ ID NO: 50497 - DNA, 20 bp, Artificial Sequence
  Description of Artificial Sequence: Synthetic oligonucleotide
  Target: ATXN1; (-) strand; PAM type: NRG; PAM sequence: CAG
ggtcttccacagtgaacttt

SEQ ID NO: 50498 - DNA, 20 bp, Artificial Sequence
  Description of Artificial Sequence: Synthetic oligonucleotide
  Target: ATXN1; (-) strand; PAM type: NRG; PAM sequence: CAG
gctgatggagaggtcttcca

SEQ ID NO: 50499 - DNA, 20 bp, Artificial Sequence
  Description of Artificial Sequence: Synthetic oligonucleotide
  Target: ATXN1; (-) strand; PAM type: NRG; PAM sequence: AGG
cctctcagtggctgatggag

SEQ ID NO: 50500 - DNA, 20 bp, Artificial Sequence
  Description of Artificial Sequence: Synthetic oligonucleotide
  Target: ATXN1; (-) strand; PAM type: NRG; PAM sequence: GAG
ccctctcagtggctgatgga

SEQ ID NO: 50501 - DNA, 20 bp, Artificial Sequence
  Description of Artificial Sequence: Synthetic oligonucleotide
  Target: ATXN1; (-) strand; PAM type: NRG; PAM sequence: GAG
ctccctctcagtggctgatg

SEQ ID NO: 50502 - DNA, 20 bp, Artificial Sequence
  Description of Artificial Sequence: Synthetic oligonucleotide
  Target: ATXN1; (-) strand; PAM type: NRG; PAM sequence: TGG
acctccctctcagtggctga

SEQ ID NO: 50503 - DNA, 20 bp, Artificial Sequence
  Description of Artificial Sequence: Synthetic oligonucleotide
  Target: ATXN1; (-) strand; PAM type: NRG; PAM sequence: TGG
gggcaccacctccctctcag

SEQ ID NO: 50504 - DNA, 20 bp, Artificial Sequence
  Description of Artificial Sequence: Synthetic oligonucleotide
  Target: ATXN1; (-) strand; PAM type: NRG; PAM sequence: CAG
gcagggcaccacctccctct

SEQ ID NO: 50505 - DNA, 20 bp, Artificial Sequence
  Description of Artificial Sequence: Synthetic oligonucleotide
  Target: ATXN1; (-) strand; PAM type: NRG; PAM sequence: GGG
acttctgtacccaagtagca

SEQ ID NO: 50506 - DNA, 20 bp, Artificial Sequence
  Description of Artificial Sequence: Synthetic oligonucleotide
  Target: ATXN1; (-) strand; PAM type: NRG; PAM sequence: AGG
gacttctgtacccaagtagc

SEQ ID NO: 50507 - DNA, 20 bp, Artificial Sequence
  Description of Artificial Sequence: Synthetic oligonucleotide
  Target: ATXN1; (-) strand; PAM type: NRG; PAM sequence: CAG
tgacttctgtacccaagtag

SEQ ID NO: 50508 - DNA, 20 bp, Artificial Sequence
  Description of Artificial Sequence: Synthetic oligonucleotide
  Target: ATXN1; (-) strand; PAM type: NRG; PAM sequence: TAG
gtttgacttctgtacccaag

SEQ ID NO: 50509 - DNA, 20 bp, Artificial Sequence
  Description of Artificial Sequence: Synthetic oligonucleotide
  Target: ATXN1; (-) strand; PAM type: NRG; PAM sequence: AAG
tgagtttgacttctgtaccc

SEQ ID NO: 50510 - DNA, 20 bp, Artificial Sequence
  Description of Artificial Sequence: Synthetic oligonucleotide
  Target: ATXN1; (-) strand; PAM type: NRG; PAM sequence: GAG
atcacgagcaagcatagtct

SEQ ID NO: 50511 - DNA, 20 bp, Artificial Sequence
  Description of Artificial Sequence: Synthetic oligonucleotide
  Target: ATXN1; (-) strand; PAM type: NRG; PAM sequence: TAG
ttgagaatcacgagcaagca

SEQ ID NO: 50512 - DNA, 20 bp, Artificial Sequence
  Description of Artificial Sequence: Synthetic oligonucleotide
  Target: ATXN1; (-) strand; PAM type: NRG; PAM sequence: AAG
cttgtttgagaatcacgagc

SEQ ID NO: 50513 - DNA, 20 bp, Artificial Sequence
  Description of Artificial Sequence: Synthetic oligonucleotide
  Target: ATXN1; (-) strand; PAM type: NRG; PAM sequence: GAG
ctgccttgtttgagaatcac

SEQ ID NO: 50514 - DNA, 20 bp, Artificial Sequence
  Description of Artificial Sequence: Synthetic oligonucleotide
  Target: ATXN1; (-) strand; PAM type: NRG; PAM sequence: GAG
gggtaacccctgccttgttt

SEQ ID NO: 50515 - DNA, 20 bp, Artificial Sequence
  Description of Artificial Sequence: Synthetic oligonucleotide
  Target: ATXN1; (-) strand; PAM type: NRG; PAM sequence: GGG
cttttcagatgtccctggga

SEQ ID NO: 50516 - DNA, 20 bp, Artificial Sequence
  Description of Artificial Sequence: Synthetic oligonucleotide
  Target: ATXN1; (-) strand; PAM type: NRG; PAM sequence: AGG
ccttttcagatgtccctggg

SEQ ID NO: 50517 - DNA, 20 bp, Artificial Sequence
  Description of Artificial Sequence: Synthetic oligonucleotide
  Target: ATXN1; (-) strand; PAM type: NRG; PAM sequence: GAG
tccttttcagatgtccctgg

SEQ ID NO: 50518 - DNA, 20 bp, Artificial Sequence
  Description of Artificial Sequence: Synthetic oligonucleotide
  Target: ATXN1; (-) strand; PAM type: NRG; PAM sequence: GGG
actccttttcagatgtccct

SEQ ID NO: 50519 - DNA, 20 bp, Artificial Sequence
  Description of Artificial Sequence: Synthetic oligonucleotide
  Target: ATXN1; (-) strand; PAM type: NRG; PAM sequence: TGG
cactccttttcagatgtccc

SEQ ID NO: 50520 - DNA, 20 bp, Artificial Sequence
  Description of Artificial Sequence: Synthetic oligonucleotide
  Target: ATXN1; (-) strand; PAM type: NRG; PAM sequence: CAG
agaatggccccactcctttt

SEQ ID NO: 50521 - DNA, 20 bp, Artificial Sequence
  Description of Artificial Sequence: Synthetic oligonucleotide
  Target: ATXN1; (-) strand; PAM type: NRG; PAM sequence: TGG
gttgttttaaggattcagaa

SEQ ID NO: 50522 - DNA, 20 bp, Artificial Sequence
  Description of Artificial Sequence: Synthetic oligonucleotide
  Target: ATXN1; (-) strand; PAM type: NRG; PAM sequence: CAG
tccaagttgttttaaggatt

SEQ ID NO: 50523 - DNA, 20 bp, Artificial Sequence
  Description of Artificial Sequence: Synthetic oligonucleotide
  Target: ATXN1; (-) strand; PAM type: NRG; PAM sequence: AGG
aatgtttccaagttgtttta

SEQ ID NO: 50524 - DNA, 20 bp, Artificial Sequence
  Description of Artificial Sequence: Synthetic oligonucleotide
  Target: ATXN1; (-) strand; PAM type: NRG; PAM sequence: AAG
caatgtttccaagttgtttt

SEQ ID NO: 50525 - DNA, 20 bp, Artificial Sequence
  Description of Artificial Sequence: Synthetic oligonucleotide
  Target: ATXN1; (-) strand; PAM type: NRG; PAM sequence: AAG
ctcatcccaacaatgtttcc

SEQ ID NO: 50526 - DNA, 20 bp, Artificial Sequence
  Description of Artificial Sequence: Synthetic oligonucleotide
  Target: ATXN1; (-) strand; PAM type: NRG; PAM sequence: CGG
gacaacacaacaagcactcc

SEQ ID NO: 50527 - DNA, 20 bp, Artificial Sequence
  Description of Artificial Sequence: Synthetic oligonucleotide
  Target: ATXN1; (-) strand; PAM type: NRG; PAM sequence: AAG
cccgctcatgacaacacaac

SEQ ID NO: 50528 - DNA, 20 bp, Artificial Sequence
  Description of Artificial Sequence: Synthetic oligonucleotide
  Target: ATXN1; (-) strand; PAM type: NRG; PAM sequence: GAG
ggacggccctctgctatgca

SEQ ID NO: 50529 - DNA, 20 bp, Artificial Sequence
  Description of Artificial Sequence: Synthetic oligonucleotide
  Target: ATXN1; (-) strand; PAM type: NRG; PAM sequence: CAG
caggacggccctctgctatg

SEQ ID NO: 50530 - DNA, 20 bp, Artificial Sequence
  Description of Artificial Sequence: Synthetic oligonucleotide
  Target: ATXN1; (-) strand; PAM type: NRG; PAM sequence: CGG
tcataacgaagcaggcagga

SEQ ID NO: 50531 - DNA, 20 bp, Artificial Sequence
  Description of Artificial Sequence: Synthetic oligonucleotide
  Target: ATXN1; (-) strand; PAM type: NRG; PAM sequence: AGG
tgtttcataacgaagcaggc

SEQ ID NO: 50532 - DNA, 20 bp, Artificial Sequence
  Description of Artificial Sequence: Synthetic oligonucleotide
  Target: ATXN1; (-) strand; PAM type: NRG; PAM sequence: CAG
gtgtttcataacgaagcagg

SEQ ID NO: 50533 - DNA, 20 bp, Artificial Sequence
  Description of Artificial Sequence: Synthetic oligonucleotide
  Target: ATXN1; (-) strand; PAM type: NRG; PAM sequence: AGG
gcagtgtttcataacgaagc

SEQ ID NO: 50534 - DNA, 20 bp, Artificial Sequence
  Description of Artificial Sequence: Synthetic oligonucleotide
  Target: ATXN1; (-) strand; PAM type: NRG; PAM sequence: CAG
tgcagtgtttcataacgaag

SEQ ID NO: 50535 - DNA, 20 bp, Artificial Sequence
  Description of Artificial Sequence: Synthetic oligonucleotide
  Target: ATXN1; (-) strand; PAM type: NRG; PAM sequence: AAG
agttgcagtgtttcataacg

SEQ ID NO: 50536 - DNA, 20 bp, Artificial Sequence
  Description of Artificial Sequence: Synthetic oligonucleotide
  Target: ATXN1; (-) strand; PAM type: NRG; PAM sequence: CAG
agagtgtttcgttaaagttg

SEQ ID NO: 50537 - DNA, 20 bp, Artificial Sequence
  Description of Artificial Sequence: Synthetic oligonucleotide
  Target: ATXN1; (-) strand; PAM type: NRG; PAM sequence: AAG
ttctagagagtgtttcgtta

SEQ ID NO: 50538 - DNA, 20 bp, Artificial Sequence
  Description of Artificial Sequence: Synthetic oligonucleotide
  Target: ATXN1; (-) strand; PAM type: NRG; PAM sequence: GAG
acaatgctatctgttctaga

SEQ ID NO: 50539 - DNA, 20 bp, Artificial Sequence
  Description of Artificial Sequence: Synthetic oligonucleotide
  Target: ATXN1; (-) strand; PAM type: NRG; PAM sequence: GAG
agacaatgctatctgttcta

SEQ ID NO: 50540 - DNA, 20 bp, Artificial Sequence
  Description of Artificial Sequence: Synthetic oligonucleotide
  Target: ATXN1; (-) strand; PAM type: NRG; PAM sequence: TAG
taagacaatgctatctgttc

SEQ ID NO: 50541 - DNA, 20 bp, Artificial Sequence
  Description of Artificial Sequence: Synthetic oligonucleotide
  Target: ATXN1; (-) strand; PAM type: NRG; PAM sequence: AAG
attaaatacagaagaaccct

SEQ ID NO: 50542 - DNA, 20 bp, Artificial Sequence
  Description of Artificial Sequence: Synthetic oligonucleotide
  Target: ATXN1; (-) strand; PAM type: NRG; PAM sequence: AAG
gaaggaagaattaaatacag

SEQ ID NO: 50543 - DNA, 20 bp, Artificial Sequence
  Description of Artificial Sequence: Synthetic oligonucleotide
  Target: ATXN1; (-) strand; PAM type: NRG; PAM sequence: CAG
gtggaaggaagaattaaata

SEQ ID NO: 50544 - DNA, 20 bp, Artificial Sequence
  Description of Artificial Sequence: Synthetic oligonucleotide
  Target: ATXN1; (-) strand; PAM type: NRG; PAM sequence: AAG
tcgatattttatgtggaagg

SEQ ID NO: 50545 - DNA, 20 bp, Artificial Sequence
  Description of Artificial Sequence: Synthetic oligonucleotide
  Target: ATXN1; (-) strand; PAM type: NRG; PAM sequence: AGG
gattcgatattttatgtgga

SEQ ID NO: 50546 - DNA, 20 bp, Artificial Sequence
  Description of Artificial Sequence: Synthetic oligonucleotide
  Target: ATXN1; (-) strand; PAM type: NRG; PAM sequence: AAG
tgattcgatattttatgtgg

SEQ ID NO: 50547 - DNA, 20 bp, Artificial Sequence
  Description of Artificial Sequence: Synthetic oligonucleotide
  Target: ATXN1; (-) strand; PAM type: NRG; PAM sequence: TGG
gcctgattcgatattttatg

SEQ ID NO: 50548 - DNA, 20 bp, Artificial Sequence
  Description of Artificial Sequence: Synthetic oligonucleotide
  Target: ATXN1; (-) strand; PAM type: NRG; PAM sequence: TAG
ttttgacaggagatatctga

SEQ ID NO: 50549 - DNA, 20 bp, Artificial Sequence
  Description of Artificial Sequence: Synthetic oligonucleotide
  Target: ATXN1; (-) strand; PAM type: NRG; PAM sequence: GAG
aggtattatatttttgacag

SEQ ID NO: 50550 - DNA, 20 bp, Artificial Sequence
  Description of Artificial Sequence: Synthetic oligonucleotide
  Target: ATXN1; (-) strand; PAM type: NRG; PAM sequence: AGG
tcaggtattatatttttgac

SEQ ID NO: 50551 - DNA, 20 bp, Artificial Sequence
  Description of Artificial Sequence: Synthetic oligonucleotide
  Target: ATXN1; (-) strand; PAM type: NRG; PAM sequence: CAG
ctcaggtattatatttttga

SEQ ID NO: 50552 - DNA, 20 bp, Artificial Sequence
  Description of Artificial Sequence: Synthetic oligonucleotide
  Target: ATXN1; (-) strand; PAM type: NRG; PAM sequence: AGG
aaattattgcagatatcctc

SEQ ID NO: 50553 - DNA, 20 bp, Artificial Sequence
  Description of Artificial Sequence: Synthetic oligonucleotide
  Target: ATXN1; (-) strand; PAM type: NRG; PAM sequence: CAG
aaaattattgcagatatcct

SEQ ID NO: 50554 - DNA, 20 bp, Artificial Sequence
  Description of Artificial Sequence: Synthetic oligonucleotide
  Target: ATXN1; (-) strand; PAM type: NRG; PAM sequence: CAG
ggtaactattaaaattattg

SEQ ID NO: 50555 - DNA, 20 bp, Artificial Sequence
  Description of Artificial Sequence: Synthetic oligonucleotide
  Target: ATXN1; (-) strand; PAM type: NRG; PAM sequence: TGG
tgtagtggatgtttggtcaa

SEQ ID NO: 50556 - DNA, 20 bp, Artificial Sequence
  Description of Artificial Sequence: Synthetic oligonucleotide
  Target: ATXN1; (-) strand; PAM type: NRG; PAM sequence: TGG
cctggcatgtagtggatgtt

SEQ ID NO: 50557 - DNA, 20 bp, Artificial Sequence
  Description of Artificial Sequence: Synthetic oligonucleotide
  Target: ATXN1; (-) strand; PAM type: NRG; PAM sequence: TGG
gtacactacctggcatgtag

SEQ ID NO: 50558 - DNA, 20 bp, Artificial Sequence
  Description of Artificial Sequence: Synthetic oligonucleotide
  Target: ATXN1; (-) strand; PAM type: NRG; PAM sequence: TAG
attgtacactacctggcatg

SEQ ID NO: 50559 - DNA, 20 bp, Artificial Sequence
  Description of Artificial Sequence: Synthetic oligonucleotide
  Target: ATXN1; (-) strand; PAM type: NRG; PAM sequence: TGG
gttgtgtattgtacactacc

SEQ ID NO: 50560 - DNA, 20 bp, Artificial Sequence
  Description of Artificial Sequence: Synthetic oligonucleotide
  Target: ATXN1; (-) strand; PAM type: NRG; PAM sequence: TAG
ttgttgttgttgttaagatt

SEQ ID NO: 50561 - DNA, 20 bp, Artificial Sequence
  Description of Artificial Sequence: Synthetic oligonucleotide
  Target: ATXN1; (-) strand; PAM type: NRG; PAM sequence: AAG
aattcattgttgttgttgtt

SEQ ID NO: 50562 - DNA, 20 bp, Artificial Sequence
  Description of Artificial Sequence: Synthetic oligonucleotide
  Target: ATXN1; (-) strand; PAM type: NRG; PAM sequence: AAG
atgcaattgggagttttaaa

SEQ ID NO: 50563 - DNA, 20 bp, Artificial Sequence
  Description of Artificial Sequence: Synthetic oligonucleotide
  Target: ATXN1; (-) strand; PAM type: NRG; PAM sequence: GAG
ggctgaatttatgcaattgg

SEQ ID NO: 50564 - DNA, 20 bp, Artificial Sequence
  Description of Artificial Sequence: Synthetic oligonucleotide
  Target: ATXN1; (-) strand; PAM type: NRG; PAM sequence: GGG
ctggctgaatttatgcaatt

SEQ ID NO: 50565 - DNA, 20 bp, Artificial Sequence
  Description of Artificial Sequence: Synthetic oligonucleotide
  Target: ATXN1; (-) strand; PAM type: NRG; PAM sequence: TGG
tctggctgaatttatgcaat

SEQ ID NO: 50566 - DNA, 20 bp, Artificial Sequence
  Description of Artificial Sequence: Synthetic oligonucleotide
  Target: ATXN1; (-) strand; PAM type: NRG; PAM sequence: TGG
ttagttgcttttttcctctc

SEQ ID NO: 50567 - DNA, 20 bp, Artificial Sequence
  Description of Artificial Sequence: Synthetic oligonucleotide
  Target: ATXN1; (-) strand; PAM type: NRG; PAM sequence: TAG
gactggtaagttgcttagat

SEQ ID NO: 50568 - DNA, 20 bp, Artificial Sequence
  Description of Artificial Sequence: Synthetic oligonucleotide
  Target: ATXN1; (-) strand; PAM type: NRG; PAM sequence: TAG
ccactgactggtaagttgct

SEQ ID NO: 50569 - DNA, 20 bp, Artificial Sequence
  Description of Artificial Sequence: Synthetic oligonucleotide
  Target: ATXN1; (-) strand; PAM type: NRG; PAM sequence: AAG
tggctcctccactgactggt

SEQ ID NO: 50570 - DNA, 20 bp, Artificial Sequence
  Description of Artificial Sequence: Synthetic oligonucleotide
  Target: ATXN1; (-) strand; PAM type: NRG; PAM sequence: TGG
atcttggctcctccactgac

SEQ ID NO: 50571 - DNA, 20 bp, Artificial Sequence
  Description of Artificial Sequence: Synthetic oligonucleotide
  Target: ATXN1; (-) strand; PAM type: NRG; PAM sequence: TGG
aggaacctggattcacatct

SEQ ID NO: 50572 - DNA, 20 bp, Artificial Sequence
  Description of Artificial Sequence: Synthetic oligonucleotide
  Target: ATXN1; (-) strand; PAM type: NRG; PAM sequence: TGG
gacttggggtcggaggaacc

SEQ ID NO: 50573 - DNA, 20 bp, Artificial Sequence
  Description of Artificial Sequence: Synthetic oligonucleotide
  Target: ATXN1; (-) strand; PAM type: NRG; PAM sequence: AGG
atctatggacttggggtcgg

SEQ ID NO: 50574 - DNA, 20 bp, Artificial Sequence
  Description of Artificial Sequence: Synthetic oligonucleotide
  Target: ATXN1; (-) strand; PAM type: NRG; PAM sequence: GAG
catctatggacttggggtcg

SEQ ID NO: 50575 - DNA, 20 bp, Artificial Sequence
  Description of Artificial Sequence: Synthetic oligonucleotide
  Target: ATXN1; (-) strand; PAM type: NRG; PAM sequence: CGG
cacatctatggacttggggt

SEQ ID NO: 50576 - DNA, 20 bp, Artificial Sequence
  Description of Artificial Sequence: Synthetic oligonucleotide
  Target: ATXN1; (-) strand; PAM type: NRG; PAM sequence: GGG
tgatcacatctatggacttg

SEQ ID NO: 50577 - DNA, 20 bp, Artificial Sequence
  Description of Artificial Sequence: Synthetic oligonucleotide
  Target: ATXN1; (-) strand; PAM type: NRG; PAM sequence: GGG
atgatcacatctatggactt

SEQ ID NO: 50578 - DNA, 20 bp, Artificial Sequence
  Description of Artificial Sequence: Synthetic oligonucleotide
  Target: ATXN1; (-) strand; PAM type: NRG; PAM sequence: TGG
aatgatcacatctatggact

SEQ ID NO: 50579 - DNA, 20 bp, Artificial Sequence
  Description of Artificial Sequence: Synthetic oligonucleotide
  Target: ATXN1; (-) strand; PAM type: NRG; PAM sequence: TGG
tcgtttaatgatcacatcta

SEQ ID NO: 50580 - DNA, 20 bp, Artificial Sequence
  Description of Artificial Sequence: Synthetic oligonucleotide
  Target: ATXN1; (-) strand; PAM type: NRG; PAM sequence: AAG
tattggccatcatgaaaacc

SEQ ID NO: 50581 - DNA, 20 bp, Artificial Sequence
  Description of Artificial Sequence: Synthetic oligonucleotide
  Target: ATXN1; (-) strand; PAM type: NRG; PAM sequence: TGG
catagtaggctttgggttat

SEQ ID NO: 50582 - DNA, 20 bp, Artificial Sequence
  Description of Artificial Sequence: Synthetic oligonucleotide
  Target: ATXN1; (-) strand; PAM type: NRG; PAM sequence: GGG
ccctgtgcatagtaggcttt

SEQ ID NO: 50583 - DNA, 20 bp, Artificial Sequence
  Description of Artificial Sequence: Synthetic oligonucleotide
  Target: ATXN1; (-) strand; PAM type: NRG; PAM sequence: TGG
cccctgtgcatagtaggctt

SEQ ID NO: 50584 - DNA, 20 bp, Artificial Sequence
  Description of Artificial Sequence: Synthetic oligonucleotide
  Target: ATXN1; (-) strand; PAM type: NRG; PAM sequence: AGG
cacactcccctgtgcatagt

SEQ ID NO: 50585 - DNA, 20 bp, Artificial Sequence
  Description of Artificial Sequence: Synthetic oligonucleotide
  Target: ATXN1; (-) strand; PAM type: NRG; PAM sequence: TAG
tcacactcccctgtgcatag

SEQ ID NO: 50586 - DNA, 20 bp, Artificial Sequence
  Description of Artificial Sequence: Synthetic oligonucleotide
  Target: ATXN1; (-) strand; PAM type: NRG; PAM sequence: TAG
tcttcacactcccctgtgca

SEQ ID NO: 50587 - DNA, 20 bp, Artificial Sequence
  Description of Artificial Sequence: Synthetic oligonucleotide
  Target: ATXN1; (-) strand; PAM type: NRG; PAM sequence: GGG
aggctctgccccggcttctc

SEQ ID NO: 50588 - DNA, 20 bp, Artificial Sequence
  Description of Artificial Sequence: Synthetic oligonucleotide
  Target: ATXN1; (-) strand; PAM type: NRG; PAM sequence: CGG
aaggctctgccccggcttct

SEQ ID NO: 50589 - DNA, 20 bp, Artificial Sequence
  Description of Artificial Sequence: Synthetic oligonucleotide
  Target: ATXN1; (-) strand; PAM type: NRG; PAM sequence: CGG
cagtggtcaaggctctgccc

SEQ ID NO: 50590 - DNA, 20 bp, Artificial Sequence
  Description of Artificial Sequence: Synthetic oligonucleotide
  Target: ATXN1; (-) strand; PAM type: NRG; PAM sequence: AGG
taagagactgtcagtggtca

SEQ ID NO: 50591 - DNA, 20 bp, Artificial Sequence
  Description of Artificial Sequence: Synthetic oligonucleotide
  Target: ATXN1; (-) strand; PAM type: NRG; PAM sequence: AAG
ttaagagactgtcagtggtc

SEQ ID NO: 50592 - DNA, 20 bp, Artificial Sequence
  Description of Artificial Sequence: Synthetic oligonucleotide
  Target: ATXN1; (-) strand; PAM type: NRG; PAM sequence: TGG
tttggttaagagactgtcag

SEQ ID NO: 50593 - DNA, 20 bp, Artificial Sequence
  Description of Artificial Sequence: Synthetic oligonucleotide
  Target: ATXN1; (-) strand; PAM type: NRG; PAM sequence: CAG
ttctttggttaagagactgt

SEQ ID NO: 50594 - DNA, 20 bp, Artificial Sequence
  Description of Artificial Sequence: Synthetic oligonucleotide
  Target: ATXN1; (-) strand; PAM type: NRG; PAM sequence: GAG
actgcagattctttggttaa

SEQ ID NO: 50595 - DNA, 20 bp, Artificial Sequence
  Description of Artificial Sequence: Synthetic oligonucleotide
  Target: ATXN1; (-) strand; PAM type: NRG; PAM sequence: AAG
tgactgcagattctttggtt

SEQ ID NO: 50596 - DNA, 20 bp, Artificial Sequence
  Description of Artificial Sequence: Synthetic oligonucleotide
  Target: ATXN1; (-) strand; PAM type: NRG; PAM sequence: TGG
caccgtgactgcagattctt

SEQ ID NO: 50597 - DNA, 20 bp, Artificial Sequence
  Description of Artificial Sequence: Synthetic oligonucleotide
  Target: ATXN1; (-) strand; PAM type: NRG; PAM sequence: CAG
agcccctttcaccgtgactg

SEQ ID NO: 50598 - DNA, 20 bp, Artificial Sequence
  Description of Artificial Sequence: Synthetic oligonucleotide
  Target: ATXN1; (-) strand; PAM type: NRG; PAM sequence: CAG
acagcattgcatgggacctg

SEQ ID NO: 50599 - DNA, 20 bp, Artificial Sequence
  Description of Artificial Sequence: Synthetic oligonucleotide
  Target: ATXN1; (-) strand; PAM type: NRG; PAM sequence: GGG
tgcagctgacagcattgcat

SEQ ID NO: 50600 - DNA, 20 bp, Artificial Sequence
  Description of Artificial Sequence: Synthetic oligonucleotide
  Target: ATXN1; (-) strand; PAM type: NRG; PAM sequence: TGG
ctgcagctgacagcattgca

SEQ ID NO: 50601 - DNA, 20 bp, Artificial Sequence
  Description of Artificial Sequence: Synthetic oligonucleotide
  Target: ATXN1; (-) strand; PAM type: NRG; PAM sequence: CAG
cttcccaggcctgcagctga

SEQ ID NO: 50602 - DNA, 20 bp, Artificial Sequence
  Description of Artificial Sequence: Synthetic oligonucleotide
  Target: ATXN1; (-) strand; PAM type: NRG; PAM sequence: CAG
tggaactcttcccaggcctg

SEQ ID NO: 50603 - DNA, 20 bp, Artificial Sequence
  Description of Artificial Sequence: Synthetic oligonucleotide
  Target: ATXN1; (-) strand; PAM type: NRG; PAM sequence: AGG
ctgctgatggaactcttccc

SEQ ID NO: 50604 - DNA, 20 bp, Artificial Sequence
  Description of Artificial Sequence: Synthetic oligonucleotide
  Target: ATXN1; (-) strand; PAM type: NRG; PAM sequence: CAG
actgctgatggaactcttcc

SEQ ID NO: 50605 - DNA, 20 bp, Artificial Sequence
  Description of Artificial Sequence: Synthetic oligonucleotide
  Target: ATXN1; (-) strand; PAM type: NRG; PAM sequence: TGG
ctgttcatcattactgctga

SEQ ID NO: 50606 - DNA, 20 bp, Artificial Sequence
  Description of Artificial Sequence: Synthetic oligonucleotide
  Target: ATXN1; (-) strand; PAM type: NRG; PAM sequence: AAG
gtgagatagatacacataat

SEQ ID NO: 50607 - DNA, 20 bp, Artificial Sequence
  Description of Artificial Sequence: Synthetic oligonucleotide
  Target: ATXN1; (-) strand; PAM type: NRG; PAM sequence: TAG
ctgtcaagaaggcagtgaga

SEQ ID NO: 50608 - DNA, 20 bp, Artificial Sequence
  Description of Artificial Sequence: Synthetic oligonucleotide
  Target: ATXN1; (-) strand; PAM type: NRG; PAM sequence: GAG
gatcctgtcaagaaggcagt

SEQ ID NO: 50609 - DNA, 20 bp, Artificial Sequence
  Description of Artificial Sequence: Synthetic oligonucleotide
  Target: ATXN1; (-) strand; PAM type: NRG; PAM sequence: CAG
cagagatcctgtcaagaagg

SEQ ID NO: 50610 - DNA, 20 bp, Artificial Sequence
  Description of Artificial Sequence: Synthetic oligonucleotide
  Target: ATXN1; (-) strand; PAM type: NRG; PAM sequence: AGG
tagcagagatcctgtcaaga

SEQ ID NO: 50611 - DNA, 20 bp, Artificial Sequence
  Description of Artificial Sequence: Synthetic oligonucleotide
  Target: ATXN1; (-) strand; PAM type: NRG; PAM sequence: AAG
gtagcagagatcctgtcaag

SEQ ID NO: 50612 - DNA, 20 bp, Artificial Sequence
  Description of Artificial Sequence: Synthetic oligonucleotide
  Target: ATXN1; (-) strand; PAM type: NRG; PAM sequence: AAG
ttggtagcagagatcctgtc

SEQ ID NO: 50613 - DNA, 20 bp, Artificial Sequence
  Description of Artificial Sequence: Synthetic oligonucleotide
  Target: ATXN1; (-) strand; PAM type: NRG; PAM sequence: GAG
agttctgtattttggtagca

SEQ ID NO: 50614 - DNA, 20 bp, Artificial Sequence
  Description of Artificial Sequence: Synthetic oligonucleotide
  Target: ATXN1; (-) strand; PAM type: NRG; PAM sequence: CAG
aaagttctgtattttggtag

SEQ ID NO: 50615 - DNA, 20 bp, Artificial Sequence
  Description of Artificial Sequence: Synthetic oligonucleotide
  Target: ATXN1; (-) strand; PAM type: NRG; PAM sequence: TAG
aggaaagttctgtattttgg

SEQ ID NO: 50616 - DNA, 20 bp, Artificial Sequence
  Description of Artificial Sequence: Synthetic oligonucleotide
  Target: ATXN1; (-) strand; PAM type: NRG; PAM sequence: TGG
ctcaggaaagttctgtattt

SEQ ID NO: 50617 - DNA, 20 bp, Artificial Sequence
  Description of Artificial Sequence: Synthetic oligonucleotide
  Target: ATXN1; (-) strand; PAM type: NRG; PAM sequence: AAG
gtgaagaatcactctcagga

SEQ ID NO: 50618 - DNA, 20 bp, Artificial Sequence
  Description of Artificial Sequence: Synthetic oligonucleotide
  Target: ATXN1; (-) strand; PAM type: NRG; PAM sequence: AGG
ttatgtgaagaatcactctc

SEQ ID NO: 50619 - DNA, 20 bp, Artificial Sequence
  Description of Artificial Sequence: Synthetic oligonucleotide
  Target: ATXN1; (-) strand; PAM type: NRG; PAM sequence: CAG
tttatgtgaagaatcactct

SEQ ID NO: 50620 - DNA, 20 bp, Artificial Sequence
  Description of Artificial Sequence: Synthetic oligonucleotide
  Target: ATXN1; (-) strand; PAM type: NRG; PAM sequence: AAG
atttcatgtgtttttatgtg

SEQ ID NO: 50621 - DNA, 20 bp, Artificial Sequence
  Description of Artificial Sequence: Synthetic oligonucleotide
  Target: ATXN1; (-) strand; PAM type: NRG; PAM sequence: AGG
cttgatcctcagtttttttg

SEQ ID NO: 50622 - DNA, 20 bp, Artificial Sequence
  Description of Artificial Sequence: Synthetic oligonucleotide
  Target: ATXN1; (-) strand; PAM type: NRG; PAM sequence: GAG
acttgatcctcagttttttt

SEQ ID NO: 50623 - DNA, 20 bp, Artificial Sequence
  Description of Artificial Sequence: Synthetic oligonucleotide
  Target: ATXN1; (-) strand; PAM type: NRG; PAM sequence: CAG
agaaaccaccacttgatcct

SEQ ID NO: 50624 - DNA, 20 bp, Artificial Sequence
  Description of Artificial Sequence: Synthetic oligonucleotide
  Target: ATXN1; (-) strand; PAM type: NRG; PAM sequence: GAG
agacaatctagtgctactca

SEQ ID NO: 50625 - DNA, 20 bp, Artificial Sequence
  Description of Artificial Sequence: Synthetic oligonucleotide
  Target: ATXN1; (-) strand; PAM type: NRG; PAM sequence: CAG
gcagacaatctagtgctact

SEQ ID NO: 50626 - DNA, 20 bp, Artificial Sequence
  Description of Artificial Sequence: Synthetic oligonucleotide
  Target: ATXN1; (-) strand; PAM type: NRG; PAM sequence: TAG
tctgatggaagcagacaatc

SEQ ID NO: 50627 - DNA, 20 bp, Artificial Sequence
  Description of Artificial Sequence: Synthetic oligonucleotide
  Target: ATXN1; (-) strand; PAM type: NRG; PAM sequence: CAG
gtccatatgtctgatggaag

SEQ ID NO: 50628 - DNA, 20 bp, Artificial Sequence
  Description of Artificial Sequence: Synthetic oligonucleotide
  Target: ATXN1; (-) strand; PAM type: NRG; PAM sequence: AAG
agagtccatatgtctgatgg

SEQ ID NO: 50629 - DNA, 20 bp, Artificial Sequence
  Description of Artificial Sequence: Synthetic oligonucleotide
  Target: ATXN1; (-) strand; PAM type: NRG; PAM sequence: TGG
aggagagtccatatgtctga

SEQ ID NO: 50630 - DNA, 20 bp, Artificial Sequence
  Description of Artificial Sequence: Synthetic oligonucleotide
  Target: ATXN1; (-) strand; PAM type: NRG; PAM sequence: GAG
ggtcttcccgggtcttagga

SEQ ID NO: 50631 - DNA, 20 bp, Artificial Sequence
  Description of Artificial Sequence: Synthetic oligonucleotide
  Target: ATXN1; (-) strand; PAM type: NRG; PAM sequence: GAG
gtggtcttcccgggtcttag

SEQ ID NO: 50632 - DNA, 20 bp, Artificial Sequence
  Description of Artificial Sequence: Synthetic oligonucleotide
  Target: ATXN1; (-) strand; PAM type: NRG; PAM sequence: AGG
ctgtggtcttcccgggtctt

SEQ ID NO: 50633 - DNA, 20 bp, Artificial Sequence
  Description of Artificial Sequence: Synthetic oligonucleotide
  Target: ATXN1; (-) strand; PAM type: NRG; PAM sequence: TAG
cctgtggtcttcccgggtct

SEQ ID NO: 50634 - DNA, 20 bp, Artificial Sequence
  Description of Artificial Sequence: Synthetic oligonucleotide
  Target: ATXN1; (-) strand; PAM type: NRG; PAM sequence: GGG
tacctgcctgtggtcttccc

SEQ ID NO: 50635 - DNA, 20 bp, Artificial Sequence
  Description of Artificial Sequence: Synthetic oligonucleotide
  Target: ATXN1; (-) strand; PAM type: NRG; PAM sequence: CGG
atacctgcctgtggtcttcc

SEQ ID NO: 50636 - DNA, 20 bp, Artificial Sequence
  Description of Artificial Sequence: Synthetic oligonucleotide
  Target: ATXN1; (-) strand; PAM type: NRG; PAM sequence: TGG
ttcaaaagcatacctgcctg

SEQ ID NO: 50637 - DNA, 20 bp, Artificial Sequence
  Description of Artificial Sequence: Synthetic oligonucleotide
  Target: ATXN1; (-) strand; PAM type: NRG; PAM sequence: AAG
ctcctgcatccttatttcaa

SEQ ID NO: 50638 - DNA, 20 bp, Artificial Sequence
  Description of Artificial Sequence: Synthetic oligonucleotide
  Target: ATXN1; (-) strand; PAM type: NRG; PAM sequence: CAG
atacactttatttgacgtag

SEQ ID NO: 50639 - DNA, 20 bp, Artificial Sequence
  Description of Artificial Sequence: Synthetic oligonucleotide
  Target: ATXN1; (-) strand; PAM type: NRG; PAM sequence: TAG
ctaatacactttatttgacg

SEQ ID NO: 50640 - DNA, 20 bp, Artificial Sequence
  Description of Artificial Sequence: Synthetic oligonucleotide
  Target: ATXN1; (-) strand; PAM type: NRG; PAM sequence: TAG
ttcctttagaagataaatac

SEQ ID NO: 50641 - DNA, 20 bp, Artificial Sequence
  Description of Artificial Sequence: Synthetic oligonucleotide
  Target: ATXN1; (-) strand; PAM type: NRG; PAM sequence: AAG
ggacagcagacttcctttag

SEQ ID NO: 50642 - DNA, 20 bp, Artificial Sequence
  Description of Artificial Sequence: Synthetic oligonucleotide
  Target: ATXN1; (-) strand; PAM type: NRG; PAM sequence: TAG
tgaggacagcagacttcctt

SEQ ID NO: 50643 - DNA, 20 bp, Artificial Sequence
  Description of Artificial Sequence: Synthetic oligonucleotide
  Target: ATXN1; (-) strand; PAM type: NRG; PAM sequence: CAG
gttcccaactgtgaggacag

SEQ ID NO: 50644 - DNA, 20 bp, Artificial Sequence
  Description of Artificial Sequence: Synthetic oligonucleotide
  Target: ATXN1; (-) strand; PAM type: NRG; PAM sequence: CAG
gaagttcccaactgtgagga

SEQ ID NO: 50645 - DNA, 20 bp, Artificial Sequence
  Description of Artificial Sequence: Synthetic oligonucleotide
  Target: ATXN1; (-) strand; PAM type: NRG; PAM sequence: AGG
atgtgaagttcccaactgtg

SEQ ID NO: 50646 - DNA, 20 bp, Artificial Sequence
  Description of Artificial Sequence: Synthetic oligonucleotide
  Target: ATXN1; (-) strand; PAM type: NRG; PAM sequence: GAG
catgtgaagttcccaactgt

SEQ ID NO: 50647 - DNA, 20 bp, Artificial Sequence
  Description of Artificial Sequence: Synthetic oligonucleotide
  Target: ATXN1; (-) strand; PAM type: NRG; PAM sequence: AAG
gctgatagaaatcacatgtg

SEQ ID NO: 50648 - DNA, 20 bp, Artificial Sequence
  Description of Artificial Sequence: Synthetic oligonucleotide
  Target: ATXN1; (-) strand; PAM type: NRG; PAM sequence: TAG
tatggtccataaaatgctga

SEQ ID NO: 50649 - DNA, 20 bp, Artificial Sequence
  Description of Artificial Sequence: Synthetic oligonucleotide
  Target: ATXN1; (-) strand; PAM type: NRG; PAM sequence: TGG
atcatgccagctttctgata

SEQ ID NO: 50650 - DNA, 20 bp, Artificial Sequence
  Description of Artificial Sequence: Synthetic oligonucleotide
  Target: ATXN1; (-) strand; PAM type: NRG; PAM sequence: CAG
tgaatcttattgaatcatgc

SEQ ID NO: 50651 - DNA, 20 bp, Artificial Sequence
  Description of Artificial Sequence: Synthetic oligonucleotide
  Target: ATXN1; (-) strand; PAM type: NRG; PAM sequence: GGG
ttagcactcatgacctcctg

SEQ ID NO: 50652 - DNA, 20 bp, Artificial Sequence
  Description of Artificial Sequence: Synthetic oligonucleotide
  Target: ATXN1; (-) strand; PAM type: NRG; PAM sequence: GGG
gttagcactcatgacctcct

SEQ ID NO: 50653 - DNA, 20 bp, Artificial Sequence
  Description of Artificial Sequence: Synthetic oligonucleotide
  Target: ATXN1; (-) strand; PAM type: NRG; PAM sequence: TGG
ggttagcactcatgacctcc

SEQ ID NO: 50654 - DNA, 20 bp, Artificial Sequence
  Description of Artificial Sequence: Synthetic oligonucleotide
  Target: ATXN1; (-) strand; PAM type: NRG; PAM sequence: TAG
tccactagctgggctgtggt

SEQ ID NO: 50655 - DNA, 20 bp, Artificial Sequence
  Description of Artificial Sequence: Synthetic oligonucleotide
  Target: ATXN1; (-) strand; PAM type: NRG; PAM sequence: TGG
gcattccactagctgggctg

SEQ ID NO: 50656 - DNA, 20 bp, Artificial Sequence
  Description of Artificial Sequence: Synthetic oligonucleotide
  Target: ATXN1; (-) strand; PAM type: NRG; PAM sequence: GGG
cacatagcattccactagct

SEQ ID NO: 50657 - DNA, 20 bp, Artificial Sequence
  Description of Artificial Sequence: Synthetic oligonucleotide
  Target: ATXN1; (-) strand; PAM type: NRG; PAM sequence: TGG
tcacatagcattccactagc

SEQ ID NO: 50658 - DNA, 20 bp, Artificial Sequence
  Description of Artificial Sequence: Synthetic oligonucleotide
  Target: ATXN1; (-) strand; PAM type: NRG; PAM sequence: TAG
aaggtcacatagcattccac

SEQ ID NO: 50659 - DNA, 20 bp, Artificial Sequence
  Description of Artificial Sequence: Synthetic oligonucleotide
  Target: ATXN1; (-) strand; PAM type: NRG; PAM sequence: TAG
acaagtcactaaaggtcaca

SEQ ID NO: 50660 - DNA, 20 bp, Artificial Sequence
  Description of Artificial Sequence: Synthetic oligonucleotide
  Target: ATXN1; (-) strand; PAM type: NRG; PAM sequence: AGG
atgttaaaacaagtcactaa

SEQ ID NO: 50661 - DNA, 20 bp, Artificial Sequence
  Description of Artificial Sequence: Synthetic oligonucleotide
  Target: ATXN1; (-) strand; PAM type: NRG; PAM sequence: AAG
aatgttaaaacaagtcacta

SEQ ID NO: 50662 - DNA, 20 bp, Artificial Sequence
  Description of Artificial Sequence: Synthetic oligonucleotide
  Target: ATXN1; (-) strand; PAM type: NRG; PAM sequence: AAG
aggcatgagaatgttaaaac

SEQ ID NO: 50663 - DNA, 20 bp, Artificial Sequence
  Description of Artificial Sequence: Synthetic oligonucleotide
  Target: ATXN1; (-) strand; PAM type: NRG; PAM sequence: GAG
taacccatgagcagaggcat

SEQ ID NO: 50664 - DNA, 20 bp, Artificial Sequence
  Description of Artificial Sequence: Synthetic oligonucleotide
  Target: ATXN1; (-) strand; PAM type: NRG; PAM sequence: AGG
gttcagtaacccatgagcag

SEQ ID NO: 50665 - DNA, 20 bp, Artificial Sequence
  Description of Artificial Sequence: Synthetic oligonucleotide
  Target: ATXN1; (-) strand; PAM type: NRG; PAM sequence: GAG
agttcagtaacccatgagca

SEQ ID NO: 50666 - DNA, 20 bp, Artificial Sequence
  Description of Artificial Sequence: Synthetic oligonucleotide
  Target: ATXN1; (-) strand; PAM type: NRG; PAM sequence: CAG
aaagttcagtaacccatgag

SEQ ID NO: 50667 - DNA, 20 bp, Artificial Sequence
  Description of Artificial Sequence: Synthetic oligonucleotide
  Target: ATXN1; (-) strand; PAM type: NRG; PAM sequence: GAG
agaaaagttcagtaacccat

SEQ ID NO: 50668 - DNA, 20 bp, Artificial Sequence
  Description of Artificial Sequence: Synthetic oligonucleotide
  Target: ATXN1; (-) strand; PAM type: NRG; PAM sequence: CAG
acccttggattagaaaagtt

SEQ ID NO: 50669 - DNA, 20 bp, Artificial Sequence
  Description of Artificial Sequence: Synthetic oligonucleotide
  Target: ATXN1; (-) strand; PAM type: NRG; PAM sequence: AAG
cagagacccttggattagaa

SEQ ID NO: 50670 - DNA, 20 bp, Artificial Sequence
  Description of Artificial Sequence: Synthetic oligonucleotide
  Target: ATXN1; (-) strand; PAM type: NRG; PAM sequence: TAG
ggatgcagagacccttggat

SEQ ID NO: 50671 - DNA, 20 bp, Artificial Sequence
  Description of Artificial Sequence: Synthetic oligonucleotide
  Target: ATXN1; (-) strand; PAM type: NRG; PAM sequence: TGG
ctgtaggatgcagagaccct

SEQ ID NO: 50672 - DNA, 20 bp, Artificial Sequence
  Description of Artificial Sequence: Synthetic oligonucleotide
  Target: ATXN1; (-) strand; PAM type: NRG; PAM sequence: GAG
tttacagactgtaggatgca

SEQ ID NO: 50673 - DNA, 20 bp, Artificial Sequence
  Description of Artificial Sequence: Synthetic oligonucleotide
  Target: ATXN1; (-) strand; PAM type: NRG; PAM sequence: CAG
gctttacagactgtaggatg

SEQ ID NO: 50674 - DNA, 20 bp, Artificial Sequence
  Description of Artificial Sequence: Synthetic oligonucleotide
  Target: ATXN1; (-) strand; PAM type: NRG; PAM sequence: AGG
gaattagctttacagactgt

SEQ ID NO: 50675 - DNA, 20 bp, Artificial Sequence
  Description of Artificial Sequence: Synthetic oligonucleotide
  Target: ATXN1; (-) strand; PAM type: NRG; PAM sequence: TAG
tgaattagctttacagactg

SEQ ID NO: 50676 - DNA, 20 bp, Artificial Sequence
  Description of Artificial Sequence: Synthetic oligonucleotide
  Target: ATXN1; (-) strand; PAM type: NRG; PAM sequence: CAG
aagcctatgaattagcttta

SEQ ID NO: 50677 - DNA, 20 bp, Artificial Sequence
  Description of Artificial Sequence: Synthetic oligonucleotide
  Target: ATXN1; (-) strand; PAM type: NRG; PAM sequence: TAG
tttgcagcaagcctatgaat

SEQ ID NO: 50678 - DNA, 20 bp, Artificial Sequence
  Description of Artificial Sequence: Synthetic oligonucleotide
  Target: ATXN1; (-) strand; PAM type: NRG; PAM sequence: AAG
gcagtatttatctttgcagc

SEQ ID NO: 50679 - DNA, 20 bp, Artificial Sequence
  Description of Artificial Sequence: Synthetic oligonucleotide
  Target: ATXN1; (-) strand; PAM type: NRG; PAM sequence: CAG
taaagcagtatttatctttg

SEQ ID NO: 50680 - DNA, 20 bp, Artificial Sequence
  Description of Artificial Sequence: Synthetic oligonucleotide
  Target: ATXN1; (-) strand; PAM type: NRG; PAM sequence: CAG
gagcttacttgaatctaaag

SEQ ID NO: 50681 - DNA, 20 bp, Artificial Sequence
  Description of Artificial Sequence: Synthetic oligonucleotide
  Target: ATXN1; (-) strand; PAM type: NRG; PAM sequence: AAG
ccagagcttacttgaatcta

SEQ ID NO: 50682 - DNA, 20 bp, Artificial Sequence
  Description of Artificial Sequence: Synthetic oligonucleotide
  Target: ATXN1; (-) strand; PAM type: NRG; PAM sequence: GAG
atttcttacagtcatatcca

SEQ ID NO: 50683 - DNA, 20 bp, Artificial Sequence
  Description of Artificial Sequence: Synthetic oligonucleotide
  Target: ATXN1; (-) strand; PAM type: NRG; PAM sequence: CAG
atatttcttacagtcatatc

SEQ ID NO: 50684 - DNA, 20 bp, Artificial Sequence
  Description of Artificial Sequence: Synthetic oligonucleotide
  Target: ATXN1; (-) strand; PAM type: NRG; PAM sequence: CAG
tgataattatatatttctta

SEQ ID NO: 50685 - DNA, 20 bp, Artificial Sequence
  Description of Artificial Sequence: Synthetic oligonucleotide
  Target: ATXN1; (-) strand; PAM type: NRG; PAM sequence: AAG
tataaacaaagtaaaataga

SEQ ID NO: 50686 - DNA, 20 bp, Artificial Sequence
  Description of Artificial Sequence: Synthetic oligonucleotide
  Target: ATXN1; (-) strand; PAM type: NRG; PAM sequence: TAG
gcagtataaacaaagtaaaa

SEQ ID NO: 50687 - DNA, 20 bp, Artificial Sequence
  Description of Artificial Sequence: Synthetic oligonucleotide
  Target: ATXN1; (-) strand; PAM type: NRG; PAM sequence: AAG
tcaggagggcagtataaaca

SEQ ID NO: 50688 - DNA, 20 bp, Artificial Sequence
  Description of Artificial Sequence: Synthetic oligonucleotide
  Target: ATXN1; (-) strand; PAM type: NRG; PAM sequence: CAG
gacagcattggtcaggaggg

SEQ ID NO: 50689 - DNA, 20 bp, Artificial Sequence
  Description of Artificial Sequence: Synthetic oligonucleotide
  Target: ATXN1; (-) strand; PAM type: NRG; PAM sequence: GGG
gaagacagcattggtcagga

SEQ ID NO: 50690 - DNA, 20 bp, Artificial Sequence
  Description of Artificial Sequence: Synthetic oligonucleotide
  Target: ATXN1; (-) strand; PAM type: NRG; PAM sequence: AGG
tgaagacagcattggtcagg

SEQ ID NO: 50691 - DNA, 20 bp, Artificial Sequence
  Description of Artificial Sequence: Synthetic oligonucleotide
  Target: ATXN1; (-) strand; PAM type: NRG; PAM sequence: GAG
atgaagacagcattggtcag

SEQ ID NO: 50692 - DNA, 20 bp, Artificial Sequence
  Description of Artificial Sequence: Synthetic oligonucleotide
  Target: ATXN1; (-) strand; PAM type: NRG; PAM sequence: AGG
aaatgaagacagcattggtc

SEQ ID NO: 50693 - DNA, 20 bp, Artificial Sequence
  Description of Artificial Sequence: Synthetic oligonucleotide
  Target: ATXN1; (-) strand; PAM type: NRG; PAM sequence: CAG
taaatgaagacagcattggt

SEQ ID NO: 50694 - DNA, 20 bp, Artificial Sequence
  Description of Artificial Sequence: Synthetic oligonucleotide
  Target: ATXN1; (-) strand; PAM type: NRG; PAM sequence: TGG
taagtaaatgaagacagcat

SEQ ID NO: 50695 - DNA, 20 bp, Artificial Sequence
  Description of Artificial Sequence: Synthetic oligonucleotide
  Target: ATXN1; (-) strand; PAM type: NRG; PAM sequence: CAG
ggtaattaagtaaatgaaga

SEQ ID NO: 50696 - DNA, 20 bp, Artificial Sequence
  Description of Artificial Sequence: Synthetic oligonucleotide
  Target: ATXN1; (-) strand; PAM type: NRG; PAM sequence: AAG
ggatggtaattaagtaaatg

SEQ ID NO: 50697 - DNA, 20 bp, Artificial Sequence
  Description of Artificial Sequence: Synthetic oligonucleotide
  Target: ATXN1; (-) strand; PAM type: NRG; PAM sequence: AAG
aaggatgatggatggtaatt

SEQ ID NO: 50698 - DNA, 20 bp, Artificial Sequence
  Description of Artificial Sequence: Synthetic oligonucleotide
  Target: ATXN1; (-) strand; PAM type: NRG; PAM sequence: TGG
gaaaagacaaggatgatgga

SEQ ID NO: 50699 - DNA, 20 bp, Artificial Sequence
  Description of Artificial Sequence: Synthetic oligonucleotide
  Target: ATXN1; (-) strand; PAM type: NRG; PAM sequence: TGG
tcaggaaaagacaaggatga

SEQ ID NO: 50700 - DNA, 20 bp, Artificial Sequence
  Description of Artificial Sequence: Synthetic oligonucleotide
  Target: ATXN1; (-) strand; PAM type: NRG; PAM sequence: AGG
atagtgctcaggaaaagaca

SEQ ID NO: 50701 - DNA, 20 bp, Artificial Sequence
  Description of Artificial Sequence: Synthetic oligonucleotide
  Target: ATXN1; (-) strand; PAM type: NRG; PAM sequence: AAG
catagtgctcaggaaaagac

SEQ ID NO: 50702 - DNA, 20 bp, Artificial Sequence
  Description of Artificial Sequence: Synthetic oligonucleotide
  Target: ATXN1; (-) strand; PAM type: NRG; PAM sequence: AAG
aggcacatagtgctcaggaa

SEQ ID NO: 50703 - DNA, 20 bp, Artificial Sequence
  Description of Artificial Sequence: Synthetic oligonucleotide
  Target: ATXN1; (-) strand; PAM type: NRG; PAM sequence: AGG
aatttaggcacatagtgctc

SEQ ID NO: 50704 - DNA, 20 bp, Artificial Sequence
  Description of Artificial Sequence: Synthetic oligonucleotide
  Target: ATXN1; (-) strand; PAM type: NRG; PAM sequence: CAG
taatttaggcacatagtgct

SEQ ID NO: 50705 - DNA, 20 bp, Artificial Sequence
  Description of Artificial Sequence: Synthetic oligonucleotide
  Target: ATXN1; (-) strand; PAM type: NRG; PAM sequence: TAG
atctttttaatttaggcaca

SEQ ID NO: 50706 - DNA, 20 bp, Artificial Sequence
  Description of Artificial Sequence: Synthetic oligonucleotide
  Target: ATXN1; (-) strand; PAM type: NRG; PAM sequence: AGG
cactatcatctttttaattt

SEQ ID NO: 50707 - DNA, 20 bp, Artificial Sequence
  Description of Artificial Sequence: Synthetic oligonucleotide
  Target: ATXN1; (-) strand; PAM type: NRG; PAM sequence: TAG
ccactatcatctttttaatt

SEQ ID NO: 50708 - DNA, 20 bp, Artificial Sequence
  Description of Artificial Sequence: Synthetic oligonucleotide
  Target: ATXN1; (-) strand; PAM type: NRG; PAM sequence: GGG
caggcgtgagccaccacgcc

SEQ ID NO: 50709 - DNA, 20 bp, Artificial Sequence
  Description of Artificial Sequence: Synthetic oligonucleotide
  Target: ATXN1; (-) strand; PAM type: NRG; PAM sequence: CGG
acaggcgtgagccaccacgc

SEQ ID NO: 50710 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 50711 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 50712 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 50713 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 50714 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgc

SEQ ID NO: 50715 - DNA, 20 bp, Artificial Sequence
  Description of Artificial Sequence: Synthetic oligonucleotide
  Target: ATXN1; (-) strand; PAM type: NRG; PAM sequence: AAG
ctgcccgccttggcctccca

SEQ ID NO: 50716 - DNA, 20 bp, Artificial Sequence
  Description of Artificial Sequence: Synthetic oligonucleotide
  Target: ATXN1; (-) strand; PAM type: NRG; PAM sequence: TGG
acctcgtgatctgcccgcct

SEQ ID NO: 50717 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggtcaggc

SEQ ID NO: 50718 - DNA, 20 bp, Artificial Sequence
  Description of Artificial Sequence: Synthetic oligonucleotide
  Target: ATXN1; (-) strand; PAM type: NRG; PAM sequence: AGG
gaggtttcaccatgttggtc

SEQ ID NO: 50719 - DNA, 20 bp, Artificial Sequence
  Description of Artificial Sequence: Synthetic oligonucleotide
  Target: ATXN1; (-) strand; PAM type: NRG; PAM sequence: CAG
cgaggtttcaccatgttggt

SEQ ID NO: 50720 - DNA, 20 bp, Artificial Sequence
  Description of Artificial Sequence: Synthetic oligonucleotide
  Target: ATXN1; (-) strand; PAM type: NRG; PAM sequence: TGG
cagacgaggtttcaccatgt

SEQ ID NO: 50721 - DNA, 20 bp, Artificial Sequence
  Description of Artificial Sequence: Synthetic oligonucleotide
  Target: ATXN1; (-) strand; PAM type: NRG; PAM sequence: AGG
ttgtacttttagtacagacg

SEQ ID NO: 50722 - DNA, 20 bp, Artificial Sequence
  Description of Artificial Sequence: Synthetic oligonucleotide
  Target: ATXN1; (-) strand; PAM type: NRG; PAM sequence: GAG
tttgtacttttagtacagac

SEQ ID NO: 50723 - DNA, 20 bp, Artificial Sequence
  Description of Artificial Sequence: Synthetic oligonucleotide
  Target: ATXN1; (-) strand; PAM type: NRG; PAM sequence: CAG
taatttttgtacttttagta

SEQ ID NO: 50724 - DNA, 20 bp, Artificial Sequence
  Description of Artificial Sequence: Synthetic oligonucleotide
  Target: ATXN1; (-) strand; PAM type: NRG; PAM sequence: TAG
ccggctaatttttgtacttt

SEQ ID NO: 50725 - DNA, 20 bp, Artificial Sequence
  Description of Artificial Sequence: Synthetic oligonucleotide
  Target: ATXN1; (-) strand; PAM type: NRG; PAM sequence: CGG
caggcgcgtgccaccacgcc

SEQ ID NO: 50726 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgagatgac

SEQ ID NO: 50727 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgagatga

SEQ ID NO: 50728 - DNA, 20 bp, Artificial Sequence
  Description of Artificial Sequence: Synthetic oligonucleotide
  Target: ATXN1; (-) strand; PAM type: NRG; PAM sequence: GAG
cctcagcctcccgagtagct

SEQ ID NO: 50729 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 50730 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 50731 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgcct

SEQ ID NO: 50732 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcccgggttc

SEQ ID NO: 50733 - DNA, 20 bp, Artificial Sequence
  Description of Artificial Sequence: Synthetic oligonucleotide
  Target: ATXN1; (-) strand; PAM type: NRG; PAM sequence: GGG
cactacaacctccgcctccc

SEQ ID NO: 50734 - DNA, 20 bp, Artificial Sequence
  Description of Artificial Sequence: Synthetic oligonucleotide
  Target: ATXN1; (-) strand; PAM type: NRG; PAM sequence: CGG
tcactacaacctccgcctcc

SEQ ID NO: 50735 - DNA, 20 bp, Artificial Sequence
  Description of Artificial Sequence: Synthetic oligonucleotide
  Target: ATXN1; (-) strand; PAM type: NRG; PAM sequence: TGG
tcactcaggctggagtgcag

SEQ ID NO: 50736 - DNA, 20 bp, Artificial Sequence
  Description of Artificial Sequence: Synthetic oligonucleotide
  Target: ATXN1; (-) strand; PAM type: NRG; PAM sequence: CAG
ctgtcactcaggctggagtg

SEQ ID NO: 50737 - DNA, 20 bp, Artificial Sequence
  Description of Artificial Sequence: Synthetic oligonucleotide
  Target: ATXN1; (-) strand; PAM type: NRG; PAM sequence: GAG
tcgctctgtcactcaggctg

SEQ ID NO: 50738 - DNA, 20 bp, Artificial Sequence
  Description of Artificial Sequence: Synthetic oligonucleotide
  Target: ATXN1; (-) strand; PAM type: NRG; PAM sequence: TGG
tctcgctctgtcactcaggc

SEQ ID NO: 50739 - DNA, 20 bp, Artificial Sequence
  Description of Artificial Sequence: Synthetic oligonucleotide
  Target: ATXN1; (-) strand; PAM type: NRG; PAM sequence: AGG
ggagtctcgctctgtcactc

SEQ ID NO: 50740 - DNA, 20 bp, Artificial Sequence
  Description of Artificial Sequence: Synthetic oligonucleotide
  Target: ATXN1; (-) strand; PAM type: NRG; PAM sequence: CAG
tggagtctcgctctgtcact

SEQ ID NO: 50741 - DNA, 20 bp, Artificial Sequence
  Description of Artificial Sequence: Synthetic oligonucleotide
  Target: ATXN1; (-) strand; PAM type: NRG; PAM sequence: GAG
tttctttttttttggagatg

SEQ ID NO: 50742 - DNA, 20 bp, Artificial Sequence
  Description of Artificial Sequence: Synthetic oligonucleotide
  Target: ATXN1; (-) strand; PAM type: NRG; PAM sequence: TGG
tttttctttttttttggaga

SEQ ID NO: 50743 - DNA, 20 bp, Artificial Sequence
  Description of Artificial Sequence: Synthetic oligonucleotide
  Target: ATXN1; (-) strand; PAM type: NRG; PAM sequence: GAG
tttttttttctttttttttg

SEQ ID NO: 50744 - DNA, 20 bp, Artificial Sequence
  Description of Artificial Sequence: Synthetic oligonucleotide
  Target: ATXN1; (-) strand; PAM type: NRG; PAM sequence: TGG
tttttttttttctttttttt

SEQ ID NO: 50745 - DNA, 20 bp, Artificial Sequence
  Description of Artificial Sequence: Synthetic oligonucleotide
  Target: ATXN1; (-) strand; PAM type: NRG; PAM sequence: GGG
ccgtgtatatttgctaccaa

SEQ ID NO: 50746 - DNA, 20 bp, Artificial Sequence
  Description of Artificial Sequence: Synthetic oligonucleotide
  Target: ATXN1; (-) strand; PAM type: NRG; PAM sequence: AGG
tccgtgtatatttgctacca

SEQ ID NO: 50747 - DNA, 20 bp, Artificial Sequence
  Description of Artificial Sequence: Synthetic oligonucleotide
  Target: ATXN1; (-) strand; PAM type: NRG; PAM sequence: AAG
ttccgtgtatatttgctacc

SEQ ID NO: 50748 - DNA, 20 bp, Artificial Sequence
  Description of Artificial Sequence: Synthetic oligonucleotide
  Target: ATXN1; (-) strand; PAM type: NRG; PAM sequence: TGG
ttagaactgcataaaccaca

SEQ ID NO: 50749 - DNA, 20 bp, Artificial Sequence
  Description of Artificial Sequence: Synthetic oligonucleotide
  Target: ATXN1; (-) strand; PAM type: NRG; PAM sequence: TAG
caatatctgtcgctttcttt

SEQ ID NO: 50750 - DNA, 20 bp, Artificial Sequence
  Description of Artificial Sequence: Synthetic oligonucleotide
  Target: ATXN1; (-) strand; PAM type: NRG; PAM sequence: CAG
gaaattgggaagtgggtcta

SEQ ID NO: 50751 - DNA, 20 bp, Artificial Sequence
  Description of Artificial Sequence: Synthetic oligonucleotide
  Target: ATXN1; (-) strand; PAM type: NRG; PAM sequence: GGG
gtcaaatgaaattgggaagt

SEQ ID NO: 50752 - DNA, 20 bp, Artificial Sequence
  Description of Artificial Sequence: Synthetic oligonucleotide
  Target: ATXN1; (-) strand; PAM type: NRG; PAM sequence: TGG
agtcaaatgaaattgggaag

SEQ ID NO: 50753 - DNA, 20 bp, Artificial Sequence
  Description of Artificial Sequence: Synthetic oligonucleotide
  Target: ATXN1; (-) strand; PAM type: NRG; PAM sequence: AAG
ggaagtcaaatgaaattggg

SEQ ID NO: 50754 - DNA, 20 bp, Artificial Sequence
  Description of Artificial Sequence: Synthetic oligonucleotide
  Target: ATXN1; (-) strand; PAM type: NRG; PAM sequence: GGG
aaaggaagtcaaatgaaatt

SEQ ID NO: 50755 - DNA, 20 bp, Artificial Sequence
  Description of Artificial Sequence: Synthetic oligonucleotide
  Target: ATXN1; (-) strand; PAM type: NRG; PAM sequence: TGG
aaaaggaagtcaaatgaaat

SEQ ID NO: 50756 - DNA, 20 bp, Artificial Sequence
  Description of Artificial Sequence: Synthetic oligonucleotide
  Target: ATXN1; (-) strand; PAM type: NRG; PAM sequence: AAG
aggactctcaaggcaaaagg

SEQ ID NO: 50757 - DNA, 20 bp, Artificial Sequence
  Description of Artificial Sequence: Synthetic oligonucleotide
  Target: ATXN1; (-) strand; PAM type: NRG; PAM sequence: AGG
ttaaggactctcaaggcaaa

SEQ ID NO: 50758 - DNA, 20 bp, Artificial Sequence
  Description of Artificial Sequence: Synthetic oligonucleotide
  Target: ATXN1; (-) strand; PAM type: NRG; PAM sequence: AAG
attaaggactctcaaggcaa

SEQ ID NO: 50759 - DNA, 20 bp, Artificial Sequence
  Description of Artificial Sequence: Synthetic oligonucleotide
  Target: ATXN1; (-) strand; PAM type: NRG; PAM sequence: AGG
aagaaaattaaggactctca

SEQ ID NO: 50760 - DNA, 20 bp, Artificial Sequence
  Description of Artificial Sequence: Synthetic oligonucleotide
  Target: ATXN1; (-) strand; PAM type: NRG; PAM sequence: AAG
caagaaaattaaggactctc

SEQ ID NO: 50761 - DNA, 20 bp, Artificial Sequence
  Description of Artificial Sequence: Synthetic oligonucleotide
  Target: ATXN1; (-) strand; PAM type: NRG; PAM sequence: AGG
taaagaagacaagaaaatta

SEQ ID NO: 50762 - DNA, 20 bp, Artificial Sequence
  Description of Artificial Sequence: Synthetic oligonucleotide
  Target: ATXN1; (-) strand; PAM type: NRG; PAM sequence: AAG
ctaaagaagacaagaaaatt

SEQ ID NO: 50763 - DNA, 20 bp, Artificial Sequence
  Description of Artificial Sequence: Synthetic oligonucleotide
  Target: ATXN1; (-) strand; PAM type: NRG; PAM sequence: AAG
tcttacagcctaaagaagac

SEQ ID NO: 50764 - DNA, 20 bp, Artificial Sequence
  Description of Artificial Sequence: Synthetic oligonucleotide
  Target: ATXN1; (-) strand; PAM type: NRG; PAM sequence: AAG
agtagtcttacagcctaaag

SEQ ID NO: 50765 - DNA, 20 bp, Artificial Sequence
  Description of Artificial Sequence: Synthetic oligonucleotide
  Target: ATXN1; (-) strand; PAM type: NRG; PAM sequence: AAG
ttcagtagtcttacagccta

SEQ ID NO: 50766 - DNA, 20 bp, Artificial Sequence
  Description of Artificial Sequence: Synthetic oligonucleotide
  Target: ATXN1; (-) strand; PAM type: NRG; PAM sequence: CAG
tcattcattcagtagtctta

SEQ ID NO: 50767 - DNA, 20 bp, Artificial Sequence
  Description of Artificial Sequence: Synthetic oligonucleotide
  Target: ATXN1; (-) strand; PAM type: NRG; PAM sequence: TAG
cctccccttcattcattcag

SEQ ID NO: 50768 - DNA, 20 bp, Artificial Sequence
  Description of Artificial Sequence: Synthetic oligonucleotide
  Target: ATXN1; (-) strand; PAM type: NRG; PAM sequence: CAG
ctgcctccccttcattcatt

SEQ ID NO: 50769 - DNA, 20 bp, Artificial Sequence
  Description of Artificial Sequence: Synthetic oligonucleotide
  Target: ATXN1; (-) strand; PAM type: NRG; PAM sequence: AAG
tgtcgataagttcagaaacc

SEQ ID NO: 50770 - DNA, 20 bp, Artificial Sequence
  Description of Artificial Sequence: Synthetic oligonucleotide
  Target: ATXN1; (-) strand; PAM type: NRG; PAM sequence: CAG
gaaaggattgtcgataagtt

SEQ ID NO: 50771 - DNA, 20 bp, Artificial Sequence
  Description of Artificial Sequence: Synthetic oligonucleotide
  Target: ATXN1; (-) strand; PAM type: NRG; PAM sequence: AAG
gtagtgaaaggattgtcgat

SEQ ID NO: 50772 - DNA, 20 bp, Artificial Sequence
  Description of Artificial Sequence: Synthetic oligonucleotide
  Target: ATXN1; (-) strand; PAM type: NRG; PAM sequence: AGG
tgcgtagttcttgtagtgaa

SEQ ID NO: 50773 - DNA, 20 bp, Artificial Sequence
  Description of Artificial Sequence: Synthetic oligonucleotide
  Target: ATXN1; (-) strand; PAM type: NRG; PAM sequence: AAG
ctgcgtagttcttgtagtga

SEQ ID NO: 50774 - DNA, 20 bp, Artificial Sequence
  Description of Artificial Sequence: Synthetic oligonucleotide
  Target: ATXN1; (-) strand; PAM type: NRG; PAM sequence: TAG
tatctgctgcgtagttcttg

SEQ ID NO: 50775 - DNA, 20 bp, Artificial Sequence
  Description of Artificial Sequence: Synthetic oligonucleotide
  Target: ATXN1; (-) strand; PAM type: NRG; PAM sequence: TAG
ctcgctttttatctgctgcg

SEQ ID NO: 50776 - DNA, 20 bp, Artificial Sequence
  Description of Artificial Sequence: Synthetic oligonucleotide
  Target: ATXN1; (-) strand; PAM type: NRG; PAM sequence: AGG
ccagaaggaaaatgagcaga

SEQ ID NO: 50777 - DNA, 20 bp, Artificial Sequence
  Description of Artificial Sequence: Synthetic oligonucleotide
  Target: ATXN1; (-) strand; PAM type: NRG; PAM sequence: AAG
tccagaaggaaaatgagcag

SEQ ID NO: 50778 - DNA, 20 bp, Artificial Sequence
  Description of Artificial Sequence: Synthetic oligonucleotide
  Target: ATXN1; (-) strand; PAM type: NRG; PAM sequence: CAG
tcctccagaaggaaaatgag

SEQ ID NO: 50779 - DNA, 20 bp, Artificial Sequence
  Description of Artificial Sequence: Synthetic oligonucleotide
  Target: ATXN1; (-) strand; PAM type: NRG; PAM sequence: GAG
ttttcctccagaaggaaaat

SEQ ID NO: 50780 - DNA, 20 bp, Artificial Sequence
  Description of Artificial Sequence: Synthetic oligonucleotide
  Target: ATXN1; (-) strand; PAM type: NRG; PAM sequence: AGG
atgttttcttttcctccaga

SEQ ID NO: 50781 - DNA, 20 bp, Artificial Sequence
  Description of Artificial Sequence: Synthetic oligonucleotide
  Target: ATXN1; (-) strand; PAM type: NRG; PAM sequence: AAG
tatgttttcttttcctccag

SEQ ID NO: 50782 - DNA, 20 bp, Artificial Sequence
  Description of Artificial Sequence: Synthetic oligonucleotide
  Target: ATXN1; (-) strand; PAM type: NRG; PAM sequence: CAG
ttctatgttttcttttcctc

SEQ ID NO: 50783 - DNA, 20 bp, Artificial Sequence
  Description of Artificial Sequence: Synthetic oligonucleotide
  Target: ATXN1; (-) strand; PAM type: NRG; PAM sequence: TAG
ggtacacctgaatgtttagt

SEQ ID NO: 50784 - DNA, 20 bp, Artificial Sequence
  Description of Artificial Sequence: Synthetic oligonucleotide
  Target: ATXN1; (-) strand; PAM type: NRG; PAM sequence: TAG
tcagggtacacctgaatgtt

SEQ ID NO: 50785 - DNA, 20 bp, Artificial Sequence
  Description of Artificial Sequence: Synthetic oligonucleotide
  Target: ATXN1; (-) strand; PAM type: NRG; PAM sequence: GGG
tgcagtgcctatgtgagtca

SEQ ID NO: 50786 - DNA, 20 bp, Artificial Sequence
  Description of Artificial Sequence: Synthetic oligonucleotide
  Target: ATXN1; (-) strand; PAM type: NRG; PAM sequence: AGG
ttgcagtgcctatgtgagtc

SEQ ID NO: 50787 - DNA, 20 bp, Artificial Sequence
  Description of Artificial Sequence: Synthetic oligonucleotide
  Target: ATXN1; (-) strand; PAM type: NRG; PAM sequence: CAG
attgcagtgcctatgtgagt

SEQ ID NO: 50788 - DNA, 20 bp, Artificial Sequence
  Description of Artificial Sequence: Synthetic oligonucleotide
  Target: ATXN1; (-) strand; PAM type: NRG; PAM sequence: GAG
aacgattgcagtgcctatgt

SEQ ID NO: 50789 - DNA, 20 bp, Artificial Sequence
  Description of Artificial Sequence: Synthetic oligonucleotide
  Target: ATXN1; (-) strand; PAM type: NRG; PAM sequence: CAG
tatttgaaatagaacgattg

SEQ ID NO: 50790 - DNA, 20 bp, Artificial Sequence
  Description of Artificial Sequence: Synthetic oligonucleotide
  Target: ATXN1; (-) strand; PAM type: NRG; PAM sequence: TAG
ctggtcccacttatttgaaa

SEQ ID NO: 50791 - DNA, 20 bp, Artificial Sequence
  Description of Artificial Sequence: Synthetic oligonucleotide
  Target: ATXN1; (-) strand; PAM type: NRG; PAM sequence: TGG
aacctgtgagccctgtgggc

SEQ ID NO: 50792 - DNA, 20 bp, Artificial Sequence
  Description of Artificial Sequence: Synthetic oligonucleotide
  Target: ATXN1; (-) strand; PAM type: NRG; PAM sequence: GGG
aatgaacctgtgagccctgt

SEQ ID NO: 50793 - DNA, 20 bp, Artificial Sequence
  Description of Artificial Sequence: Synthetic oligonucleotide
  Target: ATXN1; (-) strand; PAM type: NRG; PAM sequence: TGG
caatgaacctgtgagccctg

SEQ ID NO: 50794 - DNA, 20 bp, Artificial Sequence
  Description of Artificial Sequence: Synthetic oligonucleotide
  Target: ATXN1; (-) strand; PAM type: NRG; PAM sequence: GAG
gttgtgtgcaatgaacctgt

SEQ ID NO: 50795 - DNA, 20 bp, Artificial Sequence
  Description of Artificial Sequence: Synthetic oligonucleotide
  Target: ATXN1; (-) strand; PAM type: NRG; PAM sequence: TAG
gaaggaacaggttaagcatt

SEQ ID NO: 50796 - DNA, 20 bp, Artificial Sequence
  Description of Artificial Sequence: Synthetic oligonucleotide
  Target: ATXN1; (-) strand; PAM type: NRG; PAM sequence: AAG
gctgttggaaggaacaggtt

SEQ ID NO: 50797 - DNA, 20 bp, Artificial Sequence
  Description of Artificial Sequence: Synthetic oligonucleotide
  Target: ATXN1; (-) strand; PAM type: NRG; PAM sequence: AGG
cacctgctgttggaaggaac

SEQ ID NO: 50798 - DNA, 20 bp, Artificial Sequence
  Description of Artificial Sequence: Synthetic oligonucleotide
  Target: ATXN1; (-) strand; PAM type: NRG; PAM sequence: CAG
acacctgctgttggaaggaa

SEQ ID NO: 50799 - DNA, 20 bp, Artificial Sequence
  Description of Artificial Sequence: Synthetic oligonucleotide
  Target: ATXN1; (-) strand; PAM type: NRG; PAM sequence: AGG
acatgacacctgctgttgga

SEQ ID NO: 50800 - DNA, 20 bp, Artificial Sequence
  Description of Artificial Sequence: Synthetic oligonucleotide
  Target: ATXN1; (-) strand; PAM type: NRG; PAM sequence: AAG
cacatgacacctgctgttgg

SEQ ID NO: 50801 - DNA, 20 bp, Artificial Sequence
  Description of Artificial Sequence: Synthetic oligonucleotide
  Target: ATXN1; (-) strand; PAM type: NRG; PAM sequence: TGG
ttgcacatgacacctgctgt

SEQ ID NO: 50802 - DNA, 20 bp, Artificial Sequence
  Description of Artificial Sequence: Synthetic oligonucleotide
  Target: ATXN1; (-) strand; PAM type: NRG; PAM sequence: TAG
tcttaatactgatcctgggc

SEQ ID NO: 50803 - DNA, 20 bp, Artificial Sequence
  Description of Artificial Sequence: Synthetic oligonucleotide
  Target: ATXN1; (-) strand; PAM type: NRG; PAM sequence: GGG
ggactcttaatactgatcct

SEQ ID NO: 50804 - DNA, 20 bp, Artificial Sequence
  Description of Artificial Sequence: Synthetic oligonucleotide
  Target: ATXN1; (-) strand; PAM type: NRG; PAM sequence: TGG
aggactcttaatactgatcc

SEQ ID NO: 50805 - DNA, 20 bp, Artificial Sequence
  Description of Artificial Sequence: Synthetic oligonucleotide
  Target: ATXN1; (-) strand; PAM type: NRG; PAM sequence: AGG
tacaaaaggtgaacgtacac

SEQ ID NO: 50806 - DNA, 20 bp, Artificial Sequence
  Description of Artificial Sequence: Synthetic oligonucleotide
  Target: ATXN1; (-) strand; PAM type: NRG; PAM sequence: CAG
ttacaaaaggtgaacgtaca

SEQ ID NO: 50807 - DNA, 20 bp, Artificial Sequence
  Description of Artificial Sequence: Synthetic oligonucleotide
  Target: ATXN1; (-) strand; PAM type: NRG; PAM sequence: AGG
tcagtgagaggatttacaaa

SEQ ID NO: 50808 - DNA, 20 bp, Artificial Sequence
  Description of Artificial Sequence: Synthetic oligonucleotide
  Target: ATXN1; (-) strand; PAM type: NRG; PAM sequence: AAG
gtcagtgagaggatttacaa

SEQ ID NO: 50809 - DNA, 20 bp, Artificial Sequence
  Description of Artificial Sequence: Synthetic oligonucleotide
  Target: ATXN1; (-) strand; PAM type: NRG; PAM sequence: AGG
tggtgcagtgagtcagtgag

SEQ ID NO: 50810 - DNA, 20 bp, Artificial Sequence
  Description of Artificial Sequence: Synthetic oligonucleotide
  Target: ATXN1; (-) strand; PAM type: NRG; PAM sequence: GAG
ttggtgcagtgagtcagtga
